United States Patent 10,835,585 (SHARED NEOANTIGENS) - sequence listing, part 2

SEQ ID NO: 10782 - protein, 10 aa, Artificial Sequence
  source: /note="Description of Artificial Sequence: Synthetic peptide"
CELLSFLLVW

SEQ ID NO: 10783 - protein, 10 aa, Artificial Sequence
  source: /note="Description of Artificial Sequence: Synthetic peptide"
LVWDYIGINM

SEQ ID NO: 10784 - protein, 9 aa, Artificial Sequence
  source: /note="Description of Artificial Sequence: Synthetic peptide"
QLQEKTIHY

SEQ ID NO: 10785 - protein, 10 aa, Artificial Sequence
  source: /note="Description of Artificial Sequence: Synthetic peptide"
QLQEKTIHYR

SEQ ID NO: 10786 - protein, 10 aa, Artificial Sequence
  source: /note="Description of Artificial Sequence: Synthetic peptide"
NQLQEKTIHY

SEQ ID NO: 10787 - protein, 9 aa, Artificial Sequence
  source: /note="Description of Artificial Sequence: Synthetic peptide"
QLVAVGVIK

SEQ ID NO: 10788 - protein, 9 aa, Artificial Sequence
  source: /note="Description of Artificial Sequence: Synthetic peptide"
AVRDMRQLV

SEQ ID NO: 10789 - protein, 9 aa, Artificial Sequence
  source: /note="Description of Artificial Sequence: Synthetic peptide"
FAVRDMRQL

SEQ ID NO: 10790 - protein, 9 aa, Artificial Sequence
  source: /note="Description of Artificial Sequence: Synthetic peptide"
RDMRQLVAV

SEQ ID NO: 10791 - protein, 9 aa, Artificial Sequence
  source: /note="Description of Artificial Sequence: Synthetic peptide"
RQLVAVGVI

SEQ ID NO: 10792 - protein, 10 aa, Artificial Sequence
  source: /note="Description of Artificial Sequence: Synthetic peptide"
QLVAVGVIKA

SEQ ID NO: 10793 - protein, 10 aa, Artificial Sequence
  source: /note="Description of Artificial Sequence: Synthetic peptide"
LVAVGVIKAV

SEQ ID NO: 10794 - protein, 10 aa, Artificial Sequence
  source: /note="Description of Artificial Sequence: Synthetic peptide"
AVRDMRQLVA

SEQ ID NO: 10795 - protein, 10 aa, Artificial Sequence
  source: /note="Description of Artificial Sequence: Synthetic peptide"
RQLVAVGVIK

SEQ ID NO: 10796 - protein, 10 aa, Artificial Sequence
  source: /note="Description of Artificial Sequence: Synthetic peptide"
FAVRDMRQLV

SEQ ID NO: 10797 - protein, 9 aa, Artificial Sequence
  source: /note="Description of Artificial Sequence: Synthetic peptide"
ESFSQSPPL

SEQ ID NO: 10798 - protein, 9 aa, Artificial Sequence
  source: /note="Description of Artificial Sequence: Synthetic peptide"
SPPLGRFAV

SEQ ID NO: 10799 - protein, 9 aa, Artificial Sequence
  source: /note="Description of Artificial Sequence: Synthetic peptide"
SQSPPLGRF

SEQ ID NO: 10800 - protein, 10 aa, Artificial Sequence
  source: /note="Description of Artificial Sequence: Synthetic peptide"
SFSQSPPLGR

SEQ ID NO: 10801 - protein, 10 aa, Artificial Sequence
  source: /note="Description of Artificial Sequence: Synthetic peptide"
VESFSQSPPL

SEQ ID NO: 10802 - protein, 10 aa, Artificial Sequence
  source: /note="Description of Artificial Sequence: Synthetic peptide"
FSQSPPLGRF

SEQ ID NO: 10803 - protein, 10 aa, Artificial Sequence
  source: /note="Description of Artificial Sequence: Synthetic peptide"
SQSPPLGRFA

SEQ ID NO: 10804 - protein, 9 aa, Artificial Sequence
  source: /note="Description of Artificial Sequence: Synthetic peptide"
EAVSGPPPA

SEQ ID NO: 10805 - protein, 9 aa, Artificial Sequence
  source: /note="Description of Artificial Sequence: Synthetic peptide"
FEAVSGPPP

SEQ ID NO: 10806 - protein, 10 aa, Artificial Sequence
  source: /note="Description of Artificial Sequence: Synthetic peptide"
FEAVSGPPPA

SEQ ID NO: 10807 - protein, 9 aa, Artificial Sequence
  source: /note="Description of Artificial Sequence: Synthetic peptide"
MMLAREAKM

SEQ ID NO: 10808 - protein, 9 aa, Artificial Sequence
  source: /note="Description of Artificial Sequence: Synthetic peptide"
MLAREAKML

SEQ ID NO: 10809 - protein, 9 aa, Artificial Sequence
  source: /note="Description of Artificial Sequence: Synthetic peptide"
YMMLAREAK

SEQ ID NO: 10810 - protein, 9 aa, Artificial Sequence
  source: /note="Description of Artificial Sequence: Synthetic peptide"
AKMLFTGGY

SEQ ID NO: 10811 - protein, 9 aa, Artificial Sequence
  source: /note="Description of Artificial Sequence: Synthetic peptide"
LAREAKMLF

SEQ ID NO: 10812 - protein, 9 aa, Artificial Sequence
  source: /note="Description of Artificial Sequence: Synthetic peptide"
REAKMLFTG

SEQ ID NO: 10813 - protein, 10 aa, Artificial Sequence
  source: /note="Description of Artificial Sequence: Synthetic peptide"
YMMLAREAKM

SEQ ID NO: 10814 - protein, 10 aa, Artificial Sequence
  source: /note="Description of Artificial Sequence: Synthetic peptide"
MMLAREAKML

SEQ ID NO: 10815 - protein, 10 aa, Artificial Sequence
  source: /note="Description of Artificial Sequence: Synthetic peptide"
KMLFTGGYGL

SEQ ID NO: 10816 - protein, 10 aa, Artificial Sequence
  source: /note="Description of Artificial Sequence: Synthetic peptide"
MLAREAKMLF

SEQ ID NO: 10817 - protein, 10 aa, Artificial Sequence
  source: /note="Description of Artificial Sequence: Synthetic peptide"
RYMMLAREAK

SEQ ID NO: 10818 - protein, 10 aa, Artificial Sequence
  source: /note="Description of Artificial Sequence: Synthetic peptide"
EAKMLFTGGY

SEQ ID NO: 10819 - protein, 10 aa, Artificial Sequence
  source: /note="Description of Artificial Sequence: Synthetic peptide"
REAKMLFTGG

SEQ ID NO: 10820 - protein, 9 aa, Artificial Sequence
  source: /note="Description of Artificial Sequence: Synthetic peptide"
RFQARSQQL

SEQ ID NO: 10821 - protein, 9 aa, Artificial Sequence
  source: /note="Description of Artificial Sequence: Synthetic peptide"
RSQQLEQKL

SEQ ID NO: 10822 - protein, 9 aa, Artificial Sequence
  source: /note="Description of Artificial Sequence: Synthetic peptide"
SQQLEQKLL

SEQ ID NO: 10823 - protein, 10 aa, Artificial Sequence
  source: /note="Description of Artificial Sequence: Synthetic peptide"
QARSQQLEQK

SEQ ID NO: 10824 - protein, 10 aa, Artificial Sequence
  source: /note="Description of Artificial Sequence: Synthetic peptide"
ERFQARSQQL

SEQ ID NO: 10825 - protein, 10 aa, Artificial Sequence
  source: /note="Description of Artificial Sequence: Synthetic peptide"
FQARSQQLEQ

SEQ ID NO: 10826 - protein, 10 aa, Artificial Sequence
  source: /note="Description of Artificial Sequence: Synthetic peptide"
RSQQLEQKLL

SEQ ID NO: 10827 - protein, 9 aa, Artificial Sequence
  source: /note="Description of Artificial Sequence: Synthetic peptide"
SSKGPLTKK

SEQ ID NO: 10828 - protein, 9 aa, Artificial Sequence
  source: /note="Description of Artificial Sequence: Synthetic peptide"
GPLTKKNSI

SEQ ID NO: 10829 - protein, 10 aa, Artificial Sequence
  source: /note="Description of Artificial Sequence: Synthetic peptide"
VSSKGPLTKK

SEQ ID NO: 10830 - protein, 10 aa, Artificial Sequence
  source: /note="Description of Artificial Sequence: Synthetic peptide"
LTKKNSINSR

SEQ ID NO: 10831 - protein, 10 aa, Artificial Sequence
  source: /note="Description of Artificial Sequence: Synthetic peptide"
SLTKGELTHL

SEQ ID NO: 10832 - protein, 9 aa, Artificial Sequence
  source: /note="Description of Artificial Sequence: Synthetic peptide"
CVKTCSAGV

SEQ ID NO: 10833 - protein, 9 aa, Artificial Sequence
  source: /note="Description of Artificial Sequence: Synthetic peptide"
VKTCSAGVM

SEQ ID NO: 10834 - protein, 10 aa, Artificial Sequence
  source: /note="Description of Artificial Sequence: Synthetic peptide"
CVKTCSAGVM

SEQ ID NO: 10835 - protein, 9 aa, Artificial Sequence
  source: /note="Description of Artificial Sequence: Synthetic peptide"
CVKTCLAGV

SEQ ID NO: 10836 - protein, 9 aa, Artificial Sequence
  source: /note="Description of Artificial Sequence: Synthetic peptide"
GPHCVKTCL

SEQ ID NO: 10837 - protein, 9 aa, Artificial Sequence
  source: /note="Description of Artificial Sequence: Synthetic peptide"
VKTCLAGVM

SEQ ID NO: 10838 - protein, 9 aa, Artificial Sequence
  source: /note="Description of Artificial Sequence: Synthetic peptide"
CVKTCPAAV

SEQ ID NO: 10839 - protein, 9 aa, Artificial Sequence
  source: /note="Description of Artificial Sequence: Synthetic peptide"
VKTCPAAVM

SEQ ID NO: 10840 - protein, 9 aa, Artificial Sequence
  source: /note="Description of Artificial Sequence: Synthetic peptide"
AVMGENNTL

SEQ ID NO: 10841 - protein, 10 aa, Artificial Sequence
  source: /note="Description of Artificial Sequence: Synthetic peptide"
AVMGENNTLV

SEQ ID NO: 10842 - protein, 10 aa, Artificial Sequence
  source: /note="Description of Artificial Sequence: Synthetic peptide"
CVKTCPAAVM

SEQ ID NO: 10843 - protein, 10 aa, Artificial Sequence
  source: /note="Description of Artificial Sequence: Synthetic peptide"
AAVMGENNTL

SEQ ID NO: 10844 - protein, 9 aa, Artificial Sequence
  source: /note="Description of Artificial Sequence: Synthetic peptide"
CVKTCPAVV

SEQ ID NO: 10845 - protein, 9 aa, Artificial Sequence
  source: /note="Description of Artificial Sequence: Synthetic peptide"
VKTCPAVVM

SEQ ID NO: 10846 - protein, 10 aa, Artificial Sequence
  source: /note="Description of Artificial Sequence: Synthetic peptide"
VVMGENNTLV

SEQ ID NO: 10847 - protein, 10 aa, Artificial Sequence
  source: /note="Description of Artificial Sequence: Synthetic peptide"
CVKTCPAVVM

SEQ ID NO: 10848 - protein, 9 aa, Artificial Sequence
  source: /note="Description of Artificial Sequence: Synthetic peptide"
MFNNCEVVR

SEQ ID NO: 10849 - protein, 9 aa, Artificial Sequence
  source: /note="Description of Artificial Sequence: Synthetic peptide"
EVVRGNLEI

SEQ ID NO: 10850 - protein, 9 aa, Artificial Sequence
  source: /note="Description of Artificial Sequence: Synthetic peptide"
VRGNLEITY

SEQ ID NO: 10851 - protein, 10 aa, Artificial Sequence
  source: /note="Description of Artificial Sequence: Synthetic peptide"
RMFNNCEVVR

SEQ ID NO: 10852 - protein, 10 aa, Artificial Sequence
  source: /note="Description of Artificial Sequence: Synthetic peptide"
VVRGNLEITY

SEQ ID NO: 10853 - protein, 10 aa, Artificial Sequence
  source: /note="Description of Artificial Sequence: Synthetic peptide"
CEVVRGNLEI

SEQ ID NO: 10854 - protein, 9 aa, Artificial Sequence
  source: /note="Description of Artificial Sequence: Synthetic peptide"
RILKKTEFK

SEQ ID NO: 10855 - protein, 9 aa, Artificial Sequence
  source: /note="Description of Artificial Sequence: Synthetic peptide"
ILKKTEFKK

SEQ ID NO: 10856 - protein, 9 aa, Artificial Sequence
  source: /note="Description of Artificial Sequence: Synthetic peptide"
QALLRILKK

SEQ ID NO: 10857 - protein, 9 aa, Artificial Sequence
  source: /note="Description of Artificial Sequence: Synthetic peptide"
LRILKKTEF

SEQ ID NO: 10858 - protein, 10 aa, Artificial Sequence
  source: /note="Description of Artificial Sequence: Synthetic peptide"
RILKKTEFKK

SEQ ID NO: 10859 - protein, 10 aa, Artificial Sequence
  source: /note="Description of Artificial Sequence: Synthetic peptide"
NQALLRILKK

SEQ ID NO: 10860 - protein, 10 aa, Artificial Sequence
  source: /note="Description of Artificial Sequence: Synthetic peptide"
LLRILKKTEF

SEQ ID NO: 10861 - protein, 9 aa, Artificial Sequence
  source: /note="Description of Artificial Sequence: Synthetic peptide"
ASGAFGTVY

SEQ ID NO: 10862 - protein, 9 aa, Artificial Sequence
  source: /note="Description of Artificial Sequence: Synthetic peptide"
VLASGAFGT

SEQ ID NO: 10863 - protein, 9 aa, Artificial Sequence
  source: /note="Description of Artificial Sequence: Synthetic peptide"
LASGAFGTV

SEQ ID NO: 10864 - protein, 9 aa, Artificial Sequence
  source: /note="Description of Artificial Sequence: Synthetic peptide"
KIKVLASGA

SEQ ID NO: 10865 - protein, 9 aa, Artificial Sequence
  source: /note="Description of Artificial Sequence: Synthetic peptide"
KVLASGAFG

SEQ ID NO: 10866 - protein, 9 aa, Artificial Sequence
  source: /note="Description of Artificial Sequence: Synthetic peptide"
IKVLASGAF

SEQ ID NO: 10867 - protein, 9 aa, Artificial Sequence
  source: /note="Description of Artificial Sequence: Synthetic peptide"
KKIKVLASG

SEQ ID NO: 10868 - protein, 10 aa, Artificial Sequence
  source: /note="Description of Artificial Sequence: Synthetic peptide"
VLASGAFGTV

SEQ ID NO: 10869 - protein, 10 aa, Artificial Sequence
  source: /note="Description of Artificial Sequence: Synthetic peptide"
ASGAFGTVYK

SEQ ID NO: 10870 - protein, 10 aa, Artificial Sequence
  source: /note="Description of Artificial Sequence: Synthetic peptide"
KIKVLASGAF

SEQ ID NO: 10871 - protein, 10 aa, Artificial Sequence
  source: /note="Description of Artificial Sequence: Synthetic peptide"
LASGAFGTVY

SEQ ID NO: 10872 - protein, 10 aa, Artificial Sequence
  source: /note="Description of Artificial Sequence: Synthetic peptide"
KKIKVLASGA

SEQ ID NO: 10873 - protein, 10 aa, Artificial Sequence
  source: /note="Description of Artificial Sequence: Synthetic peptide"
TEFKKIKVLA

SEQ ID NO: 10874 - protein, 10 aa, Artificial Sequence
  source: /note="Description of Artificial Sequence: Synthetic peptide"
AIKTSPKANK

SEQ ID NO: 10875 - protein, 10 aa, Artificial Sequence
  source: /note="Description of Artificial Sequence: Synthetic peptide"
KVKIPVAIKT

SEQ ID NO: 10876 - protein, 10 aa, Artificial Sequence
  source: /note="Description of Artificial Sequence: Synthetic peptide"
KTSPKANKEI

SEQ ID NO: 10877 - protein, 9 aa, Artificial Sequence
  source: /note="Description of Artificial Sequence: Synthetic peptide"
MAIVDNPHV

SEQ ID NO: 10878 - protein, 9 aa, Artificial Sequence
  source: /note="Description of Artificial Sequence: Synthetic peptide"
VMAIVDNPH

SEQ ID NO: 10879 - protein, 9 aa, Artificial Sequence
  source: /note="Description of Artificial Sequence: Synthetic peptide"
DEAYVMAIV

SEQ ID NO: 10880 - protein, 9 aa, Artificial Sequence
  source: /note="Description of Artificial Sequence: Synthetic peptide"
LDEAYVMAI

SEQ ID NO: 10881 - protein, 10 aa, Artificial Sequence
  source: /note="Description of Artificial Sequence: Synthetic peptide"
ILDEAYVMAI

SEQ ID NO: 10882 - protein, 10 aa, Artificial Sequence
  source: /note="Description of Artificial Sequence: Synthetic peptide"
VMAIVDNPHV

SEQ ID NO: 10883 - protein, 10 aa, Artificial Sequence
  source: /note="Description of Artificial Sequence: Synthetic peptide"
AIVDNPHVCR

SEQ ID NO: 10884 - protein, 10 aa, Artificial Sequence
  source: /note="Description of Artificial Sequence: Synthetic peptide"
YVMAIVDNPH

SEQ ID NO: 10885 - protein, 10 aa, Artificial Sequence
  source: /note="Description of Artificial Sequence: Synthetic peptide"
DEAYVMAIVD

SEQ ID NO: 10886 - protein, 9 aa, Artificial Sequence
  source: /note="Description of Artificial Sequence: Synthetic peptide"
RLVHRDMAA

SEQ ID NO: 10887 - protein, 9 aa, Artificial Sequence
  source: /note="Description of Artificial Sequence: Synthetic peptide"
DMAARNVLV

SEQ ID NO: 10888 - protein, 9 aa, Artificial Sequence
  source: /note="Description of Artificial Sequence: Synthetic peptide"
MAARNVLVK

SEQ ID NO: 10889 - protein, 9 aa, Artificial Sequence
  source: /note="Description of Artificial Sequence: Synthetic peptide"
LVHRDMAAR

SEQ ID NO: 10890 - protein, 9 aa, Artificial Sequence
  source: /note="Description of Artificial Sequence: Synthetic peptide"
RDMAARNVL

SEQ ID NO: 10891 - protein, 10 aa, Artificial Sequence
  source: /note="Description of Artificial Sequence: Synthetic peptide"
RLVHRDMAAR

SEQ ID NO: 10892 - protein, 10 aa, Artificial Sequence
  source: /note="Description of Artificial Sequence: Synthetic peptide"
DMAARNVLVK

SEQ ID NO: 10893 - protein, 10 aa, Artificial Sequence
  source: /note="Description of Artificial Sequence: Synthetic peptide"
HRDMAARNVL

SEQ ID NO: 10894 - protein, 10 aa, Artificial Sequence
  source: /note="Description of Artificial Sequence: Synthetic peptide"
RDMAARNVLV

SEQ ID NO: 10895 - protein, 9 aa, Artificial Sequence
  source: /note="Description of Artificial Sequence: Synthetic peptide"
KITDFGRAK

SEQ ID NO: 10896 - protein, 9 aa, Artificial Sequence
  source: /note="Description of Artificial Sequence: Synthetic peptide"
HVKITDFGR

SEQ ID NO: 10897 - protein, 9 aa, Artificial Sequence
  source: /note="Description of Artificial Sequence: Synthetic peptide"
FGRAKLLGA

SEQ ID NO: 10898 - protein, 10 aa, Artificial Sequence
  source: /note="Description of Artificial Sequence: Synthetic peptide"
HVKITDFGRA

SEQ ID NO: 10899 - protein, 10 aa, Artificial Sequence
  source: /note="Description of Artificial Sequence: Synthetic peptide"
RAKLLGAEEK

SEQ ID NO: 10900 - protein, 10 aa, Artificial Sequence
  source: /note="Description of Artificial Sequence: Synthetic peptide"
LAKQLGAEEK

SEQ ID NO: 10901 - protein, 10 aa, Artificial Sequence
  source: /note="Description of Artificial Sequence: Synthetic peptide"
KQLGAEEKEY

SEQ ID NO: 10902 - protein, 9 aa, Artificial Sequence
  source: /note="Description of Artificial Sequence: Synthetic peptide"
QIIKGNMYY

SEQ ID NO: 10903 - protein, 9 aa, Artificial Sequence
  source: /note="Description of Artificial Sequence: Synthetic peptide"
LQIIKGNMY

SEQ ID NO: 10904 - protein, 10 aa, Artificial Sequence
  source: /note="Description of Artificial Sequence: Synthetic peptide"
LQIIKGNMYY

SEQ ID NO: 10905 - protein, 10 aa, Artificial Sequence
  source: /note="Description of Artificial Sequence: Synthetic peptide"
KGNMYYENSY

SEQ ID NO: 10906 - protein, 9 aa, Artificial Sequence
  source: /note="Description of Artificial Sequence: Synthetic peptide"
RESDCLVCC

SEQ ID NO: 10907 - protein, 9 aa, Artificial Sequence
  source: /note="Description of Artificial Sequence: Synthetic peptide"
YSFGTTCVK

SEQ ID NO: 10908 - protein, 9 aa, Artificial Sequence
  source: /note="Description of Artificial Sequence: Synthetic peptide"
TTCVKKCPR

SEQ ID NO: 10909 - protein, 9 aa, Artificial Sequence
  source: /note="Description of Artificial Sequence: Synthetic peptide"
GKYSFGTTC

SEQ ID NO: 10910 - protein, 10 aa, Artificial Sequence
  source: /note="Description of Artificial Sequence: Synthetic peptide"
YSFGTTCVKK

SEQ ID NO: 10911 - protein, 10 aa, Artificial Sequence
  source: /note="Description of Artificial Sequence: Synthetic peptide"
KYSFGTTCVK

SEQ ID NO: 10912 - protein, 10 aa, Artificial Sequence
  source: /note="Description of Artificial Sequence: Synthetic peptide"
GTTCVKKCPR

SEQ ID NO: 10913 - protein, 10 aa, Artificial Sequence
  source: /note="Description of Artificial Sequence: Synthetic peptide"
GKYSFGTTCV

SEQ ID NO: 10914 - protein, 9 aa, Artificial Sequence
  source: /note="Description of Artificial Sequence: Synthetic peptide"
YSFGDTCVK

SEQ ID NO: 10915 - protein, 9 aa, Artificial Sequence
  source: /note="Description of Artificial Sequence: Synthetic peptide"
DTCVKKCPR

SEQ ID NO: 10916 - protein, 9 aa, Artificial Sequence
  source: /note="Description of Artificial Sequence: Synthetic peptide"
GKYSFGDTC

SEQ ID NO: 10917 - protein, 10 aa, Artificial Sequence
  source: /note="Description of Artificial Sequence: Synthetic peptide"
YSFGDTCVKK

SEQ ID NO: 10918 - protein, 10 aa, Artificial Sequence
  source: /note="Description of Artificial Sequence: Synthetic peptide"
KYSFGDTCVK

SEQ ID NO: 10919 - protein, 10 aa, Artificial Sequence
  source: /note="Description of Artificial Sequence: Synthetic peptide"
GKYSFGDTCV

SEQ ID NO: 10920 - protein, 9 aa, Artificial Sequence
  source: /note="Description of Artificial Sequence: Synthetic peptide"
YSFGVTCVK

SEQ ID NO: 10921 - protein, 9 aa, Artificial Sequence
  source: /note="Description of Artificial Sequence: Synthetic peptide"
KYSFGVTCV

SEQ ID NO: 10922 - protein, 9 aa, Artificial Sequence
  source: /note="Description of Artificial Sequence: Synthetic peptide"
VTCVKKCPR

SEQ ID NO: 10923 - protein, 9 aa, Artificial Sequence
  source: /note="Description of Artificial Sequence: Synthetic peptide"
GKYSFGVTC

SEQ ID NO: 10924 - protein, 10 aa, Artificial Sequence
  source: /note="Description of Artificial Sequence: Synthetic peptide"
YSFGVTCVKK

SEQ ID NO: 10925 - protein, 10 aa, Artificial Sequence
  source: /note="Description of Artificial Sequence: Synthetic peptide"
KYSFGVTCVK

SEQ ID NO: 10926 - protein, 10 aa, Artificial Sequence
  source: /note="Description of Artificial Sequence: Synthetic peptide"
GVTCVKKCPR

SEQ ID NO: 10927 - protein, 10 aa, Artificial Sequence
  source: /note="Description of Artificial Sequence: Synthetic peptide"
GKYSFGVTCV

SEQ ID NO: 10928 - protein, 9 aa, Artificial Sequence
  source: /note="Description of Artificial Sequence: Synthetic peptide"
VVTDYGSCV

SEQ ID NO: 10929 - protein, 10 aa, Artificial Sequence
  source: /note="Description of Artificial Sequence: Synthetic peptide"
YVVTDYGSCV

SEQ ID NO: 10930 - protein, 10 aa, Artificial Sequence
  source: /note="Description of Artificial Sequence: Synthetic peptide"
VVTDYGSCVR

SEQ ID NO: 10931 - protein, 10 aa, Artificial Sequence
  source: /note="Description of Artificial Sequence: Synthetic peptide"
CPRNYVVTDY

SEQ ID NO: 10932 - protein, 9 aa, Artificial Sequence
  source: /note="Description of Artificial Sequence: Synthetic peptide"
AAKAEMHLM

SEQ ID NO: 10933 - protein, 9 aa, Artificial Sequence
  source: /note="Description of Artificial Sequence: Synthetic peptide"
AEMHLMSPL

SEQ ID NO: 10934 - protein, 9 aa, Artificial Sequence
  source: /note="Description of Artificial Sequence: Synthetic peptide"
MHLMSPLQI

SEQ ID NO: 10935 - protein, 10 aa, Artificial Sequence
  source: /note="Description of Artificial Sequence: Synthetic peptide"
MAAAKAEMHL

SEQ ID NO: 10936 - protein, 10 aa, Artificial Sequence
  source: /note="Description of Artificial Sequence: Synthetic peptide"
AAAKAEMHLM

SEQ ID NO: 10937 - protein, 10 aa, Artificial Sequence
  source: /note="Description of Artificial Sequence: Synthetic peptide"
KAEMHLMSPL

SEQ ID NO: 10938 - protein, 10 aa, Artificial Sequence
  source: /note="Description of Artificial Sequence: Synthetic peptide"
EMHLMSPLQI

SEQ ID NO: 10939 - protein, 10 aa, Artificial Sequence
  source: /note="Description of Artificial Sequence: Synthetic peptide"
AEMHLMSPLQ

SEQ ID NO: 10940 - protein, 9 aa, Artificial Sequence
  source: /note="Description of Artificial Sequence: Synthetic peptide"
LTLAQWSPV

SEQ ID NO: 10941 - protein, 9 aa, Artificial Sequence
  source: /note="Description of Artificial Sequence: Synthetic peptide"
TLAQWSPVI

SEQ ID NO: 10942 - protein, 9 aa, Artificial Sequence
  source: /note="Description of Artificial Sequence: Synthetic peptide"
AQWSPVIAA

SEQ ID NO: 10943 - protein, 9 aa, Artificial Sequence
  source: /note="Description of Artificial Sequence: Synthetic peptide"
KQTKVLWPL

SEQ ID NO: 10944 - protein, 9 aa, Artificial Sequence
  source: /note="Description of Artificial Sequence: Synthetic peptide"
VIAASPAPT

SEQ ID NO: 10945 - protein, 9 aa, Artificial Sequence
  source: /note="Description of Artificial Sequence: Synthetic peptide"
AMNARGIPR

SEQ ID NO: 10946 - protein, 9 aa, Artificial Sequence
  source: /note="Description of Artificial Sequence: Synthetic peptide"
RLLPLTRPR

SEQ ID NO: 10947 - protein, 9 aa, Artificial Sequence
  source: /note="Description of Artificial Sequence: Synthetic peptide"
RLLPLIHPR

SEQ ID NO: 10948 - protein, 9 aa, Artificial Sequence
  source: /note="Description of Artificial Sequence: Synthetic peptide"
ATSASTQAR

SEQ ID NO: 10949 - protein, 9 aa, Artificial Sequence
  source: /note="Description of Artificial Sequence: Synthetic peptide"
STCGRRTRK

SEQ ID NO: 10950 - protein, 9 aa, Artificial Sequence
  source: /note="Description of Artificial Sequence: Synthetic peptide"
CTVASPPRR

SEQ ID NO: 10951 - protein, 9 aa, Artificial Sequence
  source: /note="Description of Artificial Sequence: Synthetic peptide"
LWPLRPPPL

SEQ ID NO: 10952 - protein, 9 aa, Artificial Sequence
  source: /note="Description of Artificial Sequence: Synthetic peptide"
STQARSPSS

SEQ ID NO: 10953 - protein, 9 aa, Artificial Sequence
  source: /note="Description of Artificial Sequence: Synthetic peptide"
QARSPSSAA

SEQ ID NO: 10954 - protein, 9 aa, Artificial Sequence
  source: /note="Description of Artificial Sequence: Synthetic peptide"
RSPSSAASA

SEQ ID NO: 10955 - protein, 9 aa, Artificial Sequence
  source: /note="Description of Artificial Sequence: Synthetic peptide"
ASACATSAA

SEQ ID NO: 10956 - protein, 9 aa, Artificial Sequence
  source: /note="Description of Artificial Sequence: Synthetic peptide"
KSPSPATSV

SEQ ID NO: 10957 - protein, 9 aa, Artificial Sequence
  source: /note="Description of Artificial Sequence: Synthetic peptide"
RSTCGRRTR

SEQ ID NO: 10958 - protein, 9 aa, Artificial Sequence
  source: /note="Description of Artificial Sequence: Synthetic peptide"
RTRKQTKVL

SEQ ID NO: 10959 - protein, 9 aa, Artificial Sequence
  source: /note="Description of Artificial Sequence: Synthetic peptide"
QTKVLWPLR

SEQ ID NO: 10960 - protein, 9 aa, Artificial Sequence
  source: /note="Description of Artificial Sequence: Synthetic peptide"
PTRPRLLPL

SEQ ID NO: 10961 - protein, 9 aa, Artificial Sequence
  source: /note="Description of Artificial Sequence: Synthetic peptide"
RPRLLPLTR

SEQ ID NO: 10962 - protein, 9 aa, Artificial Sequence
  source: /note="Description of Artificial Sequence: Synthetic peptide"
LTRPRLLPL

SEQ ID NO: 10963 - protein, 9 aa, Artificial Sequence
  source: /note="Description of Artificial Sequence: Synthetic peptide"
LIHPRPPPH

SEQ ID NO: 10964 - protein, 9 aa, Artificial Sequence
  source: /note="Description of Artificial Sequence: Synthetic peptide"
SLPGAMNAR

SEQ ID NO: 10965 - protein, 9 aa, Artificial Sequence
  source: /note="Description of Artificial Sequence: Synthetic peptide"
ESLPGAMNA

SEQ ID NO: 10966 - protein, 9 aa, Artificial Sequence
  source: /note="Description of Artificial Sequence: Synthetic peptide"
SPVIAASPA

SEQ ID NO: 10967 - protein, 9 aa, Artificial Sequence
  source: /note="Description of Artificial Sequence: Synthetic peptide"
SPAPTSSPA

SEQ ID NO: 10968 - protein, 9 aa, Artificial Sequence
  source: /note="Description of Artificial Sequence: Synthetic peptide"
RPPPLSLPT

SEQ ID NO: 10969 - protein, 9 aa, Artificial Sequence
  source: /note="Description of Artificial Sequence: Synthetic peptide"
LPLTRPRLL

SEQ ID NO: 10970 - protein, 9 aa, Artificial Sequence
  source: /note="Description of Artificial Sequence: Synthetic peptide"
RPRLLPLIH

SEQ ID NO: 10971 - protein, 9 aa, Artificial Sequence
  source: /note="Description of Artificial Sequence: Synthetic peptide"
HPRPPPHTH

SEQ ID NO: 10972 - protein, 9 aa, Artificial Sequence
  source: /note="Description of Artificial Sequence: Synthetic peptide"
RPPPHTHPL

SEQ ID NO: 10973 - protein, 9 aa, Artificial Sequence
  source: /note="Description of Artificial Sequence: Synthetic peptide"
SPLPAPRPT

SEQ ID NO: 10974 - protein, 9 aa, Artificial Sequence
  source: /note="Description of Artificial Sequence: Synthetic peptide"
APRPTHPLC

SEQ ID NO: 10975 - protein, 9 aa, Artificial Sequence
  source: /note="Description of Artificial Sequence: Synthetic peptide"
RPTHPLCTV

SEQ ID NO: 10976 - protein, 9 aa, Artificial Sequence
  source: /note="Description of Artificial Sequence: Synthetic peptide"
SLPTRPRLL

SEQ ID NO: 10977 - protein, 9 aa, Artificial Sequence
  source: /note="Description of Artificial Sequence: Synthetic peptide"
SKTPPTNAL

SEQ ID NO: 10978 - protein, 9 aa, Artificial Sequence
  source: /note="Description of Artificial Sequence: Synthetic peptide"
TQARSPSSA

SEQ ID NO: 10979 - protein, 9 aa, Artificial Sequence
  source: /note="Description of Artificial Sequence: Synthetic peptide"
TQAKSPSPA

SEQ ID NO: 10980 - protein, 9 aa, Artificial Sequence
  source: /note="Description of Artificial Sequence: Synthetic peptide"
VEESLPGAM

SEQ ID NO: 10981 - protein, 9 aa, Artificial Sequence
  source: /note="Description of Artificial Sequence: Synthetic peptide"
LSLPTRPRL

SEQ ID NO: 10982 - protein, 9 aa, Artificial Sequence
  source: /note="Description of Artificial Sequence: Synthetic peptide"
CPPPSPLPA

SEQ ID NO: 10983 - protein, 10 aa, Artificial Sequence
  source: /note="Description of Artificial Sequence: Synthetic peptide"
ALTLAQWSPV

SEQ ID NO: 10984 - protein, 10 aa, Artificial Sequence
  source: /note="Description of Artificial Sequence: Synthetic peptide"
TLAQWSPVIA

SEQ ID NO: 10985 - protein, 10 aa, Artificial Sequence
  source: /note="Description of Artificial Sequence: Synthetic peptide"
VLWPLRPPPL

SEQ ID NO: 10986 - protein, 10 aa, Artificial Sequence
  source: /note="Description of Artificial Sequence: Synthetic peptide"
RLLPLTRPRL

SEQ ID NO: 10987 - protein, 10 aa, Artificial Sequence
  source: /note="Description of Artificial Sequence: Synthetic peptide"
GAMNARGIPR

SEQ ID NO: 10988 - protein, 10 aa, Artificial Sequence
  source: /note="Description of Artificial Sequence: Synthetic peptide"
RSTCGRRTRK

SEQ ID NO: 10989 - protein, 10 aa, Artificial Sequence
  source: /note="Description of Artificial Sequence: Synthetic peptide"
KTPPTNALTL

SEQ ID NO: 10990 - protein, 10 aa, Artificial Sequence
  source: /note="Description of Artificial Sequence: Synthetic peptide"
STQARSPSSA

SEQ ID NO: 10991 - protein, 10 aa, Artificial Sequence
  source: /note="Description of Artificial Sequence: Synthetic peptide"
ASACATSAAA

SEQ ID NO: 10992 - protein, 10 aa, Artificial Sequence
  source: /note="Description of Artificial Sequence: Synthetic peptide"
RGIPRSTCGR

SEQ ID NO: 10993 - protein, 10 aa, Artificial Sequence
  source: /note="Description of Artificial Sequence: Synthetic peptide"
CGRRTRKQTK

SEQ ID NO: 10994 - protein, 10 aa, Artificial Sequence
  source: /note="Description of Artificial Sequence: Synthetic peptide"
RTRKQTKVLW

SEQ ID NO: 10995 - protein, 10 aa, Artificial Sequence
  source: /note="Description of Artificial Sequence: Synthetic peptide"
KQTKVLWPLR

SEQ ID NO: 10996 - protein, 10 aa, Artificial Sequence
  source: /note="Description of Artificial Sequence: Synthetic peptide"
KVLWPLRPPP

SEQ ID NO: 10997 - protein, 10 aa, Artificial Sequence
  source: /note="Description of Artificial Sequence: Synthetic peptide"
LTRPRLLPLI

SEQ ID NO: 10998 - protein, 10 aa, Artificial Sequence
  source: /note="Description of Artificial Sequence: Synthetic peptide"
HTHPLCPPPS

SEQ ID NO: 10999 - protein, 10 aa, Artificial Sequence
  source: /note="Description of Artificial Sequence: Synthetic peptide"
ESLPGAMNAR

SEQ ID NO: 11000 - protein, 10 aa, Artificial Sequence
  source: /note="Description of Artificial Sequence: Synthetic peptide"
WSPVIAASPA

SEQ ID NO: 11001 - protein, 10 aa, Artificial Sequence
  source: /note="Description of Artificial Sequence: Synthetic peptide"
TTSPPTSAPT

SEQ ID NO: 11002 - protein, 10 aa, Artificial Sequence
  source: /note="Description of Artificial Sequence: Synthetic peptide"
RPSKTPPTNA

SEQ ID NO: 11003 - protein, 10 aa, Artificial Sequence
  source: /note="Description of Artificial Sequence: Synthetic peptide"
SPAPTSSPAT

SEQ ID NO: 11004 - protein, 10 aa, Artificial Sequence
  source: /note="Description of Artificial Sequence: Synthetic peptide"
APTSSPATSA

SEQ ID NO: 11005 - protein, 10 aa, Artificial Sequence
  source: /note="Description of Artificial Sequence: Synthetic peptide"
SPATSASTQA

SEQ ID NO: 11006 - protein, 10 aa, Artificial Sequence
  source: /note="Description of Artificial Sequence: Synthetic peptide"
SPATSVEESL

SEQ ID NO: 11007 - protein, 10 aa, Artificial Sequence
  source: /note="Description of Artificial Sequence: Synthetic peptide"
LPGAMNARGI

SEQ ID NO: 11008 - protein, 10 aa, Artificial Sequence
  source: /note="Description of Artificial Sequence: Synthetic peptide"
WPLRPPPLSL

SEQ ID NO: 11009 - protein, 10 aa, Artificial Sequence
  source: /note="Description of Artificial Sequence: Synthetic peptide"
LPTRPRLLPL

SEQ ID NO: 11010 - protein, 10 aa, Artificial Sequence
  source: /note="Description of Artificial Sequence: Synthetic peptide"
HPLCPPPSPL

SEQ ID NO: 11011 - protein, 10 aa, Artificial Sequence
  source: /note="Description of Artificial Sequence: Synthetic peptide"
LPAPRPTHPL

SEQ ID NO: 11012 - protein, 10 aa, Artificial Sequence
  source: /note="Description of Artificial Sequence: Synthetic peptide"
APRPTHPLCT

SEQ ID NO: 11013 - protein, 10 aa, Artificial Sequence
  source: /note="Description of Artificial Sequence: Synthetic peptide"
RPTHPLCTVA

SEQ ID NO: 11014 - protein, 10 aa, Artificial Sequence
  source: /note="Description of Artificial Sequence: Synthetic peptide"
LTLAQWSPVI

SEQ ID NO: 11015 - protein, 10 aa, Artificial Sequence
  source: /note="Description of Artificial Sequence: Synthetic peptide"
AQWSPVIAAS

SEQ ID NO: 11016 - protein, 10 aa, Artificial Sequence
  source: /note="Description of Artificial Sequence: Synthetic peptide"
TQARSPSSAA

SEQ ID NO: 11017 - protein, 10 aa, Artificial Sequence
  source: /note="Description of Artificial Sequence: Synthetic peptide"
TQAKSPSPAT

SEQ ID NO: 11018 - protein, 10 aa, Artificial Sequence
  source: /note="Description of Artificial Sequence: Synthetic peptide"
AKSPSPATSV

SEQ ID NO: 11019 - protein, 10 aa, Artificial Sequence
  source: /note="Description of Artificial Sequence: Synthetic peptide"
RKQTKVLWPL

SEQ ID NO: 11020 - protein, 10 aa, Artificial Sequence
  source: /note="Description of Artificial Sequence: Synthetic peptide"
LSLPTRPRLL

SEQ ID NO: 11021 - protein, 10 aa, Artificial Sequence
  source: /note="Description of Artificial Sequence: Synthetic peptide"
EESLPGAMNA

SEQ ID NO: 11022 - protein, 9 aa, Artificial Sequence
  source: /note="Description of Artificial Sequence: Synthetic peptide"
RRFSRSDKL

SEQ ID NO: 11023 - protein, 9 aa, Artificial Sequence
  source: /note="Description of Artificial Sequence: Synthetic peptide"
RICMHNFSR

SEQ ID NO: 11024 - protein, 9 aa, Artificial Sequence
  source: /note="Description of Artificial Sequence: Synthetic peptide"
HNFSRSDHL

SEQ ID NO: 11025 - protein, 10 aa, Artificial Sequence
  source: /note="Description of Artificial Sequence: Synthetic peptide"
FQCRICMHNF

SEQ ID NO: 11026 - protein, 10 aa, Artificial Sequence
  source: /note="Description of Artificial Sequence: Synthetic peptide"
CMHNFSRSDH

SEQ ID NO: 11027 - protein, 10 aa, Artificial Sequence
  source: /note="Description of Artificial Sequence: Synthetic peptide"
MHNFSRSDHL

SEQ ID NO: 11028 - protein, 9 aa, Artificial Sequence
  source: /note="Description of Artificial Sequence: Synthetic peptide"
RNFSRSDNL

SEQ ID NO: 11029 - protein, 9 aa, Artificial Sequence
  source: /note="Description of Artificial Sequence: Synthetic peptide"
RSDNLTTHI

SEQ ID NO: 11030 - protein, 10 aa, Artificial Sequence
  source: /note="Description of Artificial Sequence: Synthetic peptide"
MRNFSRSDNL

SEQ ID NO: 11031 - protein, 10 aa, Artificial Sequence
  source: /note="Description of Artificial Sequence: Synthetic peptide"
FSRSDNLTTH

SEQ ID NO: 11032 - protein, 10 aa, Artificial Sequence
  source: /note="Description of Artificial Sequence: Synthetic peptide"
SRSDNLTTHI

SEQ ID NO: 11033 - protein, 9 aa, Artificial Sequence
  source: /note="Description of Artificial Sequence: Synthetic peptide"
HYRFHKFHS

SEQ ID NO: 11034 - protein, 9 aa, Artificial Sequence
  source: /note="Description of Artificial Sequence: Synthetic peptide"
RFHKFHSPA

SEQ ID NO: 11035 - protein, 9 aa, Artificial Sequence
  source: /note="Description of Artificial Sequence: Synthetic peptide"
FHKFHSPAL

SEQ ID NO: 11036 - protein, 9 aa, Artificial Sequence
  source: /note="Description of Artificial Sequence: Synthetic peptide"
EEHYRFHKF

SEQ ID NO: 11037 - protein, 9 aa, Artificial Sequence
  source: /note="Description of Artificial Sequence: Synthetic peptide"
YRFHKFHSP

SEQ ID NO: 11038 - protein, 10 aa, Artificial Sequence
  source: /note="Description of Artificial Sequence: Synthetic peptide"
RFHKFHSPAL

SEQ ID NO: 11039 - protein, 10 aa, Artificial Sequence
  source: /note="Description of Artificial Sequence: Synthetic peptide"
YRFHKFHSPA

SEQ ID NO: 11040 - protein, 10 aa, Artificial Sequence
  source: /note="Description of Artificial Sequence: Synthetic peptide"
LEEHYRFHKF

SEQ ID NO: 11041 - protein, 10 aa, Artificial Sequence
  source: /note="Description of Artificial Sequence: Synthetic peptide"
EEHYRFHKFH

SEQ ID NO: 11042 - protein, 9 aa, Artificial Sequence
  source: /note="Description of Artificial Sequence: Synthetic peptide"
ASHGNPPLK

SEQ ID NO: 11043 - protein, 9 aa, Artificial Sequence
  source: /note="Description of Artificial Sequence: Synthetic peptide"
LASHGNPPL

SEQ ID NO: 11044 - protein, 10 aa, Artificial Sequence
  source: /note="Description of Artificial Sequence: Synthetic peptide"
KLASHGNPPL

SEQ ID NO: 11045 - protein, 10 aa, Artificial Sequence
  source: /note="Description of Artificial Sequence: Synthetic peptide"
LASHGNPPLK

SEQ ID NO: 11046 - protein, 10 aa, Artificial Sequence
  source: /note="Description of Artificial Sequence: Synthetic peptide"
KGDKNRRRGK

SEQ ID NO: 11047 - protein, 9 aa, Artificial Sequence
  source: /note="Description of Artificial Sequence: Synthetic peptide"
WLAIVSWQM

SEQ ID NO: 11048 - protein, 9 aa, Artificial Sequence
  source: /note="Description of Artificial Sequence: Synthetic peptide"
WQMLHEALV

SEQ ID NO: 11049 - protein, 9 aa, Artificial Sequence
  source: /note="Description of Artificial Sequence: Synthetic peptide"
AIVSWQMLH

SEQ ID NO: 11050 - protein, 9 aa, Artificial Sequence
  source: /note="Description of Artificial Sequence: Synthetic peptide"
SWQMLHEAL

SEQ ID NO: 11051 - protein, 9 aa, Artificial Sequence
  source: /note="Description of Artificial Sequence: Synthetic peptide"
LAIVSWQML

SEQ ID NO: 11052 - protein, 10 aa, Artificial Sequence
  source: /note="Description of Artificial Sequence: Synthetic peptide"
WLAIVSWQML

SEQ ID NO: 11053 - protein, 10 aa, Artificial Sequence
  source: /note="Description of Artificial Sequence: Synthetic peptide"
IVSWQMLHEA

SEQ ID NO: 11054 - protein, 10 aa, Artificial Sequence
  source: /note="Description of Artificial Sequence: Synthetic peptide"
KWLAIVSWQM

SEQ ID NO: 11055 - protein, 10 aa, Artificial Sequence
  source: /note="Description of Artificial Sequence: Synthetic peptide"
SWQMLHEALV

SEQ ID NO: 11056 - protein, 10 aa, Artificial Sequence
  source: /note="Description of Artificial Sequence: Synthetic peptide"
VSWQMLHEAL

SEQ ID NO: 11057 - protein, 10 aa, Artificial Sequence
  source: /note="Description of Artificial Sequence: Synthetic peptide"
WQMLHEALVS

SEQ ID NO: 11058 - protein, 10 aa, Artificial Sequence
  source: /note="Description of Artificial Sequence: Synthetic peptide"
AAAGGDSDSW

SEQ ID NO: 11059 - protein, 9 aa, Artificial Sequence
  source: /note="Description of Artificial Sequence: Synthetic peptide"
QTHSPFFQR

SEQ ID NO: 11060 - protein, 9 aa, Artificial Sequence
  source: /note="Description of Artificial Sequence: Synthetic peptide"
SQPQTHSPF

SEQ ID NO: 11061 - protein, 9 aa, Artificial Sequence
  source: /note="Description of Artificial Sequence: Synthetic peptide"
QPQTHSPFF

SEQ ID NO: 11062 - protein, 10 aa, Artificial Sequence
  source: /note="Description of Artificial Sequence: Synthetic peptide"
SQPQTHSPFF

SEQ ID NO: 11063 - protein, 10 aa, Artificial Sequence
  source: /note="Description of Artificial Sequence: Synthetic peptide"
NSQPQTHSPF

SEQ ID NO: 11064 - protein, 9 aa, Artificial Sequence
  source: /note="Description of Artificial Sequence: Synthetic peptide"
MTIDGMTSF

SEQ ID NO: 11065 - protein, 9 aa, Artificial Sequence
  source: /note="Description of Artificial Sequence: Synthetic peptide"
TIDGMTSFA

SEQ ID NO: 11066 - protein, 9 aa, Artificial Sequence
  source: /note="Description of Artificial Sequence: Synthetic peptide"
DGMTSFAGI

SEQ ID NO: 11067 - protein, 9 aa, Artificial Sequence
  source: /note="Description of Artificial Sequence: Synthetic peptide"
MTSFAGINI

SEQ ID NO: 11068 - protein, 10 aa, Artificial Sequence
  source: /note="Description of Artificial Sequence: Synthetic peptide"
MTIDGMTSFA

SEQ ID NO: 11069 - protein, 10 aa, Artificial Sequence
  source: /note="Description of Artificial Sequence: Synthetic peptide"
GMTSFAGINI

SEQ ID NO: 11070 - protein, 10 aa, Artificial Sequence
  source: /note="Description of Artificial Sequence: Synthetic peptide"
PMTIDGMTSF

SEQ ID NO: 11071 - protein, 9 aa, Artificial Sequence
  source: /note="Description of Artificial Sequence: Synthetic peptide"
GVFKFCAPR

SEQ ID NO: 11072 - protein, 9 aa, Artificial Sequence
  source: /note="Description of Artificial Sequence: Synthetic peptide"
RLWPNYGAK

SEQ ID NO: 11073 - protein, 9 aa, Artificial Sequence
  source: /note="Description of Artificial Sequence: Synthetic peptide"
VFKFCAPRL

SEQ ID NO: 11074 - protein, 9 aa, Artificial Sequence
  source: /note="Description of Artificial Sequence: Synthetic peptide"
CAPRLWPNY

SEQ ID NO: 11075 - protein, 9 aa, Artificial Sequence
  source: /note="Description of Artificial Sequence: Synthetic peptide"
YGAKRKRTA

SEQ ID NO: 11076 - protein, 9 aa, Artificial Sequence
  source: /note="Description of Artificial Sequence: Synthetic peptide"
FKFCAPRLW

SEQ ID NO: 11077 - protein, 9 aa, Artificial Sequence
  source: /note="Description of Artificial Sequence: Synthetic peptide"
HEGVFKFCA

SEQ ID NO: 11078 - protein, 10 aa, Artificial Sequence
  source: /note="Description of Artificial Sequence: Synthetic peptide"
RLWPNYGAKR

SEQ ID NO: 11079 - protein, 10 aa, Artificial Sequence
  source: /note="Description of Artificial Sequence: Synthetic peptide"
VFKFCAPRLW

SEQ ID NO: 11080 - protein, 10 aa, Artificial Sequence
  source: /note="Description of Artificial Sequence: Synthetic peptide"
FCAPRLWPNY

SEQ ID NO: 11081 - protein, 10 aa, Artificial Sequence
  source: /note="Description of Artificial Sequence: Synthetic peptide"
EGVFKFCAPR

SEQ ID NO: 11082 - protein, 10 aa, Artificial Sequence
  source: /note="Description of Artificial Sequence: Synthetic peptide"
APRLWPNYGA

SEQ ID NO: 11083 - protein, 10 aa, Artificial Sequence
  source: /note="Description of Artificial Sequence: Synthetic peptide"
GVFKFCAPRL

SEQ ID NO: 11084 - protein, 9 aa, Artificial Sequence
  source: /note="Description of Artificial Sequence: Synthetic peptide"
GLALTLQTI

SEQ ID NO: 11085 - protein, 9 aa, Artificial Sequence
  source: /note="Description of Artificial Sequence: Synthetic peptide"
GVAPVGSGL

SEQ ID NO: 11086 - protein, 9 aa, Artificial Sequence
  source: /note="Description of Artificial Sequence: Synthetic peptide"
APVGSGLAL

SEQ ID NO: 11087 - protein, 9 aa, Artificial Sequence
  source: /note="Description of Artificial Sequence: Synthetic peptide"
VGSGLALTL

SEQ ID NO: 11088 - protein, 10 aa, Artificial Sequence
  source: /note="Description of Artificial Sequence: Synthetic peptide"
GVAPVGSGLA

SEQ ID NO: 11089 - protein, 10 aa, Artificial Sequence
  source: /note="Description of Artificial Sequence: Synthetic peptide"
LGVAPVGSGL

SEQ ID NO: 11090 - protein, 10 aa, Artificial Sequence
  source: /note="Description of Artificial Sequence: Synthetic peptide"
SGLALTLQTI

SEQ ID NO: 11091 - protein, 10 aa, Artificial Sequence
  source: /note="Description of Artificial Sequence: Synthetic peptide"
LALTLQTIPL

SEQ ID NO: 11092 - protein, 9 aa, Artificial Sequence
  source: /note="Description of Artificial Sequence: Synthetic peptide"
KLWNLLMPM

SEQ ID NO: 11093 - protein, 9 aa, Artificial Sequence
  source: /note="Description of Artificial Sequence: Synthetic peptide"
LWNLLMPMK

SEQ ID NO: 11094 - protein, 9 aa, Artificial Sequence
  source: /note="Description of Artificial Sequence: Synthetic peptide"
MPMKKLNAR

SEQ ID NO: 11095 - protein, 10 aa, Artificial Sequence
  source: /note="Description of Artificial Sequence: Synthetic peptide"
LLMPMKKLNA

SEQ ID NO: 11096 - protein, 10 aa, Artificial Sequence
  source: /note="Description of Artificial Sequence: Synthetic peptide"
KLWNLLMPMK

SEQ ID NO: 11097 - protein, 10 aa, Artificial Sequence
  source: /note="Description of Artificial Sequence: Synthetic peptide"
LWNLLMPMKK

SEQ ID NO: 11098 - protein, 10 aa, Artificial Sequence
  source: /note="Description of Artificial Sequence: Synthetic peptide"
MKKLNARISK

SEQ ID NO: 11099 - protein, 10 aa, Artificial Sequence
  source: /note="Description of Artificial Sequence: Synthetic peptide"
LMPMKKLNAR

SEQ ID NO: 11100 - protein, 10 aa, Artificial Sequence
  source: /note="Description of Artificial Sequence: Synthetic peptide"
MPMKKLNARI

SEQ ID NO: 11101 - protein, 10 aa, Artificial Sequence
  source: /note="Description of Artificial Sequence: Synthetic peptide"
MKLWNLLMPM

SEQ ID NO: 11102 - protein, 10 aa, Artificial Sequence
  source: /note="Description of Artificial Sequence: Synthetic peptide"
QPHLSLDSAH

SEQ ID NO: 11103 - protein, 9 aa, Artificial Sequence
  source: /note="Description of Artificial Sequence: Synthetic peptide"
SYPPGGFSL

SEQ ID NO: 11104 - protein, 9 aa, Artificial Sequence
  source: /note="Description of Artificial Sequence: Synthetic peptide"
YPPGGFSLY

SEQ ID NO: 11105 - protein, 9 aa, Artificial Sequence
  source: /note="Description of Artificial Sequence: Synthetic peptide"
AASYPPGGF

SEQ ID NO: 11106 - protein, 10 aa, Artificial Sequence
  source: /note="Description of Artificial Sequence: Synthetic peptide"
SYPPGGFSLY

SEQ ID NO: 11107 - protein, 10 aa, Artificial Sequence
  source: /note="Description of Artificial Sequence: Synthetic peptide"
ASYPPGGFSL

SEQ ID NO: 11108 - protein, 10 aa, Artificial Sequence
  source: /note="Description of Artificial Sequence: Synthetic peptide"
GAASYPPGGF

SEQ ID NO: 11109 - protein, 9 aa, Artificial Sequence
  source: /note="Description of Artificial Sequence: Synthetic peptide"
SIVFWDWKR

SEQ ID NO: 11110 - protein, 9 aa, Artificial Sequence
  source: /note="Description of Artificial Sequence: Synthetic peptide"
WDWKRGEKI

SEQ ID NO: 11111 - protein, 10 aa, Artificial Sequence
  source: /note="Description of Artificial Sequence: Synthetic peptide"
HSIVFWDWKR

SEQ ID NO: 11112 - protein, 10 aa, Artificial Sequence
  source: /note="Description of Artificial Sequence: Synthetic peptide"
VFWDWKRGEK

SEQ ID NO: 11113 - protein, 9 aa, Artificial Sequence
  source: /note="Description of Artificial Sequence: Synthetic peptide"
SVLNEHFFK

SEQ ID NO: 11114 - protein, 9 aa, Artificial Sequence
  source: /note="Description of Artificial Sequence: Synthetic peptide"
MESVLNEHF

SEQ ID NO: 11115 - protein, 10 aa, Artificial Sequence
  source: /note="Description of Artificial Sequence: Synthetic peptide"
ESVLNEHFFK

SEQ ID NO: 11116 - protein, 10 aa, Artificial Sequence
  source: /note="Description of Artificial Sequence: Synthetic peptide"
HFFKDHQAPL

SEQ ID NO: 11117 - protein, 10 aa, Artificial Sequence
  source: /note="Description of Artificial Sequence: Synthetic peptide"
GMESVLNEHF

SEQ ID NO: 11118 - protein, 10 aa, Artificial Sequence
  source: /note="Description of Artificial Sequence: Synthetic peptide"
MESVLNEHFF

SEQ ID NO: 11119 - protein, 10 aa, Artificial Sequence
  source: /note="Description of Artificial Sequence: Synthetic peptide"
NEHFFKDHQA

SEQ ID NO: 11120 - protein, 9 aa, Artificial Sequence
  source: /note="Description of Artificial Sequence: Synthetic peptide"
SIQNHNTYL

SEQ ID NO: 11121 - protein, 9 aa, Artificial Sequence
  source: /note="Description of Artificial Sequence: Synthetic peptide"
RSIQNHNTY

SEQ ID NO: 11122 - protein, 9 aa, Artificial Sequence
  source: /note="Description of Artificial Sequence: Synthetic peptide"
IQNHNTYLH

SEQ ID NO: 11123 - protein, 9 aa, Artificial Sequence
  source: /note="Description of Artificial Sequence: Synthetic peptide"
QNHNTYLHL

SEQ ID NO: 11124 - protein, 10 aa, Artificial Sequence
  source: /note="Description of Artificial Sequence: Synthetic peptide"
RSIQNHNTYL

SEQ ID NO: 11125 - protein, 10 aa, Artificial Sequence
  source: /note="Description of Artificial Sequence: Synthetic peptide"
IQNHNTYLHL

SEQ ID NO: 11126 - protein, 10 aa, Artificial Sequence
  source: /note="Description of Artificial Sequence: Synthetic peptide"
CRSIQNHNTY

SEQ ID NO: 11127 - protein, 9 aa, Artificial Sequence
  source: /note="Description of Artificial Sequence: Synthetic peptide"
TLLKVSCGK

SEQ ID NO: 11128 - protein, 9 aa, Artificial Sequence
  source: /note="Description of Artificial Sequence: Synthetic peptide"
DINECATLL

SEQ ID NO: 11129 - protein, 9 aa, Artificial Sequence
  source: /note="Description of Artificial Sequence: Synthetic peptide"
LLKVSCGKF

SEQ ID NO: 11130 - protein, 9 aa, Artificial Sequence
  source: /note="Description of Artificial Sequence: Synthetic peptide"
NECATLLKV

SEQ ID NO: 11131 - protein, 10 aa, Artificial Sequence
  source: /note="Description of Artificial Sequence: Synthetic peptide"
ATLLKVSCGK

SEQ ID NO: 11132 - protein, 10 aa, Artificial Sequence
  source: /note="Description of Artificial Sequence: Synthetic peptide"
DINECATLLK

SEQ ID NO: 11133 - protein, 10 aa, Artificial Sequence
  source: /note="Description of Artificial Sequence: Synthetic peptide"
TLLKVSCGKF

SEQ ID NO: 11134 - protein, 9 aa, Artificial Sequence
  source: /note="Description of Artificial Sequence: Synthetic peptide"
VISRLDSPR

SEQ ID NO: 11135 - protein, 9 aa, Artificial Sequence
  source: /note="Description of Artificial Sequence: Synthetic peptide"
ISRLDSPRK

SEQ ID NO: 11136 - protein, 9 aa, Artificial Sequence
  source: /note="Description of Artificial Sequence: Synthetic peptide"
SKSPVISRL

SEQ ID NO: 11137 - protein, 10 aa, Artificial Sequence
  source: /note="Description of Artificial Sequence: Synthetic peptide"
VISRLDSPRK

SEQ ID NO: 11138 - protein, 10 aa, Artificial Sequence
  source: /note="Description of Artificial Sequence: Synthetic peptide"
GSKSPVISRL

SEQ ID NO: 11139 - protein, 10 aa, Artificial Sequence
  source: /note="Description of Artificial Sequence: Synthetic peptide"
PVISRLDSPR

SEQ ID NO: 11140 - protein, 9 aa, Artificial Sequence
  source: /note="Description of Artificial Sequence: Synthetic peptide"
QVAHPGNPV

SEQ ID NO: 11141 - protein, 9 aa, Artificial Sequence
  source: /note="Description of Artificial Sequence: Synthetic peptide"
VAHPGNPVY

SEQ ID NO: 11142 - protein, 10 aa, Artificial Sequence
  source: /note="Description of Artificial Sequence: Synthetic peptide"
KQVAHPGNPV

SEQ ID NO: 11143 - protein, 10 aa, Artificial Sequence
  source: /note="Description of Artificial Sequence: Synthetic peptide"
QVAHPGNPVY

SEQ ID NO: 11144 - protein, 10 aa, Artificial Sequence
  source: /note="Description of Artificial Sequence: Synthetic peptide"
FAWERKQVAH

SEQ ID NO: 11145 - protein, 9 aa, Artificial Sequence
  source: /note="Description of Artificial Sequence: Synthetic peptide"
AQWKNISVW

SEQ ID NO: 11146 - protein, 9 aa, Artificial Sequence
  source: /note="Description of Artificial Sequence: Synthetic peptide"
KAQWKNISV

SEQ ID NO: 11147 - protein, 10 aa, Artificial Sequence
  source: /note="Description of Artificial Sequence: Synthetic peptide"
HFTKAQWKNI

SEQ ID NO: 11148 - protein, 10 aa, Artificial Sequence
  source: /note="Description of Artificial Sequence: Synthetic peptide"
QWKNISVWCK

SEQ ID NO: 11149 - protein, 10 aa, Artificial Sequence
  source: /note="Description of Artificial Sequence: Synthetic peptide"
KAQWKNISVW

SEQ ID NO: 11150 - protein, 10 aa, Artificial Sequence
  source: /note="Description of Artificial Sequence: Synthetic peptide"
AQWKNISVWC

SEQ ID NO: 11151 - protein, 9 aa, Artificial Sequence
  source: /note="Description of Artificial Sequence: Synthetic peptide"
STYLVCCAV

SEQ ID NO: 11152 - protein, 9 aa, Artificial Sequence
  source: /note="Description of Artificial Sequence: Synthetic peptide"
MSTYLVCCA

SEQ ID NO: 11153 - protein, 9 aa, Artificial Sequence
  source: /note="Description of Artificial Sequence: Synthetic peptide"
CAVHQFDSV

SEQ ID NO: 11154 - protein, 9 aa, Artificial Sequence
  source: /note="Description of Artificial Sequence: Synthetic peptide"
LVCCAVHQF

SEQ ID NO: 11155 - protein, 10 aa, Artificial Sequence
  source: /note="Description of Artificial Sequence: Synthetic peptide"
YLVCCAVHQF

SEQ ID NO: 11156 - protein, 10 aa, Artificial Sequence
  source: /note="Description of Artificial Sequence: Synthetic peptide"
MSTYLVCCAV

SEQ ID NO: 11157 - protein, 10 aa, Artificial Sequence
  source: /note="Description of Artificial Sequence: Synthetic peptide"
CAVHQFDSVK

SEQ ID NO: 11158 - protein, 9 aa, Artificial Sequence
  source: /note="Description of Artificial Sequence: Synthetic peptide"
NTKVSYEFL

SEQ ID NO: 11159 - protein, 9 aa, Artificial Sequence
  source: /note="Description of Artificial Sequence: Synthetic peptide"
YEFLSPPQL

SEQ ID NO: 11160 - protein, 10 aa, Artificial Sequence
  source: /note="Description of Artificial Sequence: Synthetic peptide"
SYEFLSPPQL

SEQ ID NO: 11161 - protein, 10 aa, Artificial Sequence
  source: /note="Description of Artificial Sequence: Synthetic peptide"
EFLSPPQLNK

SEQ ID NO: 11162 - protein, 10 aa, Artificial Sequence
  source: /note="Description of Artificial Sequence: Synthetic peptide"
KNNTKVSYEF

SEQ ID NO: 11163 - protein, 10 aa, Artificial Sequence
  source: /note="Description of Artificial Sequence: Synthetic peptide"
YEFLSPPQLN

SEQ ID NO: 11164 - protein, 9 aa, Artificial Sequence
  source: /note="Description of Artificial Sequence: Synthetic peptide"
TLGAMDLGV

SEQ ID NO: 11165 - protein, 9 aa, Artificial Sequence
  source: /note="Description of Artificial Sequence: Synthetic peptide"
SLLRQPVQL

SEQ ID NO: 11166 - protein, 9 aa, Artificial Sequence
  source: /note="Description of Artificial Sequence: Synthetic peptide"
WLGTLWPSL

SEQ ID NO: 11167 - protein, 9 aa, Artificial Sequence
  source: /note="Description of Artificial Sequence: Synthetic peptide"
TLWPSLPSS

SEQ ID NO: 11168 - protein, 9 aa, Artificial Sequence
  source: /note="Description of Artificial Sequence: Synthetic peptide"
STLWTFCGL

SEQ ID NO: 11169 - protein, 9 aa, Artificial Sequence
  source: /note="Description of Artificial Sequence: Synthetic peptide"
AVTPTSAEI

SEQ ID NO: 11170 - protein, 9 aa, Artificial Sequence
  source: /note="Description of Artificial Sequence: Synthetic peptide"
ASSAMAVTR

SEQ ID NO: 11171 - protein, 9 aa, Artificial Sequence
  source: /note="Description of Artificial Sequence: Synthetic peptide"
TLWTFCGLR

SEQ ID NO: 11172 - protein, 9 aa, Artificial Sequence
  source: /note="Description of Artificial Sequence: Synthetic peptide"
LWTFCGLRW

SEQ ID NO: 11173 - protein, 9 aa, Artificial Sequence
  source: /note="Description of Artificial Sequence: Synthetic peptide"
RSLLRQPVQ

SEQ ID NO: 11174 - protein, 9 aa, Artificial Sequence
  source: /note="Description of Artificial Sequence: Synthetic peptide"
LLRQPVQLR

SEQ ID NO: 11175 - protein, 9 aa, Artificial Sequence
  source: /note="Description of Artificial Sequence: Synthetic peptide"
AMAVTRSSR

SEQ ID NO: 11176 - protein, 9 aa, Artificial Sequence
  source: /note="Description of Artificial Sequence: Synthetic peptide"
RSSRGCWPA

SEQ ID NO: 11177 - protein, 9 aa, Artificial Sequence
  source: /note="Description of Artificial Sequence: Synthetic peptide"
SSRGCWPAP

SEQ ID NO: 11178 - protein, 9 aa, Artificial Sequence
  source: /note="Description of Artificial Sequence: Synthetic peptide"
RGCWPAPSR

SEQ ID NO: 11179 - protein, 9 aa, Artificial Sequence
  source: /note="Description of Artificial Sequence: Synthetic peptide"
AGRGAFPPK

SEQ ID NO: 11180 - protein, 9 aa, Artificial Sequence
  source: /note="Description of Artificial Sequence: Synthetic peptide"
HAPWPSGPR

SEQ ID NO: 11181 - protein, 9 aa, Artificial Sequence
  source: /note="Description of Artificial Sequence: Synthetic peptide"
STTESTPTA

SEQ ID NO: 11182 - protein, 9 aa, Artificial Sequence
  source: /note="Description of Artificial Sequence: Synthetic peptide"
ESTPTASSA

SEQ ID NO: 11183 - protein, 9 aa, Artificial Sequence
  source: /note="Description of Artificial Sequence: Synthetic peptide"
STPTASSAM

SEQ ID NO: 11184 - protein, 9 aa, Artificial Sequence
  source: /note="Description of Artificial Sequence: Synthetic peptide"
EIWFLGSSA

SEQ ID NO: 11185 - protein, 9 aa, Artificial Sequence
  source: /note="Description of Artificial Sequence: Synthetic peptide"
WPAPSRPTA

SEQ ID NO: 11186 - protein, 9 aa, Artificial Sequence
  source: /note="Description of Artificial Sequence: Synthetic peptide"
APSRPTAST

SEQ ID NO: 11187 - protein, 9 aa, Artificial Sequence
  source: /note="Description of Artificial Sequence: Synthetic peptide"
RPTASTPAG

SEQ ID NO: 11188 - protein, 9 aa, Artificial Sequence
  source: /note="Description of Artificial Sequence: Synthetic peptide"
FPPKCCSGM

SEQ ID NO: 11189 - protein, 9 aa, Artificial Sequence
  source: /note="Description of Artificial Sequence: Synthetic peptide"
WPSGPRTST

SEQ ID NO: 11190 - protein, 9 aa, Artificial Sequence
  source: /note="Description of Artificial Sequence: Synthetic peptide"
APSPDALSM

SEQ ID NO: 11191 - protein, 9 aa, Artificial Sequence
  source: /note="Description of Artificial Sequence: Synthetic peptide"
WPSLPSSTL

SEQ ID NO: 11192 - protein, 9 aa, Artificial Sequence
  source: /note="Description of Artificial Sequence: Synthetic peptide"
LPSSTLWTF

SEQ ID NO: 11193 - protein, 9 aa, Artificial Sequence
  source: /note="Description of Artificial Sequence: Synthetic peptide"
GAMDLGVPL

SEQ ID NO: 11194 - protein, 9 aa, Artificial Sequence
  source: /note="Description of Artificial Sequence: Synthetic peptide"
LGVPLPRSL

SEQ ID NO: 11195 - protein, 9 aa, Artificial Sequence
  source: /note="Description of Artificial Sequence: Synthetic peptide"
ARSSCISTA

SEQ ID NO: 11196 - protein, 9 aa, Artificial Sequence
  source: /note="Description of Artificial Sequence: Synthetic peptide"
MCTSHHAPW

SEQ ID NO: 11197 - protein, 9 aa, Artificial Sequence
  source: /note="Description of Artificial Sequence: Synthetic peptide"
SMGSSSPQW

SEQ ID NO: 11198 - protein, 9 aa, Artificial Sequence
  source: /note="Description of Artificial Sequence: Synthetic peptide"
CGLRWGCPW

SEQ ID NO: 11199 - protein, 9 aa, Artificial Sequence
  source: /note="Description of Artificial Sequence: Synthetic peptide"
TPTSAEIWF

SEQ ID NO: 11200 - protein, 9 aa, Artificial Sequence
  source: /note="Description of Artificial Sequence: Synthetic peptide"
SPQWLGTLW

SEQ ID NO: 11201 - protein, 9 aa, Artificial Sequence
  source: /note="Description of Artificial Sequence: Synthetic peptide"
CPWPPCSSW

SEQ ID NO: 11202 - protein, 9 aa, Artificial Sequence
  source: /note="Description of Artificial Sequence: Synthetic peptide"
AEIWFLGSS

SEQ ID NO: 11203 - protein, 10 aa, Artificial Sequence
  source: /note="Description of Artificial Sequence: Synthetic peptide"
GTLGAMDLGV

SEQ ID NO: 11204 - protein, 10 aa, Artificial Sequence
  source: /note="Description of Artificial Sequence: Synthetic peptide"
FLGSSASPPA

SEQ ID NO: 11205 - protein, 10 aa, Artificial Sequence
  source: /note="Description of Artificial Sequence: Synthetic peptide"
SMGSSSPQWL

SEQ ID NO: 11206 - protein, 10 aa, Artificial Sequence
  source: /note="Description of Artificial Sequence: Synthetic peptide"
TLWPSLPSST

SEQ ID NO: 11207 - protein, 10 aa, Artificial Sequence
  source: /note="Description of Artificial Sequence: Synthetic peptide"
AMDLGVPLPR

SEQ ID NO: 11208 - protein, 10 aa, Artificial Sequence
  source: /note="Description of Artificial Sequence: Synthetic peptide"
SAMAVTRSSR

SEQ ID NO: 11209 - protein, 10 aa, Artificial Sequence
  source: /note="Description of Artificial Sequence: Synthetic peptide"
STLWTFCGLR

SEQ ID NO: 11210 - protein, 10 aa, Artificial Sequence
  source: /note="Description of Artificial Sequence: Synthetic peptide"
QWLGTLWPSL

SEQ ID NO: 11211 - protein, 10 aa, Artificial Sequence
  source: /note="Description of Artificial Sequence: Synthetic peptide"
LWPSLPSSTL

SEQ ID NO: 11212 - protein, 10 aa, Artificial Sequence
  source: /note="Description of Artificial Sequence: Synthetic peptide"
SLPSSTLWTF

SEQ ID NO: 11213 - protein, 10 aa, Artificial Sequence
  source: /note="Description of Artificial Sequence: Synthetic peptide"
RSLLRQPVQL

SEQ ID NO: 11214 - protein, 10 aa, Artificial Sequence
  source: /note="Description of Artificial Sequence: Synthetic peptide"
RTEPARSSCI

SEQ ID NO: 11215 - protein, 10 aa, Artificial Sequence
  source: /note="Description of Artificial Sequence: Synthetic peptide"
RSSCISTAST

SEQ ID NO: 11216 - protein, 10 aa, Artificial Sequence
  source: /note="Description of Artificial Sequence: Synthetic peptide"
SSRGCWPAPS

SEQ ID NO: 11217 - protein, 10 aa, Artificial Sequence
  source: /note="Description of Artificial Sequence: Synthetic peptide"
RTSTAVPGSA

SEQ ID NO: 11218 - protein, 10 aa, Artificial Sequence
  source: /note="Description of Artificial Sequence: Synthetic peptide"
SLLRQPVQLR

SEQ ID NO: 11219 - protein, 10 aa, Artificial Sequence
  source: /note="Description of Artificial Sequence: Synthetic peptide"
TASSAMAVTR

SEQ ID NO: 11220 - protein, 10 aa, Artificial Sequence
  source: /note="Description of Artificial Sequence: Synthetic peptide"
HHAPWPSGPR

SEQ ID NO: 11221 - protein, 10 aa, Artificial Sequence
  source: /note="Description of Artificial Sequence: Synthetic peptide"
STPTASSAMA

SEQ ID NO: 11222 - protein, 10 aa, Artificial Sequence
  source: /note="Description of Artificial Sequence: Synthetic peptide"
TSAEIWFLGS

SEQ ID NO: 11223 - protein, 10 aa, Artificial Sequence
  source: /note="Description of Artificial Sequence: Synthetic peptide"
SSTLWTFCGL

SEQ ID NO: 11224 - protein, 10 aa, Artificial Sequence
  source: /note="Description of Artificial Sequence: Synthetic peptide"
WTFCGLRWGC

SEQ ID NO: 11225 - protein, 10 aa, Artificial Sequence
  source: /note="Description of Artificial Sequence: Synthetic peptide"
LPRSLLRQPV

SEQ ID NO: 11226 - protein, 10 aa, Artificial Sequence
  source: /note="Description of Artificial Sequence: Synthetic peptide"
QPVQLRTEPA

SEQ ID NO: 11227 - protein, 10 aa, Artificial Sequence
  source: /note="Description of Artificial Sequence: Synthetic peptide"
TPTASSAMAV

SEQ ID NO: 11228 - protein, 10 aa, Artificial Sequence
  source: /note="Description of Artificial Sequence: Synthetic peptide"
WPAPSRPTAS

SEQ ID NO: 11229 - protein, 10 aa, Artificial Sequence
  source: /note="Description of Artificial Sequence: Synthetic peptide"
WPSGPRTSTA

SEQ ID NO: 11230 - protein, 10 aa, Artificial Sequence
  source: /note="Description of Artificial Sequence: Synthetic peptide"
VPGSACQGAV

SEQ ID NO: 11231 - protein, 10 aa, Artificial Sequence
  source: /note="Description of Artificial Sequence: Synthetic peptide"
SPPAPSPDAL

SEQ ID NO: 11232 - protein, 10 aa, Artificial Sequence
  source: /note="Description of Artificial Sequence: Synthetic peptide"
ASTPAGRGAF

SEQ ID NO: 11233 - protein, 10 aa, Artificial Sequence
  source: /note="Description of Artificial Sequence: Synthetic peptide"
ESTPTASSAM

SEQ ID NO: 11234 - protein, 10 aa, Artificial Sequence
  source: /note="Description of Artificial Sequence: Synthetic peptide"
LSMGSSSPQW

SEQ ID NO: 11235 - protein, 10 aa, Artificial Sequence
  source: /note="Description of Artificial Sequence: Synthetic peptide"
LGAMDLGVPL

SEQ ID NO: 11236 - protein, 10 aa, Artificial Sequence
  source: /note="Description of Artificial Sequence: Synthetic peptide"
GMCTSHHAPW

SEQ ID NO: 11237 - protein, 10 aa, Artificial Sequence
  source: /note="Description of Artificial Sequence: Synthetic peptide"
CQGAVTPTSA

SEQ ID NO: 11238 - protein, 10 aa, Artificial Sequence
  source: /note="Description of Artificial Sequence: Synthetic peptide"
AEIWFLGSSA

SEQ ID NO: 11239 - protein, 10 aa, Artificial Sequence
  source: /note="Description of Artificial Sequence: Synthetic peptide"
SSSPQWLGTL

SEQ ID NO: 11240 - protein, 10 aa, Artificial Sequence
  source: /note="Description of Artificial Sequence: Synthetic peptide"
TPTSAEIWFL

SEQ ID NO: 11241 - protein, 10 aa, Artificial Sequence
  source: /note="Description of Artificial Sequence: Synthetic peptide"
WPSLPSSTLW

SEQ ID NO: 11242 - protein, 10 aa, Artificial Sequence
  source: /note="Description of Artificial Sequence: Synthetic peptide"
TESTPTASSA

SEQ ID NO: 11243 - protein, 10 aa, Artificial Sequence
  source: /note="Description of Artificial Sequence: Synthetic peptide"
LPSSTLWTFC

SEQ ID NO: 11244 - protein, 9 aa, Artificial Sequence
  source: /note="Description of Artificial Sequence: Synthetic peptide"
GNFARQRYK

SEQ ID NO: 11245 - protein, 9 aa, Artificial Sequence
  source: /note="Description of Artificial Sequence: Synthetic peptide"
RQRYKDLVL

SEQ ID NO: 11246 - protein, 9 aa, Artificial Sequence
  source: /note="Description of Artificial Sequence: Synthetic peptide"
FARQRYKDL

SEQ ID NO: 11247 - protein, 9 aa, Artificial Sequence
  source: /note="Description of Artificial Sequence: Synthetic peptide"
KDLVLNETL

SEQ ID NO: 11248 - protein, 10 aa, Artificial Sequence
  source: /note="Description of Artificial Sequence: Synthetic peptide"
GGNFARQRYK

SEQ ID NO: 11249 - protein, 10 aa, Artificial Sequence
  source: /note="Description of Artificial Sequence: Synthetic peptide"
RQRYKDLVLN

SEQ ID NO: 11250 - protein, 10 aa, Artificial Sequence
  source: /note="Description of Artificial Sequence: Synthetic peptide"
FARQRYKDLV

SEQ ID NO: 11251 - protein, 10 aa, Artificial Sequence
  source: /note="Description of Artificial Sequence: Synthetic peptide"
YKDLVLNETL

SEQ ID NO: 11252 - protein, 9 aa, Artificial Sequence
  source: /note="Description of Artificial Sequence: Synthetic peptide"
HWRFQGANG

SEQ ID NO: 11253 - protein, 9 aa, Artificial Sequence
  source: /note="Description of Artificial Sequence: Synthetic peptide"
SLGYCYGRK

SEQ ID NO: 11254 - protein, 9 aa, Artificial Sequence
  source: /note="Description of Artificial Sequence: Synthetic peptide"
YCYGRKLEF

SEQ ID NO: 11255 - protein, 9 aa, Artificial Sequence
  source: /note="Description of Artificial Sequence: Synthetic peptide"
VMQSLGYCY

SEQ ID NO: 11256 - protein, 9 aa, Artificial Sequence
  source: /note="Description of Artificial Sequence: Synthetic peptide"
QSLGYCYGR

SEQ ID NO: 11257 - protein, 9 aa, Artificial Sequence
  source: /note="Description of Artificial Sequence: Synthetic peptide"
LGYCYGRKL

SEQ ID NO: 11258 - protein, 10 aa, Artificial Sequence
  source: /note="Description of Artificial Sequence: Synthetic peptide"
QSLGYCYGRK

SEQ ID NO: 11259 - protein, 10 aa, Artificial Sequence
  source: /note="Description of Artificial Sequence: Synthetic peptide"
GYCYGRKLEF

SEQ ID NO: 11260 - protein, 10 aa, Artificial Sequence
  source: /note="Description of Artificial Sequence: Synthetic peptide"
PVMQSLGYCY

SEQ ID NO: 11261 - protein, 10 aa, Artificial Sequence
  source: /note="Description of Artificial Sequence: Synthetic peptide"
MQSLGYCYGR

SEQ ID NO: 11262 - protein, 9 aa, Artificial Sequence
  source: /note="Description of Artificial Sequence: Synthetic peptide"
YLNSVHFFR

SEQ ID NO: 11263 - protein, 9 aa, Artificial Sequence
  source: /note="Description of Artificial Sequence: Synthetic peptide"
NSVHFFRPK

SEQ ID NO: 11264 - protein, 9 aa, Artificial Sequence
  source: /note="Description of Artificial Sequence: Synthetic peptide"
VYISYLNSV

SEQ ID NO: 11265 - protein, 9 aa, Artificial Sequence
  source: /note="Description of Artificial Sequence: Synthetic peptide"
ISYLNSVHF

SEQ ID NO: 11266 - protein, 9 aa, Artificial Sequence
  source: /note="Description of Artificial Sequence: Synthetic peptide"
SYLNSVHFF

SEQ ID NO: 11267 - protein, 9 aa, Artificial Sequence
  source: /note="Description of Artificial Sequence: Synthetic peptide"
RVYISYLNS

SEQ ID NO: 11268 - protein, 9 aa, Artificial Sequence
  source: /note="Description of Artificial Sequence: Synthetic peptide"
YISYLNSVH

SEQ ID NO: 11269 - protein, 10 aa, Artificial Sequence
  source: /note="Description of Artificial Sequence: Synthetic peptide"
RVYISYLNSV

SEQ ID NO: 11270 - protein, 10 aa, Artificial Sequence
  source: /note="Description of Artificial Sequence: Synthetic peptide"
SYLNSVHFFR

SEQ ID NO: 11271 - protein, 10 aa, Artificial Sequence
  source: /note="Description of Artificial Sequence: Synthetic peptide"
YISYLNSVHF

SEQ ID NO: 11272 - protein, 10 aa, Artificial Sequence
  source: /note="Description of Artificial Sequence: Synthetic peptide"
ISYLNSVHFF

SEQ ID NO: 11273 - protein, 10 aa, Artificial Sequence
  source: /note="Description of Artificial Sequence: Synthetic peptide"
LNSVHFFRPK

SEQ ID NO: 11274 - protein, 9 aa, Artificial Sequence
  source: /note="Description of Artificial Sequence: Synthetic peptide"
GSSLTEGAK

SEQ ID NO: 11275 - protein, 9 aa, Artificial Sequence
  source: /note="Description of Artificial Sequence: Synthetic peptide"
IKGKEGSSL

SEQ ID NO: 11276 - protein, 10 aa, Artificial Sequence
  source: /note="Description of Artificial Sequence: Synthetic peptide"
KEGSSLTEGA

SEQ ID NO: 11277 - protein, 9 aa, Artificial Sequence
  source: /note="Description of Artificial Sequence: Synthetic peptide"
KLFNAKSEH

SEQ ID NO: 11278 - protein, 9 aa, Artificial Sequence
  source: /note="Description of Artificial Sequence: Synthetic peptide"
ELKKLFNAK

SEQ ID NO: 11279 - protein, 9 aa, Artificial Sequence
  source: /note="Description of Artificial Sequence: Synthetic peptide"
VELKKLFNA

SEQ ID NO: 11280 - protein, 10 aa, Artificial Sequence
  source: /note="Description of Artificial Sequence: Synthetic peptide"
KLFNAKSEHL

SEQ ID NO: 11281 - protein, 9 aa, Artificial Sequence
  source: /note="Description of Artificial Sequence: Synthetic peptide"
LLGSIRTWI

SEQ ID NO: 11282 - protein, 9 aa, Artificial Sequence
  source: /note="Description of Artificial Sequence: Synthetic peptide"
TIPTAEFLL

SEQ ID NO: 11283 - protein, 9 aa, Artificial Sequence
  source: /note="Description of Artificial Sequence: Synthetic peptide"
FLLGSIRTW

SEQ ID NO: 11284 - protein, 10 aa, Artificial Sequence
  source: /note="Description of Artificial Sequence: Synthetic peptide"
FLLGSIRTWI

SEQ ID NO: 11285 - protein, 10 aa, Artificial Sequence
  source: /note="Description of Artificial Sequence: Synthetic peptide"
EFLLGSIRTW

SEQ ID NO: 11286 - protein, 10 aa, Artificial Sequence
  source: /note="Description of Artificial Sequence: Synthetic peptide"
ATIPTAEFLL

SEQ ID NO: 11287 - protein, 10 aa, Artificial Sequence
  source: /note="Description of Artificial Sequence: Synthetic peptide"
AEFLLGSIRT

SEQ ID NO: 11288 - protein, 9 aa, Artificial Sequence
  source: /note="Description of Artificial Sequence: Synthetic peptide"
FPVGAGPLG

SEQ ID NO: 11289 - protein, 10 aa, Artificial Sequence
  source: /note="Description of Artificial Sequence: Synthetic peptide"
TVRDCKSFPV

SEQ ID NO: 11290 - protein, 10 aa, Artificial Sequence
  source: /note="Description of Artificial Sequence: Synthetic peptide"
KSFPVGAGPL

SEQ ID NO: 11291 - protein, 10 aa, Artificial Sequence
  source: /note="Description of Artificial Sequence: Synthetic peptide"
FPVGAGPLGC

SEQ ID NO: 11292 - protein, 9 aa, Artificial Sequence
  source: /note="Description of Artificial Sequence: Synthetic peptide"
YLTFHNPGA

SEQ ID NO: 11293 - protein, 9 aa, Artificial Sequence
  source: /note="Description of Artificial Sequence: Synthetic peptide"
LTRRGLYLT

SEQ ID NO: 11294 - protein, 9 aa, Artificial Sequence
  source: /note="Description of Artificial Sequence: Synthetic peptide"
TRRGLYLTF

SEQ ID NO: 11295 - protein, 10 aa, Artificial Sequence
  source: /note="Description of Artificial Sequence: Synthetic peptide"
LTFHNPGACV

SEQ ID NO: 11296 - protein, 10 aa, Artificial Sequence
  source: /note="Description of Artificial Sequence: Synthetic peptide"
LTRRGLYLTF

SEQ ID NO: 11297 - protein, 9 aa, Artificial Sequence
  source: /note="Description of Artificial Sequence: Synthetic peptide"
RLPPPGTVL

SEQ ID NO: 11298 - protein, 10 aa, Artificial Sequence
  source: /note="Description of Artificial Sequence: Synthetic peptide"
GFRLPPPGTV

SEQ ID NO: 11299 - protein, 10 aa, Artificial Sequence
  source: /note="Description of Artificial Sequence: Synthetic peptide"
LPPPGTVLTF

SEQ ID NO: 11300 - protein, 10 aa, Artificial Sequence
  source: /note="Description of Artificial Sequence: Synthetic peptide"
FRLPPPGTVL

SEQ ID NO: 11301 - protein, 9 aa, Artificial Sequence
  source: /note="Description of Artificial Sequence: Synthetic peptide"
ATMCAAPRV

SEQ ID NO: 11302 - protein, 9 aa, Artificial Sequence
  source: /note="Description of Artificial Sequence: Synthetic peptide"
LSVSWSIPR

SEQ ID NO: 11303 - protein, 9 aa, Artificial Sequence
  source: /note="Description of Artificial Sequence: Synthetic peptide"
SVSWSIPRR

SEQ ID NO: 11304 - protein, 9 aa, Artificial Sequence
  source: /note="Description of Artificial Sequence: Synthetic peptide"
GSTRSLTAR

SEQ ID NO: 11305 - protein, 9 aa, Artificial Sequence
  source: /note="Description of Artificial Sequence: Synthetic peptide"
RSRAECGST

SEQ ID NO: 11306 - protein, 9 aa, Artificial Sequence
  source: /note="Description of Artificial Sequence: Synthetic peptide"
STRSLTARR

SEQ ID NO: 11307 - protein, 9 aa, Artificial Sequence
  source: /note="Description of Artificial Sequence: Synthetic peptide"
RSLTARRET

SEQ ID NO: 11308 - protein, 9 aa, Artificial Sequence
  source: /note="Description of Artificial Sequence: Synthetic peptide"
TARRETPTA

SEQ ID NO: 11309 - protein, 9 aa, Artificial Sequence
  source: /note="Description of Artificial Sequence: Synthetic peptide"
SWSIPRRSR

SEQ ID NO: 11310 - protein, 9 aa, Artificial Sequence
  source: /note="Description of Artificial Sequence: Synthetic peptide"
TATMCAAPR

SEQ ID NO: 11311 - protein, 9 aa, Artificial Sequence
  source: /note="Description of Artificial Sequence: Synthetic peptide"
ETPTATMCA

SEQ ID NO: 11312 - protein, 9 aa, Artificial Sequence
  source: /note="Description of Artificial Sequence: Synthetic peptide"
IPRRSRAEC

SEQ ID NO: 11313 - protein, 9 aa, Artificial Sequence
  source: /note="Description of Artificial Sequence: Synthetic peptide"
TPTATMCAA

SEQ ID NO: 11314 - protein, 9 aa, Artificial Sequence
  source: /note="Description of Artificial Sequence: Synthetic peptide"
AECGSTRSL

SEQ ID NO: 11315 - protein, 9 aa, Artificial Sequence
  source: /note="Description of Artificial Sequence: Synthetic peptide"
RRETPTATM

SEQ ID NO: 11316 - protein, 9 aa, Artificial Sequence
  source: /note="Description of Artificial Sequence: Synthetic peptide"
RETPTATMC

SEQ ID NO: 11317 - protein, 10 aa, Artificial Sequence
  source: /note="Description of Artificial Sequence: Synthetic peptide"
SLSVSWSIPR

SEQ ID NO: 11318 - protein, 10 aa, Artificial Sequence
  source: /note="Description of Artificial Sequence: Synthetic peptide"
LSVSWSIPRR

SEQ ID NO: 11319 - protein, 10 aa, Artificial Sequence
  source: /note="Description of Artificial Sequence: Synthetic peptide"
SWSIPRRSRA

SEQ ID NO: 11320 - protein, 10 aa, Artificial Sequence
  source: /note="Description of Artificial Sequence: Synthetic peptide"
RSRAECGSTR

SEQ ID NO: 11321 - protein, 10 aa, Artificial Sequence
  source: /note="Description of Artificial Sequence: Synthetic peptide"
VSWSIPRRSR

SEQ ID NO: 11322 - protein, 10 aa, Artificial Sequence
  source: /note="Description of Artificial Sequence: Synthetic peptide"
PTATMCAAPR

SEQ ID NO: 11323 - protein, 10 aa, Artificial Sequence
  source: /note="Description of Artificial Sequence: Synthetic peptide"
ETPTATMCAA

SEQ ID NO: 11324 - protein, 10 aa, Artificial Sequence
  source: /note="Description of Artificial Sequence: Synthetic peptide"
TATMCAAPRV

SEQ ID NO: 11325 - protein, 10 aa, Artificial Sequence
  source: /note="Description of Artificial Sequence: Synthetic peptide"
RAECGSTRSL

SEQ ID NO: 11326 - protein, 10 aa, Artificial Sequence
  source: /note="Description of Artificial Sequence: Synthetic peptide"
ARRETPTATM

SEQ ID NO: 11327 - protein, 10 aa, Artificial Sequence
  source: /note="Description of Artificial Sequence: Synthetic peptide"
RETPTATMCA

SEQ ID NO: 11328 - protein, 10 aa, Artificial Sequence
  source: /note="Description of Artificial Sequence: Synthetic peptide"
AECGSTRSLT

SEQ ID NO: 11329 - protein, 9 aa, Artificial Sequence
  source: /note="Description of Artificial Sequence: Synthetic peptide"
RSASDVWSY

SEQ ID NO: 11330 - protein, 9 aa, Artificial Sequence
  source: /note="Description of Artificial Sequence: Synthetic peptide"
KFRSASDVW

SEQ ID NO: 11331 - protein, 9 aa, Artificial Sequence
  source: /note="Description of Artificial Sequence: Synthetic peptide"
IAYRKFRSA

SEQ ID NO: 11332 - protein, 9 aa, Artificial Sequence
  source: /note="Description of Artificial Sequence: Synthetic peptide"
AYRKFRSAS

SEQ ID NO: 11333 - protein, 9 aa, Artificial Sequence
  source: /note="Description of Artificial Sequence: Synthetic peptide"
EAIAYRKFR

SEQ ID NO: 11334 - protein, 9 aa, Artificial Sequence
  source: /note="Description of Artificial Sequence: Synthetic peptide"
RKFRSASDV

SEQ ID NO: 11335 - protein, 10 aa, Artificial Sequence
  source: /note="Description of Artificial Sequence: Synthetic peptide"
AIAYRKFRSA

SEQ ID NO: 11336 - protein, 10 aa, Artificial Sequence
  source: /note="Description of Artificial Sequence: Synthetic peptide"
KFRSASDVWS

SEQ ID NO: 11337 - protein, 10 aa, Artificial Sequence
  source: /note="Description of Artificial Sequence: Synthetic peptide"
IAYRKFRSAS

SEQ ID NO: 11338 - protein, 10 aa, Artificial Sequence
  source: /note="Description of Artificial Sequence: Synthetic peptide"
RKFRSASDVW

SEQ ID NO: 11339 - protein, 10 aa, Artificial Sequence
  source: /note="Description of Artificial Sequence: Synthetic peptide"
FRSASDVWSY

SEQ ID NO: 11340 - protein, 9 aa, Artificial Sequence
  source: /note="Description of Artificial Sequence: Synthetic peptide"
SSASHAWSY

SEQ ID NO: 11341 - protein, 9 aa, Artificial Sequence
  source: /note="Description of Artificial Sequence: Synthetic peptide"
KFSSASHAW

SEQ ID NO: 11342 - protein, 9 aa, Artificial Sequence
  source: /note="Description of Artificial Sequence: Synthetic peptide"
ASHAWSYGI

SEQ ID NO: 11343 - protein, 9 aa, Artificial Sequence
  source: /note="Description of Artificial Sequence: Synthetic peptide"
HAWSYGIVM

SEQ ID NO: 11344 - protein, 9 aa, Artificial Sequence
  source: /note="Description of Artificial Sequence: Synthetic peptide"
YRKFSSASH

SEQ ID NO: 11345 - protein, 9 aa, Artificial Sequence
  source: /note="Description of Artificial Sequence: Synthetic peptide"
RKFSSASHA

SEQ ID NO: 11346 - protein, 10 aa, Artificial Sequence
  source: /note="Description of Artificial Sequence: Synthetic peptide"
FSSASHAWSY

SEQ ID NO: 11347 - protein, 10 aa, Artificial Sequence
  source: /note="Description of Artificial Sequence: Synthetic peptide"
AYRKFSSASH

SEQ ID NO: 11348 - protein, 10 aa, Artificial Sequence
  source: /note="Description of Artificial Sequence: Synthetic peptide"
ASHAWSYGIV

SEQ ID NO: 11349 - protein, 10 aa, Artificial Sequence
  source: /note="Description of Artificial Sequence: Synthetic peptide"
SASHAWSYGI

SEQ ID NO: 11350 - protein, 10 aa, Artificial Sequence
  source: /note="Description of Artificial Sequence: Synthetic peptide"
RKFSSASHAW

SEQ ID NO: 11351 - protein, 10 aa, Artificial Sequence
  source: /note="Description of Artificial Sequence: Synthetic peptide"
SHAWSYGIVM

SEQ ID NO: 11352 - protein, 10 aa, Artificial Sequence
  source: /note="Description of Artificial Sequence: Synthetic peptide"
HAWSYGIVMW

SEQ ID NO: 11353 - protein, 9 aa, Artificial Sequence
  source: /note="Description of Artificial Sequence: Synthetic peptide"
GLTEPHIYI

SEQ ID NO: 11354 - protein, 9 aa, Artificial Sequence
  source: /note="Description of Artificial Sequence: Synthetic peptide"
RQLGLTEPH

SEQ ID NO: 11355 - protein, 9 aa, Artificial Sequence
  source: /note="Description of Artificial Sequence: Synthetic peptide"
LGLTEPHIY

SEQ ID NO: 11356 - protein, 10 aa, Artificial Sequence
  source: /note="Description of Artificial Sequence: Synthetic peptide"
RQLGLTEPHI

SEQ ID NO: 11357 - protein, 10 aa, Artificial Sequence
  source: /note="Description of Artificial Sequence: Synthetic peptide"
QLGLTEPHIY

SEQ ID NO: 11358 - protein, 10 aa, Artificial Sequence
  source: /note="Description of Artificial Sequence: Synthetic peptide"
HIYISDLLAH

SEQ ID NO: 11359 - protein, 10 aa, Artificial Sequence
  source: /note="Description of Artificial Sequence: Synthetic peptide"
TEPHIYISDL

SEQ ID NO: 11360 - protein, 9 aa, Artificial Sequence
  source: /note="Description of Artificial Sequence: Synthetic peptide"
HSHAPNPAA

SEQ ID NO: 11361 - protein, 10 aa, Artificial Sequence
  source: /note="Description of Artificial Sequence: Synthetic peptide"
LTYPPGGGTR

SEQ ID NO: 11362 - protein, 9 aa, Artificial Sequence
  source: /note="Description of Artificial Sequence: Synthetic peptide"
KPPSCPQAI

SEQ ID NO: 11363 - protein, 10 aa, Artificial Sequence
  source: /note="Description of Artificial Sequence: Synthetic peptide"
HVKPPSCPQA

SEQ ID NO: 11364 - protein, 10 aa, Artificial Sequence
  source: /note="Description of Artificial Sequence: Synthetic peptide"
CPQAIPRSPC

SEQ ID NO: 11365 - protein, 9 aa, Artificial Sequence
  source: /note="Description of Artificial Sequence: Synthetic peptide"
HYQNIFSCL

SEQ ID NO: 11366 - protein, 9 aa, Artificial Sequence
  source: /note="Description of Artificial Sequence: Synthetic peptide"
GPINHYQNI

SEQ ID NO: 11367 - protein, 9 aa, Artificial Sequence
  source: /note="Description of Artificial Sequence: Synthetic peptide"
YQNIFSCLP

SEQ ID NO: 11368 - protein, 9 aa, Artificial Sequence
  source: /note="Description of Artificial Sequence: Synthetic peptide"
QNIFSCLPL

SEQ ID NO: 11369 - protein, 10 aa, Artificial Sequence
  source: /note="Description of Artificial Sequence: Synthetic peptide"
YQNIFSCLPL

SEQ ID NO: 11370 - protein, 10 aa, Artificial Sequence
  source: /note="Description of Artificial Sequence: Synthetic peptide"
QNIFSCLPLK

SEQ ID NO: 11371 - protein, 10 aa, Artificial Sequence
  source: /note="Description of Artificial Sequence: Synthetic peptide"
GPINHYQNIF

SEQ ID NO: 11372 - protein, 10 aa, Artificial Sequence
  source: /note="Description of Artificial Sequence: Synthetic peptide"
NHYQNIFSCL

SEQ ID NO: 11373 - protein, 9 aa, Artificial Sequence
  source: /note="Description of Artificial Sequence: Synthetic peptide"
STTTGSHWK

SEQ ID NO: 11374 - protein, 9 aa, Artificial Sequence
  source: /note="Description of Artificial Sequence: Synthetic peptide"
AVCTRTSMR

SEQ ID NO: 11375 - protein, 9 aa, Artificial Sequence
  source: /note="Description of Artificial Sequence: Synthetic peptide"
TSMRSFPTR

SEQ ID NO: 11376 - protein, 9 aa, Artificial Sequence
  source: /note="Description of Artificial Sequence: Synthetic peptide"
CTRTSMRSF

SEQ ID NO: 11377 - protein, 9 aa, Artificial Sequence
  source: /note="Description of Artificial Sequence: Synthetic peptide"
RTSMRSFPT

SEQ ID NO: 11378 - protein, 9 aa, Artificial Sequence
  source: /note="Description of Artificial Sequence: Synthetic peptide"
SMRSFPTRS

SEQ ID NO: 11379 - protein, 9 aa, Artificial Sequence
  source: /note="Description of Artificial Sequence: Synthetic peptide"
LEVQVATGV

SEQ ID NO: 11380 - protein, 9 aa, Artificial Sequence
  source: /note="Description of Artificial Sequence: Synthetic peptide"
VQVATGVSS

SEQ ID NO: 11381 - protein, 9 aa, Artificial Sequence
  source: /note="Description of Artificial Sequence: Synthetic peptide"
HSTTTGSHW

SEQ ID NO: 11382 - protein, 9 aa, Artificial Sequence
  source: /note="Description of Artificial Sequence: Synthetic peptide"
WKQPTDGAV

SEQ ID NO: 11383 - protein, 9 aa, Artificial Sequence
  source: /note="Description of Artificial Sequence: Synthetic peptide"
GAVCTRTSM

SEQ ID NO: 11384 - protein, 10 aa, Artificial Sequence
  source: /note="Description of Artificial Sequence: Synthetic peptide"
LLEVQVATGV

SEQ ID NO: 11385 - protein, 10 aa, Artificial Sequence
  source: /note="Description of Artificial Sequence: Synthetic peptide"
RTSMRSFPTR

SEQ ID NO: 11386 - protein, 10 aa, Artificial Sequence
  source: /note="Description of Artificial Sequence: Synthetic peptide"
HSTTTGSHWK

SEQ ID NO: 11387 - protein, 10 aa, Artificial Sequence
  source: /note="Description of Artificial Sequence: Synthetic peptide"
STHSTTTGSH

SEQ ID NO: 11388 - protein, 10 aa, Artificial Sequence
  source: /note="Description of Artificial Sequence: Synthetic peptide"
CTRTSMRSFP

SEQ ID NO: 11389 - protein, 10 aa, Artificial Sequence
  source: /note="Description of Artificial Sequence: Synthetic peptide"
SMRSFPTRST

SEQ ID NO: 11390 - protein, 10 aa, Artificial Sequence
  source: /note="Description of Artificial Sequence: Synthetic peptide"
VQVATGVSST

SEQ ID NO: 11391 - protein, 10 aa, Artificial Sequence
  source: /note="Description of Artificial Sequence: Synthetic peptide"
VCTRTSMRSF

SEQ ID NO: 11392 - protein, 9 aa, Artificial Sequence
  source: /note="Description of Artificial Sequence: Synthetic peptide"
EEMNRVLAH

SEQ ID NO: 11393 - protein, 9 aa, Artificial Sequence
  source: /note="Description of Artificial Sequence: Synthetic peptide"
HPSDDTKGF

SEQ ID NO: 11394 - protein, 10 aa, Artificial Sequence
  source: /note="Description of Artificial Sequence: Synthetic peptide"
VLAHPSDDTK

SEQ ID NO: 11395 - protein, 10 aa, Artificial Sequence
  source: /note="Description of Artificial Sequence: Synthetic peptide"
HPSDDTKGFF

SEQ ID NO: 11396 - protein, 10 aa, Artificial Sequence
  source: /note="Description of Artificial Sequence: Synthetic peptide"
DEEMNRVLAH

SEQ ID NO: 11397 - protein, 9 aa, Artificial Sequence
  source: /note="Description of Artificial Sequence: Synthetic peptide"
KLNQWCNVL

SEQ ID NO: 11398 - protein, 9 aa, Artificial Sequence
  source: /note="Description of Artificial Sequence: Synthetic peptide"
CNVLRWEFK

SEQ ID NO: 11399 - protein, 9 aa, Artificial Sequence
  source: /note="Description of Artificial Sequence: Synthetic peptide"
NQWCNVLRW

SEQ ID NO: 11400 - protein, 9 aa, Artificial Sequence
  source: /note="Description of Artificial Sequence: Synthetic peptide"
LNQWCNVLR

SEQ ID NO: 11401 - protein, 9 aa, Artificial Sequence
  source: /note="Description of Artificial Sequence: Synthetic peptide"
WCNVLRWEF

SEQ ID NO: 11402 - protein, 10 aa, Artificial Sequence
  source: /note="Description of Artificial Sequence: Synthetic peptide"
KLNQWCNVLR

SEQ ID NO: 11403 - protein, 10 aa, Artificial Sequence
  source: /note="Description of Artificial Sequence: Synthetic peptide"
QWCNVLRWEF

SEQ ID NO: 11404 - protein, 10 aa, Artificial Sequence
  source: /note="Description of Artificial Sequence: Synthetic peptide"
IKLNQWCNVL

SEQ ID NO: 11405 - protein, 9 aa, Artificial Sequence
  source: /note="Description of Artificial Sequence: Synthetic peptide"
RLISVNIRV

SEQ ID NO: 11406 - protein, 9 aa, Artificial Sequence
  source: /note="Description of Artificial Sequence: Synthetic peptide"
RRRLISVNI

SEQ ID NO: 11407 - protein, 9 aa, Artificial Sequence
  source: /note="Description of Artificial Sequence: Synthetic peptide"
DYRRRLISV

SEQ ID NO: 11408 - protein, 10 aa, Artificial Sequence
  source: /note="Description of Artificial Sequence: Synthetic peptide"
RRRLISVNIR

SEQ ID NO: 11409 - protein, 10 aa, Artificial Sequence
  source: /note="Description of Artificial Sequence: Synthetic peptide"
RLISVNIRVR

SEQ ID NO: 11410 - protein, 10 aa, Artificial Sequence
  source: /note="Description of Artificial Sequence: Synthetic peptide"
NDYRRRLISV

SEQ ID NO: 11411 - protein, 10 aa, Artificial Sequence
  source: /note="Description of Artificial Sequence: Synthetic peptide"
YRRRLISVNI

SEQ ID NO: 11412 - protein, 9 aa, Artificial Sequence
  source: /note="Description of Artificial Sequence: Synthetic peptide"
VSRENTSPK

SEQ ID NO: 11413 - protein, 9 aa, Artificial Sequence
  source: /note="Description of Artificial Sequence: Synthetic peptide"
IPVAIKVSR

SEQ ID NO: 11414 - protein, 10 aa, Artificial Sequence
  source: /note="Description of Artificial Sequence: Synthetic peptide"
KVSRENTSPK

SEQ ID NO: 11415 - protein, 10 aa, Artificial Sequence
  source: /note="Description of Artificial Sequence: Synthetic peptide"
VSRENTSPKA

SEQ ID NO: 11416 - protein, 9 aa, Artificial Sequence
  source: /note="Description of Artificial Sequence: Synthetic peptide"
ILYEAYVMA

SEQ ID NO: 11417 - protein, 9 aa, Artificial Sequence
  source: /note="Description of Artificial Sequence: Synthetic peptide"
YEAYVMAGV

SEQ ID NO: 11418 - protein, 9 aa, Artificial Sequence
  source: /note="Description of Artificial Sequence: Synthetic peptide"
NKEILYEAY

SEQ ID NO: 11419 - protein, 9 aa, Artificial Sequence
  source: /note="Description of Artificial Sequence: Synthetic peptide"
KEILYEAYV

SEQ ID NO: 11420 - protein, 9 aa, Artificial Sequence
  source: /note="Description of Artificial Sequence: Synthetic peptide"
EILYEAYVM

SEQ ID NO: 11421 - protein, 10 aa, Artificial Sequence
  source: /note="Description of Artificial Sequence: Synthetic peptide"
ILYEAYVMAG

SEQ ID NO: 11422 - protein, 10 aa, Artificial Sequence
  source: /note="Description of Artificial Sequence: Synthetic peptide"
ANKEILYEAY

SEQ ID NO: 11423 - protein, 10 aa, Artificial Sequence
  source: /note="Description of Artificial Sequence: Synthetic peptide"
EILYEAYVMA

SEQ ID NO: 11424 - protein, 10 aa, Artificial Sequence
  source: /note="Description of Artificial Sequence: Synthetic peptide"
KEILYEAYVM

SEQ ID NO: 11425 - protein, 10 aa, Artificial Sequence
  source: /note="Description of Artificial Sequence: Synthetic peptide"
SPKANKEILY

SEQ ID NO: 11426 - protein, 10 aa, Artificial Sequence
  source: /note="Description of Artificial Sequence: Synthetic peptide"
YEAYVMAGVG

SEQ ID NO: 11427 - protein, 9 aa, Artificial Sequence
  source: /note="Description of Artificial Sequence: Synthetic peptide"
VMAYVMAGV

SEQ ID NO: 11428 - protein, 9 aa, Artificial Sequence
  source: /note="Description of Artificial Sequence: Synthetic peptide"
YVMAYVMAG

SEQ ID NO: 11429 - protein, 9 aa, Artificial Sequence
  source: /note="Description of Artificial Sequence: Synthetic peptide"
DEAYVMAYV

SEQ ID NO: 11430 - protein, 9 aa, Artificial Sequence
  source: /note="Description of Artificial Sequence: Synthetic peptide"
EAYVMAYVM

SEQ ID NO: 11431 - protein, 9 aa, Artificial Sequence
  source: /note="Description of Artificial Sequence: Synthetic peptide"
LDEAYVMAY

SEQ ID NO: 11432 - protein, 9 aa, Artificial Sequence
  source: /note="Description of Artificial Sequence: Synthetic peptide"
MAYVMAGVG

SEQ ID NO: 11433 - protein, 10 aa, Artificial Sequence
  source: /note="Description of Artificial Sequence: Synthetic peptide"
ILDEAYVMAY

SEQ ID NO: 11434 - protein, 10 aa, Artificial Sequence
  source: /note="Description of Artificial Sequence: Synthetic peptide"
YVMAYVMAGV

SEQ ID NO: 11435 - protein, 10 aa, Artificial Sequence
  source: /note="Description of Artificial Sequence: Synthetic peptide"
EAYVMAYVMA

SEQ ID NO: 11436 - protein, 10 aa, Artificial Sequence
  source: /note="Description of Artificial Sequence: Synthetic peptide"
DEAYVMAYVM

SEQ ID NO: 11437 - protein, 9 aa, Artificial Sequence
  source: /note="Description of Artificial Sequence: Synthetic peptide"
AVCVGSPYV

SEQ ID NO: 11438 - protein, 9 aa, Artificial Sequence
  source: /note="Description of Artificial Sequence: Synthetic peptide"
MAVCVGSPY

SEQ ID NO: 11439 - protein, 9 aa, Artificial Sequence
  source: /note="Description of Artificial Sequence: Synthetic peptide"
EAYVMAVCV

SEQ ID NO: 11440 - protein, 9 aa, Artificial Sequence
  source: /note="Description of Artificial Sequence: Synthetic peptide"
YVMAVCVGS

SEQ ID NO: 11441 - protein, 9 aa, Artificial Sequence
  source: /note="Description of Artificial Sequence: Synthetic peptide"
DEAYVMAVC

SEQ ID NO: 11442 - protein, 10 aa, Artificial Sequence
  source: /note="Description of Artificial Sequence: Synthetic peptide"
ILDEAYVMAV

SEQ ID NO: 11443 - protein, 10 aa, Artificial Sequence
  source: /note="Description of Artificial Sequence: Synthetic peptide"
MAVCVGSPYV

SEQ ID NO: 11444 - protein, 10 aa, Artificial Sequence
  source: /note="Description of Artificial Sequence: Synthetic peptide"
VMAVCVGSPY

SEQ ID NO: 11445 - protein, 10 aa, Artificial Sequence
  source: /note="Description of Artificial Sequence: Synthetic peptide"
DEAYVMAVCV

SEQ ID NO: 11446 - protein, 9 aa, Artificial Sequence
  source: /note="Description of Artificial Sequence: Synthetic peptide"
RLIHRDLAA

SEQ ID NO: 11447 - protein, 9 aa, Artificial Sequence
  source: /note="Description of Artificial Sequence: Synthetic peptide"
SYLEDVRLI

SEQ ID NO: 11448 - protein, 9 aa, Artificial Sequence
  source: /note="Description of Artificial Sequence: Synthetic peptide"
LIHRDLAAR

SEQ ID NO: 11449 - protein, 10 aa, Artificial Sequence
  source: /note="Description of Artificial Sequence: Synthetic peptide"
RLIHRDLAAR

SEQ ID NO: 11450 - protein, 10 aa, Artificial Sequence
  source: /note="Description of Artificial Sequence: Synthetic peptide"
YLEDVRLIHR

SEQ ID NO: 11451 - protein, 10 aa, Artificial Sequence
  source: /note="Description of Artificial Sequence: Synthetic peptide"
MSYLEDVRLI

SEQ ID NO: 11452 - protein, 9 aa, Artificial Sequence
  source: /note="Description of Artificial Sequence: Synthetic peptide"
YGVTVWELI

SEQ ID NO: 11453 - protein, 9 aa, Artificial Sequence
  source: /note="Description of Artificial Sequence: Synthetic peptide"
VTVWELITF

SEQ ID NO: 11454 - protein, 9 aa, Artificial Sequence
  source: /note="Description of Artificial Sequence: Synthetic peptide"
LITFGAKPY

SEQ ID NO: 11455 - protein, 9 aa, Artificial Sequence
  source: /note="Description of Artificial Sequence: Synthetic peptide"
WELITFGAK

SEQ ID NO: 11456 - protein, 10 aa, Artificial Sequence
  source: /note="Description of Artificial Sequence: Synthetic peptide"
TVWELITFGA

SEQ ID NO: 11457 - protein, 10 aa, Artificial Sequence
  source: /note="Description of Artificial Sequence: Synthetic peptide"
SYGVTVWELI

SEQ ID NO: 11458 - protein, 10 aa, Artificial Sequence
  source: /note="Description of Artificial Sequence: Synthetic peptide"
ELITFGAKPY

SEQ ID NO: 11459 - protein, 10 aa, Artificial Sequence
  source: /note="Description of Artificial Sequence: Synthetic peptide"
GVTVWELITF

SEQ ID NO: 11460 - protein, 10 aa, Artificial Sequence
  source: /note="Description of Artificial Sequence: Synthetic peptide"
WELITFGAKP

SEQ ID NO: 11461 - protein, 9 aa, Artificial Sequence
  source: /note="Description of Artificial Sequence: Synthetic peptide"
YLSTDVGYC

SEQ ID NO: 11462 - protein, 10 aa, Artificial Sequence
  source: /note="Description of Artificial Sequence: Synthetic peptide"
STDVGYCTLV

SEQ ID NO: 11463 - protein, 10 aa, Artificial Sequence
  source: /note="Description of Artificial Sequence: Synthetic peptide"
YLSTDVGYCT

SEQ ID NO: 11464 - protein, 10 aa, Artificial Sequence
  source: /note="Description of Artificial Sequence: Synthetic peptide"
YNYLSTDVGY

SEQ ID NO: 11465 - protein, 10 aa, Artificial Sequence
  source: /note="Description of Artificial Sequence: Synthetic peptide"
LSTDVGYCTL

SEQ ID NO: 11466 - protein, 10 aa, Artificial Sequence
  source: /note="Description of Artificial Sequence: Synthetic peptide"
VGYCTLVCPL

SEQ ID NO: 11467 - protein, 9 aa, Artificial Sequence
  source: /note="Description of Artificial Sequence: Synthetic peptide"
STDVGFCTL

SEQ ID NO: 11468 - protein, 9 aa, Artificial Sequence
  source: /note="Description of Artificial Sequence: Synthetic peptide"
YLSTDVGFC

SEQ ID NO: 11469 - protein, 9 aa, Artificial Sequence
  source: /note="Description of Artificial Sequence: Synthetic peptide"
NYLSTDVGF

SEQ ID NO: 11470 - protein, 10 aa, Artificial Sequence
  source: /note="Description of Artificial Sequence: Synthetic peptide"
STDVGFCTLV

SEQ ID NO: 11471 - protein, 10 aa, Artificial Sequence
  source: /note="Description of Artificial Sequence: Synthetic peptide"
YLSTDVGFCT

SEQ ID NO: 11472 - protein, 10 aa, Artificial Sequence
  source: /note="Description of Artificial Sequence: Synthetic peptide"
YNYLSTDVGF

SEQ ID NO: 11473 - protein, 10 aa, Artificial Sequence
  source: /note="Description of Artificial Sequence: Synthetic peptide"
LSTDVGFCTL

SEQ ID NO: 11474 - protein, 10 aa, Artificial Sequence
  source: /note="Description of Artificial Sequence: Synthetic peptide"
VGFCTLVCPL

SEQ ID NO: 11475 - protein, 9 aa, Artificial Sequence
  source: /note="Description of Artificial Sequence: Synthetic peptide"
YVLVAINEF

SEQ ID NO: 11476 - protein, 9 aa, Artificial Sequence
  source: /note="Description of Artificial Sequence: Synthetic peptide"
VAINEFSTL

SEQ ID NO: 11477 - protein, 9 aa, Artificial Sequence
  source: /note="Description of Artificial Sequence: Synthetic peptide"
INEFSTLPL

SEQ ID NO: 11478 - protein, 10 aa, Artificial Sequence
  source: /note="Description of Artificial Sequence: Synthetic peptide"
AINEFSTLPL

SEQ ID NO: 11479 - protein, 10 aa, Artificial Sequence
  source: /note="Description of Artificial Sequence: Synthetic peptide"
GYVLVAINEF

SEQ ID NO: 11480 - protein, 10 aa, Artificial Sequence
  source: /note="Description of Artificial Sequence: Synthetic peptide"
EVTGYVLVAI

SEQ ID NO: 11481 - protein, 9 aa, Artificial Sequence
  source: /note="Description of Artificial Sequence: Synthetic peptide"
RMVRGTQVY

SEQ ID NO: 11482 - protein, 9 aa, Artificial Sequence
  source: /note="Description of Artificial Sequence: Synthetic peptide"
LPLPNLRMV

SEQ ID NO: 11483 - protein, 9 aa, Artificial Sequence
  source: /note="Description of Artificial Sequence: Synthetic peptide"
LRMVRGTQV

SEQ ID NO: 11484 - protein, 10 aa, Artificial Sequence
  source: /note="Description of Artificial Sequence: Synthetic peptide"
TLPLPNLRMV

SEQ ID NO: 11485 - protein, 10 aa, Artificial Sequence
  source: /note="Description of Artificial Sequence: Synthetic peptide"
NLRMVRGTQV

SEQ ID NO: 11486 - protein, 10 aa, Artificial Sequence
  source: /note="Description of Artificial Sequence: Synthetic peptide"
LRMVRGTQVY

SEQ ID NO: 11487 - protein, 9 aa, Artificial Sequence
  source: /note="Description of Artificial Sequence: Synthetic peptide"
RLVRGTQVY

SEQ ID NO: 11488 - protein, 9 aa, Artificial Sequence
  source: /note="Description of Artificial Sequence: Synthetic peptide"
LPLPNLRLV

SEQ ID NO: 11489 - protein, 10 aa, Artificial Sequence
  source: /note="Description of Artificial Sequence: Synthetic peptide"
TLPLPNLRLV

SEQ ID NO: 11490 - protein, 10 aa, Artificial Sequence
  source: /note="Description of Artificial Sequence: Synthetic peptide"
NLRLVRGTQV

SEQ ID NO: 11491 - protein, 10 aa, Artificial Sequence
  source: /note="Description of Artificial Sequence: Synthetic peptide"
LRLVRGTQVY

SEQ ID NO: 11492 - protein, 9 aa, Artificial Sequence
  source: /note="Description of Artificial Sequence: Synthetic peptide"
FVVYQTSCV

SEQ ID NO: 11493 - protein, 9 aa, Artificial Sequence
  source: /note="Description of Artificial Sequence: Synthetic peptide"
VVYQTSCVR

SEQ ID NO: 11494 - protein, 9 aa, Artificial Sequence
  source: /note="Description of Artificial Sequence: Synthetic peptide"
YQTSCVRAC

SEQ ID NO: 11495 - protein, 10 aa, Artificial Sequence
  source: /note="Description of Artificial Sequence: Synthetic peptide"
ASCPHNFVVY

SEQ ID NO: 11496 - protein, 10 aa, Artificial Sequence
  source: /note="Description of Artificial Sequence: Synthetic peptide"
FVVYQTSCVR

SEQ ID NO: 11497 - protein, 9 aa, Artificial Sequence
  source: /note="Description of Artificial Sequence: Synthetic peptide"
GLKRDSRLK

SEQ ID NO: 11498 - protein, 9 aa, Artificial Sequence
  source: /note="Description of Artificial Sequence: Synthetic peptide"
SLASSGLKR

SEQ ID NO: 11499 - protein, 10 aa, Artificial Sequence
  source: /note="Description of Artificial Sequence: Synthetic peptide"
SSLASSGLKR

SEQ ID NO: 11500 - protein, 10 aa, Artificial Sequence
  source: /note="Description of Artificial Sequence: Synthetic peptide"
SGLKRDSRLK

SEQ ID NO: 11501 - protein, 10 aa, Artificial Sequence
  source: /note="Description of Artificial Sequence: Synthetic peptide"
LKRDSRLKTL

SEQ ID NO: 11502 - protein, 9 aa, Artificial Sequence
  source: /note="Description of Artificial Sequence: Synthetic peptide"
LVYFPCDYI

SEQ ID NO: 11503 - protein, 9 aa, Artificial Sequence
  source: /note="Description of Artificial Sequence: Synthetic peptide"
VYFPCDYIY

SEQ ID NO: 11504 - protein, 9 aa, Artificial Sequence
  source: /note="Description of Artificial Sequence: Synthetic peptide"
LLVYFPCDY

SEQ ID NO: 11505 - protein, 9 aa, Artificial Sequence
  source: /note="Description of Artificial Sequence: Synthetic peptide"
CDYIYPEQF

SEQ ID NO: 11506 - protein, 9 aa, Artificial Sequence
  source: /note="Description of Artificial Sequence: Synthetic peptide"
FPCDYIYPE

SEQ ID NO: 11507 - protein, 10 aa, Artificial Sequence
  source: /note="Description of Artificial Sequence: Synthetic peptide"
LLVYFPCDYI

SEQ ID NO: 11508 - protein, 10 aa, Artificial Sequence
  source: /note="Description of Artificial Sequence: Synthetic peptide"
LVYFPCDYIY

SEQ ID NO: 11509 - protein, 10 aa, Artificial Sequence
  source: /note="Description of Artificial Sequence: Synthetic peptide"
GLLVYFPCDY

SEQ ID NO: 11510 - protein, 9 aa, Artificial Sequence
  source: /note="Description of Artificial Sequence: Synthetic peptide"
VVFDEAHSI

SEQ ID NO: 11511 - protein, 10 aa, Artificial Sequence
  source: /note="Description of Artificial Sequence: Synthetic peptide"
EAHSIDNVCI

SEQ ID NO: 11512 - protein, 9 aa, Artificial Sequence
  source: /note="Description of Artificial Sequence: Synthetic peptide"
NPVLPNEVL

SEQ ID NO: 11513 - protein, 9 aa, Artificial Sequence
  source: /note="Description of Artificial Sequence: Synthetic peptide"
LPNEVLQEA

SEQ ID NO: 11514 - protein, 10 aa, Artificial Sequence
  source: /note="Description of Artificial Sequence: Synthetic peptide"
VLPNEVLQEA

SEQ ID NO: 11515 - protein, 10 aa, Artificial Sequence
  source: /note="Description of Artificial Sequence: Synthetic peptide"
LANPVLPNEV

SEQ ID NO: 11516 - protein, 10 aa, Artificial Sequence
  source: /note="Description of Artificial Sequence: Synthetic peptide"
LPNEVLQEAV

SEQ ID NO: 11517 - protein, 9 aa, Artificial Sequence
  source: /note="Description of Artificial Sequence: Synthetic peptide"
FIDSKEVYR

SEQ ID NO: 11518 - protein, 9 aa, Artificial Sequence
  source: /note="Description of Artificial Sequence: Synthetic peptide"
NFIDSKEVY

SEQ ID NO: 11519 - protein, 10 aa, Artificial Sequence
  source: /note="Description of Artificial Sequence: Synthetic peptide"
YQNFIDSKEV

SEQ ID NO: 11520 - protein, 10 aa, Artificial Sequence
  source: /note="Description of Artificial Sequence: Synthetic peptide"
FIDSKEVYRI

SEQ ID NO: 11521 - protein, 10 aa, Artificial Sequence
  source: /note="Description of Artificial Sequence: Synthetic peptide"
KVYQNFIDSK

SEQ ID NO: 11522 - protein, 10 aa, Artificial Sequence
  source: /note="Description of Artificial Sequence: Synthetic peptide"
NFIDSKEVYR

SEQ ID NO: 11523 - protein, 10 aa, Artificial Sequence
  source: /note="Description of Artificial Sequence: Synthetic peptide"
QNFIDSKEVY

SEQ ID NO: 11524 - protein, 9 aa, Artificial Sequence
  source: /note="Description of Artificial Sequence: Synthetic peptide"
KTLQIDGTV

SEQ ID NO: 11525 - protein, 9 aa, Artificial Sequence
  source: /note="Description of Artificial Sequence: Synthetic peptide"
LQIDGTVTH

SEQ ID NO: 11526 - protein, 10 aa, Artificial Sequence
  source: /note="Description of Artificial Sequence: Synthetic peptide"
LQIDGTVTHL

SEQ ID NO: 11527 - protein, 10 aa, Artificial Sequence
  source: /note="Description of Artificial Sequence: Synthetic peptide"
KNRHFKTLQI

SEQ ID NO: 11528 - protein, 9 aa, Artificial Sequence
  source: /note="Description of Artificial Sequence: Synthetic peptide"
KVISGPMEK

SEQ ID NO: 11529 - protein, 10 aa, Artificial Sequence
  source: /note="Description of Artificial Sequence: Synthetic peptide"
VISGPMEKAK

SEQ ID NO: 11530 - protein, 10 aa, Artificial Sequence
  source: /note="Description of Artificial Sequence: Synthetic peptide"
SPTQLPKKVI

SEQ ID NO: 11531 - protein, 10 aa, Artificial Sequence
  source: /note="Description of Artificial Sequence: Synthetic peptide"
LPKKVISGPM

SEQ ID NO: 11532 - protein, 9 aa, Artificial Sequence
  source: /note="Description of Artificial Sequence: Synthetic peptide"
GLRQLPHLK

SEQ ID NO: 11533 - protein, 9 aa, Artificial Sequence
  source: /note="Description of Artificial Sequence: Synthetic peptide"
KLARDTLHF

SEQ ID NO: 11534 - protein, 9 aa, Artificial Sequence
  source: /note="Description of Artificial Sequence: Synthetic peptide"
RQLPHLKLA

SEQ ID NO: 11535 - protein, 9 aa, Artificial Sequence
  source: /note="Description of Artificial Sequence: Synthetic peptide"
QLPHLKLAR

SEQ ID NO: 11536 - protein, 9 aa, Artificial Sequence
  source: /note="Description of Artificial Sequence: Synthetic peptide"
HLKLARDTL

SEQ ID NO: 11537 - protein, 10 aa, Artificial Sequence
  source: /note="Description of Artificial Sequence: Synthetic peptide"
KLARDTLHFL

SEQ ID NO: 11538 - protein, 10 aa, Artificial Sequence
  source: /note="Description of Artificial Sequence: Synthetic peptide"
RQLPHLKLAR

SEQ ID NO: 11539 - protein, 10 aa, Artificial Sequence
  source: /note="Description of Artificial Sequence: Synthetic peptide"
LKLARDTLHF

SEQ ID NO: 11540 - protein, 10 aa, Artificial Sequence
  source: /note="Description of Artificial Sequence: Synthetic peptide"
AEETNGGTQI

SEQ ID NO: 11541 - protein, 9 aa, Artificial Sequence
  source: /note="Description of Artificial Sequence: Synthetic peptide"
KSKQGSILQ

SEQ ID NO: 11542 - protein, 9 aa, Artificial Sequence
  source: /note="Description of Artificial Sequence: Synthetic peptide"
GKSKQGSIL

SEQ ID NO: 11543 - protein, 9 aa, Artificial Sequence
  source: /note="Description of Artificial Sequence: Synthetic peptide"
SKQGSILQL

SEQ ID NO: 11544 - protein, 10 aa, Artificial Sequence
  source: /note="Description of Artificial Sequence: Synthetic peptide"
KSKQGSILQL

SEQ ID NO: 11545 - protein, 9 aa, Artificial Sequence
  source: /note="Description of Artificial Sequence: Synthetic peptide"
RLKKKSIQK

SEQ ID NO: 11546 - protein, 9 aa, Artificial Sequence
  source: /note="Description of Artificial Sequence: Synthetic peptide"
KIKKKKPRL

SEQ ID NO: 11547 - protein, 9 aa, Artificial Sequence
  source: /note="Description of Artificial Sequence: Synthetic peptide"
KKKKPRLKK

SEQ ID NO: 11548 - protein, 9 aa, Artificial Sequence
  source: /note="Description of Artificial Sequence: Synthetic peptide"
KKKPRLKKK

SEQ ID NO: 11549 - protein, 9 aa, Artificial Sequence
  source: /note="Description of Artificial Sequence: Synthetic peptide"
KPRLKKKSI

SEQ ID NO: 11550 - protein, 9 aa, Artificial Sequence
  source: /note="Description of Artificial Sequence: Synthetic peptide"
LKKKSIQKI

SEQ ID NO: 11551 - protein, 10 aa, Artificial Sequence
  source: /note="Description of Artificial Sequence: Synthetic peptide"
RLKKKSIQKI

SEQ ID NO: 11552 - protein, 10 aa, Artificial Sequence
  source: /note="Description of Artificial Sequence: Synthetic peptide"
KIKKKKPRLK

SEQ ID NO: 11553 - protein, 10 aa, Artificial Sequence
  source: /note="Description of Artificial Sequence: Synthetic peptide"
KKKKPRLKKK

SEQ ID NO: 11554 - protein, 10 aa, Artificial Sequence
  source: /note="Description of Artificial Sequence: Synthetic peptide"
IGKPTPPPGY

SEQ ID NO: 11555 - protein, 10 aa, Artificial Sequence
  source: /note="Description of Artificial Sequence: Synthetic peptide"
KPTPPPGYPA

SEQ ID NO: 11556 - protein, 9 aa, Artificial Sequence
  source: /note="Description of Artificial Sequence: Synthetic peptide"
AWRWDLLQK

SEQ ID NO: 11557 - protein, 10 aa, Artificial Sequence
  source: /note="Description of Artificial Sequence: Synthetic peptide"
AWRWDLLQKK

SEQ ID NO: 11558 - protein, 10 aa, Artificial Sequence
  source: /note="Description of Artificial Sequence: Synthetic peptide"
WRWDLLQKKL

SEQ ID NO: 11559 - protein, 9 aa, Artificial Sequence
  source: /note="Description of Artificial Sequence: Synthetic peptide"
GQRRRHRHA

SEQ ID NO: 11560 - protein, 9 aa, Artificial Sequence
  source: /note="Description of Artificial Sequence: Synthetic peptide"
RRRHRHALR

SEQ ID NO: 11561 - protein, 9 aa, Artificial Sequence
  source: /note="Description of Artificial Sequence: Synthetic peptide"
RPRRHDPTA

SEQ ID NO: 11562 - protein, 9 aa, Artificial Sequence
  source: /note="Description of Artificial Sequence: Synthetic peptide"
GPQPGHRVV

SEQ ID NO: 11563 - protein, 9 aa, Artificial Sequence
  source: /note="Description of Artificial Sequence: Synthetic peptide"
QRRRHRHAL

SEQ ID NO: 11564 - protein, 9 aa, Artificial Sequence
  source: /note="Description of Artificial Sequence: Synthetic peptide"
RPQQGAQLA

SEQ ID NO: 11565 - protein, 9 aa, Artificial Sequence
  source: /note="Description of Artificial Sequence: Synthetic peptide"
AAAARRGDL

SEQ ID NO: 11566 - protein, 9 aa, Artificial Sequence
  source: /note="Description of Artificial Sequence: Synthetic peptide"
QQGAQLAAA

SEQ ID NO: 11567 - protein, 9 aa, Artificial Sequence
  source: /note="Description of Artificial Sequence: Synthetic peptide"
GELHRREPV

SEQ ID NO: 11568 - protein, 10 aa, Artificial Sequence
  source: /note="Description of Artificial Sequence: Synthetic peptide"
GQRRRHRHAL

SEQ ID NO: 11569 - protein, 10 aa, Artificial Sequence
  source: /note="Description of Artificial Sequence: Synthetic peptide"
LVQECGADPR

SEQ ID NO: 11570 - protein, 10 aa, Artificial Sequence
  source: /note="Description of Artificial Sequence: Synthetic peptide"
QPGHRVVGEL

SEQ ID NO: 11571 - protein, 10 aa, Artificial Sequence
  source: /note="Description of Artificial Sequence: Synthetic peptide"
EPRPQQGAQL

SEQ ID NO: 11572 - protein, 10 aa, Artificial Sequence
  source: /note="Description of Artificial Sequence: Synthetic peptide"
RPQQGAQLAA

SEQ ID NO: 11573 - protein, 10 aa, Artificial Sequence
  source: /note="Description of Artificial Sequence: Synthetic peptide"
LAAAARRGDL

SEQ ID NO: 11574 - protein, 10 aa, Artificial Sequence
  source: /note="Description of Artificial Sequence: Synthetic peptide"
QQGAQLAAAA

SEQ ID NO: 11575 - protein, 10 aa, Artificial Sequence
  source: /note="Description of Artificial Sequence: Synthetic peptide"
IGKPIPPPSY

SEQ ID NO: 11576 - protein, 9 aa, Artificial Sequence
  source: /note="Description of Artificial Sequence: Synthetic peptide"
GPNGHLPAV

SEQ ID NO: 11577 - protein, 10 aa, Artificial Sequence
  source: /note="Description of Artificial Sequence: Synthetic peptide"
MPDPAGPNGH

SEQ ID NO: 11578 - protein, 9 aa, Artificial Sequence
  source: /note="Description of Artificial Sequence: Synthetic peptide"
LLSIYMEWA

SEQ ID NO: 11579 - protein, 9 aa, Artificial Sequence
  source: /note="Description of Artificial Sequence: Synthetic peptide"
ALLSIYMEW

SEQ ID NO: 11580 - protein, 9 aa, Artificial Sequence
  source: /note="Description of Artificial Sequence: Synthetic peptide"
IYMEWAEDL

SEQ ID NO: 11581 - protein, 9 aa, Artificial Sequence
  source: /note="Description of Artificial Sequence: Synthetic peptide"
EWAEDLPLR

SEQ ID NO: 11582 - protein, 9 aa, Artificial Sequence
  source: /note="Description of Artificial Sequence: Synthetic peptide"
MEWAEDLPL

SEQ ID NO: 11583 - protein, 10 aa, Artificial Sequence
  source: /note="Description of Artificial Sequence: Synthetic peptide"
ALLSIYMEWA

SEQ ID NO: 11584 - protein, 10 aa, Artificial Sequence
  source: /note="Description of Artificial Sequence: Synthetic peptide"
YMEWAEDLPL

SEQ ID NO: 11585 - protein, 10 aa, Artificial Sequence
  source: /note="Description of Artificial Sequence: Synthetic peptide"
AALLSIYMEW

SEQ ID NO: 11586 - protein, 9 aa, Artificial Sequence
  source: /note="Description of Artificial Sequence: Synthetic peptide"
SLIFMRLVL

SEQ ID NO: 11587 - protein, 9 aa, Artificial Sequence
  source: /note="Description of Artificial Sequence: Synthetic peptide"
FMRLVLRFL

SEQ ID NO: 11588 - protein, 9 aa, Artificial Sequence
  source: /note="Description of Artificial Sequence: Synthetic peptide"
LIFMRLVLR

SEQ ID NO: 11589 - protein, 9 aa, Artificial Sequence
  source: /note="Description of Artificial Sequence: Synthetic peptide"
IFMRLVLRF

SEQ ID NO: 11590 - protein, 9 aa, Artificial Sequence
  source: /note="Description of Artificial Sequence: Synthetic peptide"
DSLIFMRLV

SEQ ID NO: 11591 - protein, 9 aa, Artificial Sequence
  source: /note="Description of Artificial Sequence: Synthetic peptide"
HSGLDSLIF

SEQ ID NO: 11592 - protein, 9 aa, Artificial Sequence
  source: /note="Description of Artificial Sequence: Synthetic peptide"
SGLDSLIFM

SEQ ID NO: 11593 - protein, 10 aa, Artificial Sequence
  source: /note="Description of Artificial Sequence: Synthetic peptide"
GLDSLIFMRL

SEQ ID NO: 11594 - protein, 10 aa, Artificial Sequence
  source: /note="Description of Artificial Sequence: Synthetic peptide"
SLIFMRLVLR

SEQ ID NO: 11595 - protein, 10 aa, Artificial Sequence
  source: /note="Description of Artificial Sequence: Synthetic peptide"
IFMRLVLRFL

SEQ ID NO: 11596 - protein, 10 aa, Artificial Sequence
  source: /note="Description of Artificial Sequence: Synthetic peptide"
SGLDSLIFMR

SEQ ID NO: 11597 - protein, 10 aa, Artificial Sequence
  source: /note="Description of Artificial Sequence: Synthetic peptide"
LIFMRLVLRF

SEQ ID NO: 11598 - protein, 10 aa, Artificial Sequence
  source: /note="Description of Artificial Sequence: Synthetic peptide"
HSGLDSLIFM

SEQ ID NO: 11599 - protein, 9 aa, Artificial Sequence
  source: /note="Description of Artificial Sequence: Synthetic peptide"
WVFDEKNWK

SEQ ID NO: 11600 - protein, 9 aa, Artificial Sequence
  source: /note="Description of Artificial Sequence: Synthetic peptide"
IGLKELWVF

SEQ ID NO: 11601 - protein, 9 aa, Artificial Sequence
  source: /note="Description of Artificial Sequence: Synthetic peptide"
WIVDPNGLA

SEQ ID NO: 11602 - protein, 9 aa, Artificial Sequence
  source: /note="Description of Artificial Sequence: Synthetic peptide"
KESKIFWIV

SEQ ID NO: 11603 - protein, 10 aa, Artificial Sequence
  source: /note="Description of Artificial Sequence: Synthetic peptide"
IFWIVDPNGL

SEQ ID NO: 11604 - protein, 9 aa, Artificial Sequence
  source: /note="Description of Artificial Sequence: Synthetic peptide"
MMIKIFCCI

SEQ ID NO: 11605 - protein, 9 aa, Artificial Sequence
  source: /note="Description of Artificial Sequence: Synthetic peptide"
RQMMIKIFC

SEQ ID NO: 11606 - protein, 10 aa, Artificial Sequence
  source: /note="Description of Artificial Sequence: Synthetic peptide"
QMMIKIFCCI

SEQ ID NO: 11607 - protein, 10 aa, Artificial Sequence
  source: /note="Description of Artificial Sequence: Synthetic peptide"
KIFCCIEPEL

SEQ ID NO: 11608 - protein, 10 aa, Artificial Sequence
  source: /note="Description of Artificial Sequence: Synthetic peptide"
RQMMIKIFCC

SEQ ID NO: 11609 - protein, 9 aa, Artificial Sequence
  source: /note="Description of Artificial Sequence: Synthetic peptide"
EMRLPVAPK

SEQ ID NO: 11610 - protein, 9 aa, Artificial Sequence
  source: /note="Description of Artificial Sequence: Synthetic peptide"
APKPLSERL

SEQ ID NO: 11611 - protein, 9 aa, Artificial Sequence
  source: /note="Description of Artificial Sequence: Synthetic peptide"
MEMRLPVAP

SEQ ID NO: 11612 - protein, 10 aa, Artificial Sequence
  source: /note="Description of Artificial Sequence: Synthetic peptide"
MEMRLPVAPK

SEQ ID NO: 11613 - protein, 10 aa, Artificial Sequence
  source: /note="Description of Artificial Sequence: Synthetic peptide"
MRLPVAPKPL

SEQ ID NO: 11614 - protein, 9 aa, Artificial Sequence
  source: /note="Description of Artificial Sequence: Synthetic peptide"
KMYSCLKLL

SEQ ID NO: 11615 - protein, 9 aa, Artificial Sequence
  source: /note="Description of Artificial Sequence: Synthetic peptide"
ALKMYSCLK

SEQ ID NO: 11616 - protein, 9 aa, Artificial Sequence
  source: /note="Description of Artificial Sequence: Synthetic peptide"
ALLAALKMY

SEQ ID NO: 11617 - protein, 9 aa, Artificial Sequence
  source: /note="Description of Artificial Sequence: Synthetic peptide"
FALLAALKM

SEQ ID NO: 11618 - protein, 9 aa, Artificial Sequence
  source: /note="Description of Artificial Sequence: Synthetic peptide"
AALKMYSCL

SEQ ID NO: 11619 - protein, 9 aa, Artificial Sequence
  source: /note="Description of Artificial Sequence: Synthetic peptide"
LKMYSCLKL

SEQ ID NO: 11620 - protein, 10 aa, Artificial Sequence
  source: /note="Description of Artificial Sequence: Synthetic peptide"
LLAALKMYSC

SEQ ID NO: 11621 - protein, 10 aa, Artificial Sequence
  source: /note="Description of Artificial Sequence: Synthetic peptide"
ALKMYSCLKL

SEQ ID NO: 11622 - protein, 10 aa, Artificial Sequence
  source: /note="Description of Artificial Sequence: Synthetic peptide"
AALKMYSCLK

SEQ ID NO: 11623 - protein, 10 aa, Artificial Sequence
  source: /note="Description of Artificial Sequence: Synthetic peptide"
LAALKMYSCL

SEQ ID NO: 11624 - protein, 10 aa, Artificial Sequence
  source: /note="Description of Artificial Sequence: Synthetic peptide"
FALLAALKMY

SEQ ID NO: 11625 - protein, 10 aa, Artificial Sequence
  source: /note="Description of Artificial Sequence: Synthetic peptide"
LKMYSCLKLL

SEQ ID NO: 11626 - protein, 9 aa, Artificial Sequence
  source: /note="Description of Artificial Sequence: Synthetic peptide"
RDGSSNHVY

SEQ ID NO: 11627 - protein, 9 aa, Artificial Sequence
  source: /note="Description of Artificial Sequence: Synthetic peptide"
LKRDGSSNH

SEQ ID NO: 11628 - protein, 10 aa, Artificial Sequence
  source: /note="Description of Artificial Sequence: Synthetic peptide"
KRDGSSNHVY

SEQ ID NO: 11629 - protein, 9 aa, Artificial Sequence
  source: /note="Description of Artificial Sequence: Synthetic peptide"
FISEFCGEI

SEQ ID NO: 11630 - protein, 9 aa, Artificial Sequence
  source: /note="Description of Artificial Sequence: Synthetic peptide"
QKNEFISEF

SEQ ID NO: 11631 - protein, 9 aa, Artificial Sequence
  source: /note="Description of Artificial Sequence: Synthetic peptide"
SEFCGEIIS

SEQ ID NO: 11632 - protein, 10 aa, Artificial Sequence
  source: /note="Description of Artificial Sequence: Synthetic peptide"
FISEFCGEII

SEQ ID NO: 11633 - protein, 10 aa, Artificial Sequence
  source: /note="Description of Artificial Sequence: Synthetic peptide"
VQKNEFISEF

SEQ ID NO: 11634 - protein, 9 aa, Artificial Sequence
  source: /note="Description of Artificial Sequence: Synthetic peptide"
KGKNCELFT

SEQ ID NO: 11635 - protein, 9 aa, Artificial Sequence
  source: /note="Description of Artificial Sequence: Synthetic peptide"
FKGKNCELF

SEQ ID NO: 11636 - protein, 10 aa, Artificial Sequence
  source: /note="Description of Artificial Sequence: Synthetic peptide"
YTCTCLEGFK

SEQ ID NO: 11637 - protein, 10 aa, Artificial Sequence
  source: /note="Description of Artificial Sequence: Synthetic peptide"
CTCLEGFKGK

SEQ ID NO: 11638 - protein, 10 aa, Artificial Sequence
  source: /note="Description of Artificial Sequence: Synthetic peptide"
GFKGKNCELF

SEQ ID NO: 11639 - protein, 10 aa, Artificial Sequence
  source: /note="Description of Artificial Sequence: Synthetic peptide"
KGKNCELFTR

SEQ ID NO: 11640 - protein, 9 aa, Artificial Sequence
  source: /note="Description of Artificial Sequence: Synthetic peptide"
ILGPIIRAL

SEQ ID NO: 11641 - protein, 9 aa, Artificial Sequence
  source: /note="Description of Artificial Sequence: Synthetic peptide"
ALVRDTLKI

SEQ ID NO: 11642 - protein, 9 aa, Artificial Sequence
  source: /note="Description of Artificial Sequence: Synthetic peptide"
LVRDTLKIV

SEQ ID NO: 11643 - protein, 9 aa, Artificial Sequence
  source: /note="Description of Artificial Sequence: Synthetic peptide"
RALVRDTLK

SEQ ID NO: 11644 - protein, 9 aa, Artificial Sequence
  source: /note="Description of Artificial Sequence: Synthetic peptide"
IRALVRDTL

SEQ ID NO: 11645 - protein, 10 aa, Artificial Sequence
  source: /note="Description of Artificial Sequence: Synthetic peptide"
ILGPIIRALV

SEQ ID NO: 11646 - protein, 10 aa, Artificial Sequence
  source: /note="Description of Artificial Sequence: Synthetic peptide"
ALVRDTLKIV

SEQ ID NO: 11647 - protein, 10 aa, Artificial Sequence
  source: /note="Description of Artificial Sequence: Synthetic peptide"
IIRALVRDTL

SEQ ID NO: 11648 - protein, 10 aa, Artificial Sequence
  source: /note="Description of Artificial Sequence: Synthetic peptide"
RALVRDTLKI

SEQ ID NO: 11649 - protein, 10 aa, Artificial Sequence
  source: /note="Description of Artificial Sequence: Synthetic peptide"
LVRDTLKIVF

SEQ ID NO: 11650 - protein, 9 aa, Artificial Sequence
  source: /note="Description of Artificial Sequence: Synthetic peptide"
TLSPDFSQT

SEQ ID NO: 11651 - protein, 9 aa, Artificial Sequence
  source: /note="Description of Artificial Sequence: Synthetic peptide"
SPDFSQTNL

SEQ ID NO: 11652 - protein, 9 aa, Artificial Sequence
  source: /note="Description of Artificial Sequence: Synthetic peptide"
SHTTLSPDF

SEQ ID NO: 11653 - protein, 10 aa, Artificial Sequence
  source: /note="Description of Artificial Sequence: Synthetic peptide"
LSHTTLSPDF

SEQ ID NO: 11654 - protein, 9 aa, Artificial Sequence
  source: /note="Description of Artificial Sequence: Synthetic peptide"
YLLTSMYVK

SEQ ID NO: 11655 - protein, 9 aa, Artificial Sequence
  source: /note="Description of Artificial Sequence: Synthetic peptide"
KYLLTSMYV

SEQ ID NO: 11656 - protein, 9 aa, Artificial Sequence
  source: /note="Description of Artificial Sequence: Synthetic peptide"
GVKYLLTSM

SEQ ID NO: 11657 - protein, 9 aa, Artificial Sequence
  source: /note="Description of Artificial Sequence: Synthetic peptide"
GVTTQGVKY

SEQ ID NO: 11658 - protein, 9 aa, Artificial Sequence
  source: /note="Description of Artificial Sequence: Synthetic peptide"
VKYLLTSMY

SEQ ID NO: 11659 - protein, 9 aa, Artificial Sequence
  source: /note="Description of Artificial Sequence: Synthetic peptide"
TTQGVKYLL

SEQ ID NO: 11660 - protein, 10 aa, Artificial Sequence
  source: /note="Description of Artificial Sequence: Synthetic peptide"
KYLLTSMYVK

SEQ ID NO: 11661 - protein, 10 aa, Artificial Sequence
  source: /note="Description of Artificial Sequence: Synthetic peptide"
GVKYLLTSMY

SEQ ID NO: 11662 - protein, 10 aa, Artificial Sequence
  source: /note="Description of Artificial Sequence: Synthetic peptide"
QGVKYLLTSM

SEQ ID NO: 11663 - protein, 10 aa, Artificial Sequence
  source: /note="Description of Artificial Sequence: Synthetic peptide"
VKYLLTSMYV

SEQ ID NO: 11664 - protein, 9 aa, Artificial Sequence
  source: /note="Description of Artificial Sequence: Synthetic peptide"
HANFPQFLH

SEQ ID NO: 11665 - protein, 9 aa, Artificial Sequence
  source: /note="Description of Artificial Sequence: Synthetic peptide"
EPHANFPQF

SEQ ID NO: 11666 - protein, 9 aa, Artificial Sequence
  source: /note="Description of Artificial Sequence: Synthetic peptide"
IVTEPHANF

SEQ ID NO: 11667 - protein, 10 aa, Artificial Sequence
  source: /note="Description of Artificial Sequence: Synthetic peptide"
EPHANFPQFL

SEQ ID NO: 11668 - protein, 10 aa, Artificial Sequence
  source: /note="Description of Artificial Sequence: Synthetic peptide"
QIVTEPHANF

SEQ ID NO: 11669 - protein, 10 aa, Artificial Sequence
  source: /note="Description of Artificial Sequence: Synthetic peptide"
TEPHANFPQF

SEQ ID NO: 11670 - protein, 9 aa, Artificial Sequence
  source: /note="Description of Artificial Sequence: Synthetic peptide"
ELFWRHNIK

SEQ ID NO: 11671 - protein, 9 aa, Artificial Sequence
  source: /note="Description of Artificial Sequence: Synthetic peptide"
NIKCVRQVR

SEQ ID NO: 11672 - protein, 9 aa, Artificial Sequence
  source: /note="Description of Artificial Sequence: Synthetic peptide"
EELFWRHNI

SEQ ID NO: 11673 - protein, 10 aa, Artificial Sequence
  source: /note="Description of Artificial Sequence: Synthetic peptide"
FWRHNIKCVR

SEQ ID NO: 11674 - protein, 10 aa, Artificial Sequence
  source: /note="Description of Artificial Sequence: Synthetic peptide"
HNIKCVRQVR

SEQ ID NO: 11675 - protein, 10 aa, Artificial Sequence
  source: /note="Description of Artificial Sequence: Synthetic peptide"
NIKCVRQVRR

SEQ ID NO: 11676 - protein, 10 aa, Artificial Sequence
  source: /note="Description of Artificial Sequence: Synthetic peptide"
YEELFWRHNI

SEQ ID NO: 11677 - protein, 9 aa, Artificial Sequence
  source: /note="Description of Artificial Sequence: Synthetic peptide"
QLAAVRGMA

SEQ ID NO: 11678 - protein, 9 aa, Artificial Sequence
  source: /note="Description of Artificial Sequence: Synthetic peptide"
LAAVRGMAL

SEQ ID NO: 11679 - protein, 9 aa, Artificial Sequence
  source: /note="Description of Artificial Sequence: Synthetic peptide"
QQLAAVRGM

SEQ ID NO: 11680 - protein, 10 aa, Artificial Sequence
  source: /note="Description of Artificial Sequence: Synthetic peptide"
QLAAVRGMAL

SEQ ID NO: 11681 - protein, 10 aa, Artificial Sequence
  source: /note="Description of Artificial Sequence: Synthetic peptide"
EQQLAAVRGM

SEQ ID NO: 11682 - protein, 10 aa, Artificial Sequence
  source: /note="Description of Artificial Sequence: Synthetic peptide"
QQLAAVRGMA

SEQ ID NO: 11683 - protein, 9 aa, Artificial Sequence
  source: /note="Description of Artificial Sequence: Synthetic peptide"
KLNRMKVPL

SEQ ID NO: 11684 - protein, 9 aa, Artificial Sequence
  source: /note="Description of Artificial Sequence: Synthetic peptide"
PLMKLITRV

SEQ ID NO: 11685 - protein, 9 aa, Artificial Sequence
  source: /note="Description of Artificial Sequence: Synthetic peptide"
RMKVPLMKL

SEQ ID NO: 11686 - protein, 9 aa, Artificial Sequence
  source: /note="Description of Artificial Sequence: Synthetic peptide"
ISKKKHYNR

SEQ ID NO: 11687 - protein, 9 aa, Artificial Sequence
  source: /note="Description of Artificial Sequence: Synthetic peptide"
SKKKHYNRK

SEQ ID NO: 11688 - protein, 9 aa, Artificial Sequence
  source: /note="Description of Artificial Sequence: Synthetic peptide"
KHYNRKISI

SEQ ID NO: 11689 - protein, 9 aa, Artificial Sequence
  source: /note="Description of Artificial Sequence: Synthetic peptide"
HYNRKISIK

SEQ ID NO: 11690 - protein, 9 aa, Artificial Sequence
  source: /note="Description of Artificial Sequence: Synthetic peptide"
YNRKISIKK

SEQ ID NO: 11691 - protein, 9 aa, Artificial Sequence
  source: /note="Description of Artificial Sequence: Synthetic peptide"
KISIKKLNR

SEQ ID NO: 11692 - protein, 9 aa, Artificial Sequence
  source: /note="Description of Artificial Sequence: Synthetic peptide"
SIKKLNRMK

SEQ ID NO: 11693 - protein, 9 aa, Artificial Sequence
  source: /note="Description of Artificial Sequence: Synthetic peptide"
LNRMKVPLM

SEQ ID NO: 11694 - protein, 9 aa, Artificial Sequence
  source: /note="Description of Artificial Sequence: Synthetic peptide"
ISIKKLNRM

SEQ ID NO: 11695 - protein, 9 aa, Artificial Sequence
  source: /note="Description of Artificial Sequence: Synthetic peptide"
MKVPLMKLI

SEQ ID NO: 11696 - protein, 10 aa, Artificial Sequence
  source: /note="Description of Artificial Sequence: Synthetic peptide"
KLNRMKVPLM

SEQ ID NO: 11697 - protein, 10 aa, Artificial Sequence
  source: /note="Description of Artificial Sequence: Synthetic peptide"
RMKVPLMKLI

SEQ ID NO: 11698 - protein, 10 aa, Artificial Sequence
  source: /note="Description of Artificial Sequence: Synthetic peptide"
ISIKKLNRMK

SEQ ID NO: 11699 - protein, 10 aa, Artificial Sequence
  source: /note="Description of Artificial Sequence: Synthetic peptide"
ISKKKHYNRK

SEQ ID NO: 11700 - protein, 10 aa, Artificial Sequence
  source: /note="Description of Artificial Sequence: Synthetic peptide"
KHYNRKISIK

SEQ ID NO: 11701 - protein, 10 aa, Artificial Sequence
  source: /note="Description of Artificial Sequence: Synthetic peptide"
HYNRKISIKK

SEQ ID NO: 11702 - protein, 10 aa, Artificial Sequence
  source: /note="Description of Artificial Sequence: Synthetic peptide"
KISIKKLNRM

SEQ ID NO: 11703 - protein, 10 aa, Artificial Sequence
  source: /note="Description of Artificial Sequence: Synthetic peptide"
SIKKLNRMKV

SEQ ID NO: 11704 - protein, 10 aa, Artificial Sequence
  source: /note="Description of Artificial Sequence: Synthetic peptide"
LNRMKVPLMK

SEQ ID NO: 11705 - protein, 10 aa, Artificial Sequence
  source: /note="Description of Artificial Sequence: Synthetic peptide"
KVPLMKLITR

SEQ ID NO: 11706 - protein, 10 aa, Artificial Sequence
  source: /note="Description of Artificial Sequence: Synthetic peptide"
DISKKKHYNR

SEQ ID NO: 11707 - protein, 10 aa, Artificial Sequence
  source: /note="Description of Artificial Sequence: Synthetic peptide"
KKHYNRKISI

SEQ ID NO: 11708 - protein, 10 aa, Artificial Sequence
  source: /note="Description of Artificial Sequence: Synthetic peptide"
KKLNRMKVPL

SEQ ID NO: 11709 - protein, 10 aa, Artificial Sequence
  source: /note="Description of Artificial Sequence: Synthetic peptide"
VPLMKLITRV

SEQ ID NO: 11710 - protein, 9 aa, Artificial Sequence
  source: /note="Description of Artificial Sequence: Synthetic peptide"
SVILRRYFW

SEQ ID NO: 11711 - protein, 9 aa, Artificial Sequence
  source: /note="Description of Artificial Sequence: Synthetic peptide"
HESRQEVPM

SEQ ID NO: 11712 - protein, 9 aa, Artificial Sequence
  source: /note="Description of Artificial Sequence: Synthetic peptide"
VPMYTGHES

SEQ ID NO: 11713 - protein, 10 aa, Artificial Sequence
  source: /note="Description of Artificial Sequence: Synthetic peptide"
RQEVPMYTGH

SEQ ID NO: 11714 - protein, 10 aa, Artificial Sequence
  source: /note="Description of Artificial Sequence: Synthetic peptide"
HESRQEVPMY

SEQ ID NO: 11715 - protein, 9 aa, Artificial Sequence
  source: /note="Description of Artificial Sequence: Synthetic peptide"
KVATGHSAK

SEQ ID NO: 11716 - protein, 9 aa, Artificial Sequence
  source: /note="Description of Artificial Sequence: Synthetic peptide"
ATGHSAKDK

SEQ ID NO: 11717 - protein, 9 aa, Artificial Sequence
  source: /note="Description of Artificial Sequence: Synthetic peptide"
RKVATGHSA

SEQ ID NO: 11718 - protein, 9 aa, Artificial Sequence
  source: /note="Description of Artificial Sequence: Synthetic peptide"
VQTSSYMLV

SEQ ID NO: 11719 - protein, 9 aa, Artificial Sequence
  source: /note="Description of Artificial Sequence: Synthetic peptide"
MLVDENTFS

SEQ ID NO: 11720 - protein, 9 aa, Artificial Sequence
  source: /note="Description of Artificial Sequence: Synthetic peptide"
YMLVDENTF

SEQ ID NO: 11721 - protein, 10 aa, Artificial Sequence
  source: /note="Description of Artificial Sequence: Synthetic peptide"
FIVQTSSYML

SEQ ID NO: 11722 - protein, 10 aa, Artificial Sequence
  source: /note="Description of Artificial Sequence: Synthetic peptide"
IVQTSSYMLV

SEQ ID NO: 11723 - protein, 10 aa, Artificial Sequence
  source: /note="Description of Artificial Sequence: Synthetic peptide"
SYMLVDENTF

SEQ ID NO: 11724 - protein, 9 aa, Artificial Sequence
  source: /note="Description of Artificial Sequence: Synthetic peptide"
LRSTLREPL

SEQ ID NO: 11725 - protein, 10 aa, Artificial Sequence
  source: /note="Description of Artificial Sequence: Synthetic peptide"
EPCDPLRSTL

SEQ ID NO: 11726 - protein, 9 aa, Artificial Sequence
  source: /note="Description of Artificial Sequence: Synthetic peptide"
TMREPLDIR

SEQ ID NO: 11727 - protein, 9 aa, Artificial Sequence
  source: /note="Description of Artificial Sequence: Synthetic peptide"
LSSTMREPL

SEQ ID NO: 11728 - protein, 10 aa, Artificial Sequence
  source: /note="Description of Artificial Sequence: Synthetic peptide"
STMREPLDIR

SEQ ID NO: 11729 - protein, 10 aa, Artificial Sequence
  source: /note="Description of Artificial Sequence: Synthetic peptide"
EPCDPLSSTM

SEQ ID NO: 11730 - protein, 9 aa, Artificial Sequence
  source: /note="Description of Artificial Sequence: Synthetic peptide"
GLNLKIPHV

SEQ ID NO: 11731 - protein, 9 aa, Artificial Sequence
  source: /note="Description of Artificial Sequence: Synthetic peptide"
HVIALENPR

SEQ ID NO: 11732 - protein, 9 aa, Artificial Sequence
  source: /note="Description of Artificial Sequence: Synthetic peptide"
LKIPHVIAL

SEQ ID NO: 11733 - protein, 10 aa, Artificial Sequence
  source: /note="Description of Artificial Sequence: Synthetic peptide"
GLNLKIPHVI

SEQ ID NO: 11734 - protein, 10 aa, Artificial Sequence
  source: /note="Description of Artificial Sequence: Synthetic peptide"
NLKIPHVIAL

SEQ ID NO: 11735 - protein, 10 aa, Artificial Sequence
  source: /note="Description of Artificial Sequence: Synthetic peptide"
KGLNLKIPHV

SEQ ID NO: 11736 - protein, 9 aa, Artificial Sequence
  source: /note="Description of Artificial Sequence: Synthetic peptide"
MQHAHKCHR

SEQ ID NO: 11737 - protein, 10 aa, Artificial Sequence
  source: /note="Description of Artificial Sequence: Synthetic peptide"
CMQHAHKCHR

SEQ ID NO: 11738 - protein, 9 aa, Artificial Sequence
  source: /note="Description of Artificial Sequence: Synthetic peptide"
TLSHLCSEL

SEQ ID NO: 11739 - protein, 9 aa, Artificial Sequence
  source: /note="Description of Artificial Sequence: Synthetic peptide"
HLCSELQML

SEQ ID NO: 11740 - protein, 9 aa, Artificial Sequence
  source: /note="Description of Artificial Sequence: Synthetic peptide"
SHLCSELQM

SEQ ID NO: 11741 - protein, 10 aa, Artificial Sequence
  source: /note="Description of Artificial Sequence: Synthetic peptide"
ETLSHLCSEL

SEQ ID NO: 11742 - protein, 10 aa, Artificial Sequence
  source: /note="Description of Artificial Sequence: Synthetic peptide"
LAVEETLSHL

SEQ ID NO: 11743 - protein, 10 aa, Artificial Sequence
  source: /note="Description of Artificial Sequence: Synthetic peptide"
LSHLCSELQM

SEQ ID NO: 11744 - protein, 9 aa, Artificial Sequence
  source: /note="Description of Artificial Sequence: Synthetic peptide"
IMAHPPLST

SEQ ID NO: 11745 - protein, 9 aa, Artificial Sequence
  source: /note="Description of Artificial Sequence: Synthetic peptide"
MAHPPLSTV

SEQ ID NO: 11746 - protein, 9 aa, Artificial Sequence
  source: /note="Description of Artificial Sequence: Synthetic peptide"
WTLCWALPK

SEQ ID NO: 11747 - protein, 9 aa, Artificial Sequence
  source: /note="Description of Artificial Sequence: Synthetic peptide"
TSRTSRQWA

SEQ ID NO: 11748 - protein, 9 aa, Artificial Sequence
  source: /note="Description of Artificial Sequence: Synthetic peptide"
RTSRQWAPP

SEQ ID NO: 11749 - protein, 9 aa, Artificial Sequence
  source: /note="Description of Artificial Sequence: Synthetic peptide"
TLCWALPKR

SEQ ID NO: 11750 - protein, 9 aa, Artificial Sequence
  source: /note="Description of Artificial Sequence: Synthetic peptide"
SNWTSRTSR

SEQ ID NO: 11751 - protein, 9 aa, Artificial Sequence
  source: /note="Description of Artificial Sequence: Synthetic peptide"
VPIMAHPPL

SEQ ID NO: 11752 - protein, 9 aa, Artificial Sequence
  source: /note="Description of Artificial Sequence: Synthetic peptide"
THWSSGWTL

SEQ ID NO: 11753 - protein, 9 aa, Artificial Sequence
  source: /note="Description of Artificial Sequence: Synthetic peptide"
SGWTLCWAL

SEQ ID NO: 11754 - protein, 9 aa, Artificial Sequence
  source: /note="Description of Artificial Sequence: Synthetic peptide"
TSRQWAPPW

SEQ ID NO: 11755 - protein, 9 aa, Artificial Sequence
  source: /note="Description of Artificial Sequence: Synthetic peptide"
RQWAPPWTS

SEQ ID NO: 11756 - protein, 9 aa, Artificial Sequence
  source: /note="Description of Artificial Sequence: Synthetic peptide"
WSSGWTLCW

SEQ ID NO: 11757 - protein, 10 aa, Artificial Sequence
  source: /note="Description of Artificial Sequence: Synthetic peptide"
IMAHPPLSTV

SEQ ID NO: 11758 - protein, 10 aa, Artificial Sequence
  source: /note="Description of Artificial Sequence: Synthetic peptide"
GWTLCWALPK

SEQ ID NO: 11759 - protein, 10 aa, Artificial Sequence
  source: /note="Description of Artificial Sequence: Synthetic peptide"
WTLCWALPKR

SEQ ID NO: 11760 - protein, 10 aa, Artificial Sequence
  source: /note="Description of Artificial Sequence: Synthetic peptide"
ASNWTSRTSR

SEQ ID NO: 11761 - protein, 10 aa, Artificial Sequence
  source: /note="Description of Artificial Sequence: Synthetic peptide"
HWSSGWTLCW

SEQ ID NO: 11762 - protein, 10 aa, Artificial Sequence
  source: /note="Description of Artificial Sequence: Synthetic peptide"
RTSRQWAPPW

SEQ ID NO: 11763 - protein, 10 aa, Artificial Sequence
  source: /note="Description of Artificial Sequence: Synthetic peptide"
TTHWSSGWTL

SEQ ID NO: 11764 - protein, 10 aa, Artificial Sequence
  source: /note="Description of Artificial Sequence: Synthetic peptide"
WSSGWTLCWA

SEQ ID NO: 11765 - protein, 10 aa, Artificial Sequence
  source: /note="Description of Artificial Sequence: Synthetic peptide"
MAHPPLSTVT

SEQ ID NO: 11766 - protein, 10 aa, Artificial Sequence
  source: /note="Description of Artificial Sequence: Synthetic peptide"
SSGWTLCWAL

SEQ ID NO: 11767 - protein, 10 aa, Artificial Sequence
  source: /note="Description of Artificial Sequence: Synthetic peptide"
WALPKRASNW

SEQ ID NO: 11768 - protein, 10 aa, Artificial Sequence
  source: /note="Description of Artificial Sequence: Synthetic peptide"
RQWAPPWTSC

SEQ ID NO: 11769 - protein, 10 aa, Artificial Sequence
  source: /note="Description of Artificial Sequence: Synthetic peptide"
PPLSTVTTHW

SEQ ID NO: 11770 - protein, 9 aa, Artificial Sequence
  source: /note="Description of Artificial Sequence: Synthetic peptide"
RQRQQQQQR

SEQ ID NO: 11771 - protein, 9 aa, Artificial Sequence
  source: /note="Description of Artificial Sequence: Synthetic peptide"
RRRQQEPSW

SEQ ID NO: 11772 - protein, 10 aa, Artificial Sequence
  source: /note="Description of Artificial Sequence: Synthetic peptide"
RQRQQQQQRR

SEQ ID NO: 11773 - protein, 9 aa, Artificial Sequence
  source: /note="Description of Artificial Sequence: Synthetic peptide"
RLFKPTTPA

SEQ ID NO: 11774 - protein, 9 aa, Artificial Sequence
  source: /note="Description of Artificial Sequence: Synthetic peptide"
LQSLQRLFK

SEQ ID NO: 11775 - protein, 9 aa, Artificial Sequence
  source: /note="Description of Artificial Sequence: Synthetic peptide"
KPTTPAPPL

SEQ ID NO: 11776 - protein, 9 aa, Artificial Sequence
  source: /note="Description of Artificial Sequence: Synthetic peptide"
LQRLFKPTT

SEQ ID NO: 11777 - protein, 10 aa, Artificial Sequence
  source: /note="Description of Artificial Sequence: Synthetic peptide"
KLQSLQRLFK

SEQ ID NO: 11778 - protein, 10 aa, Artificial Sequence
  source: /note="Description of Artificial Sequence: Synthetic peptide"
LQRLFKPTTP

SEQ ID NO: 11779 - protein, 10 aa, Artificial Sequence
  source: /note="Description of Artificial Sequence: Synthetic peptide"
RLFKPTTPAP

SEQ ID NO: 11780 - protein, 10 aa, Artificial Sequence
  source: /note="Description of Artificial Sequence: Synthetic peptide"
FKPTTPAPPL

SEQ ID NO: 11781 - protein, 10 aa, Artificial Sequence
  source: /note="Description of Artificial Sequence: Synthetic peptide"
DTNDDPECGV

SEQ ID NO: 11782 - protein, 9 aa, Artificial Sequence
  source: /note="Description of Artificial Sequence: Synthetic peptide"
STSKYCSCV

SEQ ID NO: 11783 - protein, 9 aa, Artificial Sequence
  source: /note="Description of Artificial Sequence: Synthetic peptide"
GEVTSTSKY

SEQ ID NO: 11784 - protein, 9 aa, Artificial Sequence
  source: /note="Description of Artificial Sequence: Synthetic peptide"
SKYCSCVSS

SEQ ID NO: 11785 - protein, 10 aa, Artificial Sequence
  source: /note="Description of Artificial Sequence: Synthetic peptide"
GVGEVTSTSK

SEQ ID NO: 11786 - protein, 10 aa, Artificial Sequence
  source: /note="Description of Artificial Sequence: Synthetic peptide"
VGEVTSTSKY

SEQ ID NO: 11787 - protein, 10 aa, Artificial Sequence
  source: /note="Description of Artificial Sequence: Synthetic peptide"
TSTSKYCSCV

SEQ ID NO: 11788 - protein, 10 aa, Artificial Sequence
  source: /note="Description of Artificial Sequence: Synthetic peptide"
SKYCSCVSSS

SEQ ID NO: 11789 - protein, 9 aa, Artificial Sequence
  source: /note="Description of Artificial Sequence: Synthetic peptide"
MVKTRDNFK

SEQ ID NO: 11790 - protein, 9 aa, Artificial Sequence
  source: /note="Description of Artificial Sequence: Synthetic peptide"
KTRDNFKIY

SEQ ID NO: 11791 - protein, 9 aa, Artificial Sequence
  source: /note="Description of Artificial Sequence: Synthetic peptide"
SMVKTRDNF

SEQ ID NO: 11792 - protein, 10 aa, Artificial Sequence
  source: /note="Description of Artificial Sequence: Synthetic peptide"
SMVKTRDNFK

SEQ ID NO: 11793 - protein, 10 aa, Artificial Sequence
  source: /note="Description of Artificial Sequence: Synthetic peptide"
MVKTRDNFKI

SEQ ID NO: 11794 - protein, 10 aa, Artificial Sequence
  source: /note="Description of Artificial Sequence: Synthetic peptide"
KTRDNFKIYN

SEQ ID NO: 11795 - protein, 10 aa, Artificial Sequence
  source: /note="Description of Artificial Sequence: Synthetic peptide"
VSMVKTRDNF

SEQ ID NO: 11796 - protein, 10 aa, Artificial Sequence
  source: /note="Description of Artificial Sequence: Synthetic peptide"
VKTRDNFKIY

SEQ ID NO: 11797 - protein, 9 aa, Artificial Sequence
  source: /note="Description of Artificial Sequence: Synthetic peptide"
FTKMIPLLR

SEQ ID NO: 11798 - protein, 9 aa, Artificial Sequence
  source: /note="Description of Artificial Sequence: Synthetic peptide"
SFTKMIPLL

SEQ ID NO: 11799 - protein, 9 aa, Artificial Sequence
  source: /note="Description of Artificial Sequence: Synthetic peptide"
ESFTKMIPL

SEQ ID NO: 11800 - protein, 9 aa, Artificial Sequence
  source: /note="Description of Artificial Sequence: Synthetic peptide"
WALESFTKM

SEQ ID NO: 11801 - protein, 10 aa, Artificial Sequence
  source: /note="Description of Artificial Sequence: Synthetic peptide"
NQWALESFTK

SEQ ID NO: 11802 - protein, 10 aa, Artificial Sequence
  source: /note="Description of Artificial Sequence: Synthetic peptide"
SFTKMIPLLR

SEQ ID NO: 11803 - protein, 10 aa, Artificial Sequence
  source: /note="Description of Artificial Sequence: Synthetic peptide"
ESFTKMIPLL

SEQ ID NO: 11804 - protein, 10 aa, Artificial Sequence
  source: /note="Description of Artificial Sequence: Synthetic peptide"
WALESFTKMI

SEQ ID NO: 11805 - protein, 10 aa, Artificial Sequence
  source: /note="Description of Artificial Sequence: Synthetic peptide"
LESFTKMIPL

SEQ ID NO: 11806 - protein, 9 aa, Artificial Sequence
  source: /note="Description of Artificial Sequence: Synthetic peptide"
KQLKHFSQK

SEQ ID NO: 11807 - protein, 9 aa, Artificial Sequence
  source: /note="Description of Artificial Sequence: Synthetic peptide"
YLQKQLKHF

SEQ ID NO: 11808 - protein, 9 aa, Artificial Sequence
  source: /note="Description of Artificial Sequence: Synthetic peptide"
KHFSQKYSR

SEQ ID NO: 11809 - protein, 9 aa, Artificial Sequence
  source: /note="Description of Artificial Sequence: Synthetic peptide"
QLKHFSQKY

SEQ ID NO: 11810 - protein, 10 aa, Artificial Sequence
  source: /note="Description of Artificial Sequence: Synthetic peptide"
KYLQKQLKHF

SEQ ID NO: 11811 - protein, 10 aa, Artificial Sequence
  source: /note="Description of Artificial Sequence: Synthetic peptide"
KQLKHFSQKY

SEQ ID NO: 11812 - protein, 10 aa, Artificial Sequence
  source: /note="Description of Artificial Sequence: Synthetic peptide"
RKYLQKQLKH

SEQ ID NO: 11813 - protein, 10 aa, Artificial Sequence
  source: /note="Description of Artificial Sequence: Synthetic peptide"
KHFSQKYSRL

SEQ ID NO: 11814 - protein, 9 aa, Artificial Sequence
  source: /note="Description of Artificial Sequence: Synthetic peptide"
EEWGGPGQA

SEQ ID NO: 11815 - protein, 10 aa, Artificial Sequence
  source: /note="Description of Artificial Sequence: Synthetic peptide"
EEWGGPGQAG

SEQ ID NO: 11816 - protein, 10 aa, Artificial Sequence
  source: /note="Description of Artificial Sequence: Synthetic peptide"
TEEWGGPGQA

SEQ ID NO: 11817 - protein, 9 aa, Artificial Sequence
  source: /note="Description of Artificial Sequence: Synthetic peptide"
VQALGIPLT

SEQ ID NO: 11818 - protein, 10 aa, Artificial Sequence
  source: /note="Description of Artificial Sequence: Synthetic peptide"
VQALGIPLTP

SEQ ID NO: 11819 - protein, 9 aa, Artificial Sequence
  source: /note="Description of Artificial Sequence: Synthetic peptide"
IIVYLLCEL

SEQ ID NO: 11820 - protein, 9 aa, Artificial Sequence
  source: /note="Description of Artificial Sequence: Synthetic peptide"
YLLCELLSS

SEQ ID NO: 11821 - protein, 10 aa, Artificial Sequence
  source: /note="Description of Artificial Sequence: Synthetic peptide"
AIIVYLLCEL

SEQ ID NO: 11822 - protein, 10 aa, Artificial Sequence
  source: /note="Description of Artificial Sequence: Synthetic peptide"
IIVYLLCELL

SEQ ID NO: 11823 - protein, 10 aa, Artificial Sequence
  source: /note="Description of Artificial Sequence: Synthetic peptide"
YLLCELLSSS

SEQ ID NO: 11824 - protein, 10 aa, Artificial Sequence
  source: /note="Description of Artificial Sequence: Synthetic peptide"
LTCGIMDPPR

SEQ ID NO: 11825 - protein, 9 aa, Artificial Sequence
  source: /note="Description of Artificial Sequence: Synthetic peptide"
SLMTSTFTS

SEQ ID NO: 11826 - protein, 9 aa, Artificial Sequence
  source: /note="Description of Artificial Sequence: Synthetic peptide"
WILLLTILL

SEQ ID NO: 11827 - protein, 9 aa, Artificial Sequence
  source: /note="Description of Artificial Sequence: Synthetic peptide"
ILLRGARPV

SEQ ID NO: 11828 - protein, 9 aa, Artificial Sequence
  source: /note="Description of Artificial Sequence: Synthetic peptide"
VMMKMLHHC

SEQ ID NO: 11829 - protein, 9 aa, Artificial Sequence
  source: /note="Description of Artificial Sequence: Synthetic peptide"
MLHHCQPNL

SEQ ID NO: 11830 - protein, 9 aa, Artificial Sequence
  source: /note="Description of Artificial Sequence: Synthetic peptide"
GIMDPPSLM

SEQ ID NO: 11831 - protein, 9 aa, Artificial Sequence
  source: /note="Description of Artificial Sequence: Synthetic peptide"
FTSSHFKWI

SEQ ID NO: 11832 - protein, 9 aa, Artificial Sequence
  source: /note="Description of Artificial Sequence: Synthetic peptide"
LLTILLRGA

SEQ ID NO: 11833 - protein, 9 aa, Artificial Sequence
  source: /note="Description of Artificial Sequence: Synthetic peptide"
LQARGPAPA

SEQ ID NO: 11834 - protein, 9 aa, Artificial Sequence
  source: /note="Description of Artificial Sequence: Synthetic peptide"
ALPSQFSST

SEQ ID NO: 11835 - protein, 9 aa, Artificial Sequence
  source: /note="Description of Artificial Sequence: Synthetic peptide"
TVARHQLFV

SEQ ID NO: 11836 - protein, 9 aa, Artificial Sequence
  source: /note="Description of Artificial Sequence: Synthetic peptide"
STFTSSHFK

SEQ ID NO: 11837 - protein, 9 aa, Artificial Sequence
  source: /note="Description of Artificial Sequence: Synthetic peptide"
HQLFVVMMK

SEQ ID NO: 11838 - protein, 9 aa, Artificial Sequence
  source: /note="Description of Artificial Sequence: Synthetic peptide"
MTSTFTSSH

SEQ ID NO: 11839 - protein, 9 aa, Artificial Sequence
  source: /note="Description of Artificial Sequence: Synthetic peptide"
GSSSQTVAR

SEQ ID NO: 11840 - protein, 9 aa, Artificial Sequence
  source: /note="Description of Artificial Sequence: Synthetic peptide"
TFTSSHFKW

SEQ ID NO: 11841 - protein, 9 aa, Artificial Sequence
  source: /note="Description of Artificial Sequence: Synthetic peptide"
SHFKWILLL

SEQ ID NO: 11842 - protein, 9 aa, Artificial Sequence
  source: /note="Description of Artificial Sequence: Synthetic peptide"
KWILLLTIL

SEQ ID NO: 11843 - protein, 9 aa, Artificial Sequence
  source: /note="Description of Artificial Sequence: Synthetic peptide"
QTVARHQLF

SEQ ID NO: 11844 - protein, 9 aa, Artificial Sequence
  source: /note="Description of Artificial Sequence: Synthetic peptide"
HCQPNLLIF

SEQ ID NO: 11845 - protein, 9 aa, Artificial Sequence
  source: /note="Description of Artificial Sequence: Synthetic peptide"
CQPNLLIFI

SEQ ID NO: 11846 - protein, 9 aa, Artificial Sequence
  source: /note="Description of Artificial Sequence: Synthetic peptide"
SSHFKWILL

SEQ ID NO: 11847 - protein, 9 aa, Artificial Sequence
  source: /note="Description of Artificial Sequence: Synthetic peptide"
VARHQLFVV

SEQ ID NO: 11848 - protein, 9 aa, Artificial Sequence
  source: /note="Description of Artificial Sequence: Synthetic peptide"
LTILLRGAR

SEQ ID NO: 11849 - protein, 9 aa, Artificial Sequence
  source: /note="Description of Artificial Sequence: Synthetic peptide"
QARGPAPAL

SEQ ID NO: 11850 - protein, 9 aa, Artificial Sequence
  source: /note="Description of Artificial Sequence: Synthetic peptide"
TSTFTSSHF

SEQ ID NO: 11851 - protein, 9 aa, Artificial Sequence
  source: /note="Description of Artificial Sequence: Synthetic peptide"
LMTSTFTSS

SEQ ID NO: 11852 - protein, 9 aa, Artificial Sequence
  source: /note="Description of Artificial Sequence: Synthetic peptide"
FKWILLLTI

SEQ ID NO: 11853 - protein, 9 aa, Artificial Sequence
  source: /note="Description of Artificial Sequence: Synthetic peptide"
RGARPVCHL

SEQ ID NO: 11854 - protein, 9 aa, Artificial Sequence
  source: /note="Description of Artificial Sequence: Synthetic peptide"
SQFSSTPGS

SEQ ID NO: 11855 - protein, 9 aa, Artificial Sequence
  source: /note="Description of Artificial Sequence: Synthetic peptide"
SQTVARHQL

SEQ ID NO: 11856 - protein, 9 aa, Artificial Sequence
  source: /note="Description of Artificial Sequence: Synthetic peptide"
ARHQLFVVM

SEQ ID NO: 11857 - protein, 9 aa, Artificial Sequence
  source: /note="Description of Artificial Sequence: Synthetic peptide"
RHQLFVVMM

SEQ ID NO: 11858 - protein, 9 aa, Artificial Sequence
  source: /note="Description of Artificial Sequence: Synthetic peptide"
QLFVVMMKM

SEQ ID NO: 11859 - protein, 9 aa, Artificial Sequence
  source: /note="Description of Artificial Sequence: Synthetic peptide"
MKMLHHCQP

SEQ ID NO: 11860 - protein, 9 aa, Artificial Sequence
  source: /note="Description of Artificial Sequence: Synthetic peptide"
KMLHHCQPN

SEQ ID NO: 11861 - protein, 9 aa, Artificial Sequence
  source: /note="Description of Artificial Sequence: Synthetic peptide"
TPGSSSQTV

SEQ ID NO: 11862 - protein, 9 aa, Artificial Sequence
  source: /note="Description of Artificial Sequence: Synthetic peptide"
PPSLMTSTF

SEQ ID NO: 11863 - protein, 10 aa, Artificial Sequence
  source: /note="Description of Artificial Sequence: Synthetic peptide"
LLLTILLRGA

SEQ ID NO: 11864 - protein, 10 aa, Artificial Sequence
  source: /note="Description of Artificial Sequence: Synthetic peptide"
TVARHQLFVV

SEQ ID NO: 11865 - protein, 10 aa, Artificial Sequence
  source: /note="Description of Artificial Sequence: Synthetic peptide"
KMLHHCQPNL

SEQ ID NO: 11866 - protein, 10 aa, Artificial Sequence
  source: /note="Description of Artificial Sequence: Synthetic peptide"
MLHHCQPNLL

SEQ ID NO: 11867 - protein, 10 aa, Artificial Sequence
  source: /note="Description of Artificial Sequence: Synthetic peptide"
SLMTSTFTSS

SEQ ID NO: 11868 - protein, 10 aa, Artificial Sequence
  source: /note="Description of Artificial Sequence: Synthetic peptide"
HLQARGPAPA

SEQ ID NO: 11869 - protein, 10 aa, Artificial Sequence
  source: /note="Description of Artificial Sequence: Synthetic peptide"
LQARGPAPAL

SEQ ID NO: 11870 - protein, 10 aa, Artificial Sequence
  source: /note="Description of Artificial Sequence: Synthetic peptide"
QLFVVMMKML

SEQ ID NO: 11871 - protein, 10 aa, Artificial Sequence
  source: /note="Description of Artificial Sequence: Synthetic peptide"
TSTFTSSHFK

SEQ ID NO: 11872 - protein, 10 aa, Artificial Sequence
  source: /note="Description of Artificial Sequence: Synthetic peptide"
TFTSSHFKWI

SEQ ID NO: 11873 - protein, 10 aa, Artificial Sequence
  source: /note="Description of Artificial Sequence: Synthetic peptide"
HFKWILLLTI

SEQ ID NO: 11874 - protein, 10 aa, Artificial Sequence
  source: /note="Description of Artificial Sequence: Synthetic peptide"
KWILLLTILL

SEQ ID NO: 11875 - protein, 10 aa, Artificial Sequence
  source: /note="Description of Artificial Sequence: Synthetic peptide"
SQTVARHQLF

SEQ ID NO: 11876 - protein, 10 aa, Artificial Sequence
  source: /note="Description of Artificial Sequence: Synthetic peptide"
SSHFKWILLL

SEQ ID NO: 11877 - protein, 10 aa, Artificial Sequence
  source: /note="Description of Artificial Sequence: Synthetic peptide"
GARPVCHLQA

SEQ ID NO: 11878 - protein, 10 aa, Artificial Sequence
  source: /note="Description of Artificial Sequence: Synthetic peptide"
VARHQLFVVM

SEQ ID NO: 11879 - protein, 10 aa, Artificial Sequence
  source: /note="Description of Artificial Sequence: Synthetic peptide"
RHQLFVVMMK

SEQ ID NO: 11880 - protein, 10 aa, Artificial Sequence
  source: /note="Description of Artificial Sequence: Synthetic peptide"
MTSTFTSSHF

SEQ ID NO: 11881 - protein, 10 aa, Artificial Sequence
  source: /note="Description of Artificial Sequence: Synthetic peptide"
WILLLTILLR

SEQ ID NO: 11882 - protein, 10 aa, Artificial Sequence
  source: /note="Description of Artificial Sequence: Synthetic peptide"
LLTILLRGAR

SEQ ID NO: 11883 - protein, 10 aa, Artificial Sequence
  source: /note="Description of Artificial Sequence: Synthetic peptide"
FTSSHFKWIL

SEQ ID NO: 11884 - protein, 10 aa, Artificial Sequence
  source: /note="Description of Artificial Sequence: Synthetic peptide"
STPGSSSQTV

SEQ ID NO: 11885 - protein, 10 aa, Artificial Sequence
  source: /note="Description of Artificial Sequence: Synthetic peptide"
QTVARHQLFV

SEQ ID NO: 11886 - protein, 10 aa, Artificial Sequence
  source: /note="Description of Artificial Sequence: Synthetic peptide"
GPAPALPSQF

SEQ ID NO: 11887 - protein, 10 aa, Artificial Sequence
  source: /note="Description of Artificial Sequence: Synthetic peptide"
LMTSTFTSSH

SEQ ID NO: 11888 - protein, 10 aa, Artificial Sequence
  source: /note="Description of Artificial Sequence: Synthetic peptide"
HQLFVVMMKM

SEQ ID NO: 11889 - protein, 10 aa, Artificial Sequence
  source: /note="Description of Artificial Sequence: Synthetic peptide"
CGIMDPPSLM

SEQ ID NO: 11890 - protein, 10 aa, Artificial Sequence
  source: /note="Description of Artificial Sequence: Synthetic peptide"
STFTSSHFKW

SEQ ID NO: 11891 - protein, 10 aa, Artificial Sequence
  source: /note="Description of Artificial Sequence: Synthetic peptide"
FKWILLLTIL

SEQ ID NO: 11892 - protein, 10 aa, Artificial Sequence
  source: /note="Description of Artificial Sequence: Synthetic peptide"
SQFSSTPGSS

SEQ ID NO: 11893 - protein, 10 aa, Artificial Sequence
  source: /note="Description of Artificial Sequence: Synthetic peptide"
ARHQLFVVMM

SEQ ID NO: 11894 - protein, 10 aa, Artificial Sequence
  source: /note="Description of Artificial Sequence: Synthetic peptide"
MKMLHHCQPN

SEQ ID NO: 11895 - protein, 10 aa, Artificial Sequence
  source: /note="Description of Artificial Sequence: Synthetic peptide"
HHCQPNLLIF

SEQ ID NO: 11896 - protein, 10 aa, Artificial Sequence
  source: /note="Description of Artificial Sequence: Synthetic peptide"
LPSQFSSTPG

SEQ ID NO: 11897 - protein, 9 aa, Artificial Sequence
  source: /note="Description of Artificial Sequence: Synthetic peptide"
LGKEEHLGK

SEQ ID NO: 11898 - protein, 9 aa, Artificial Sequence
  source: /note="Description of Artificial Sequence: Synthetic peptide"
EEHLGKEGY

SEQ ID NO: 11899 - protein, 10 aa, Artificial Sequence
  source: /note="Description of Artificial Sequence: Synthetic peptide"
HLGKEGYLEK

SEQ ID NO: 11900 - protein, 10 aa, Artificial Sequence
  source: /note="Description of Artificial Sequence: Synthetic peptide"
KEEHLGKEGY

SEQ ID NO: 11901 - protein, 10 aa, Artificial Sequence
  source: /note="Description of Artificial Sequence: Synthetic peptide"
EEHLGKEGYL

SEQ ID NO: 11902 - protein, 9 aa, Artificial Sequence
  source: /note="Description of Artificial Sequence: Synthetic peptide"
EEHLGKEGY

SEQ ID NO: 11903 - protein, 10 aa, Artificial Sequence
  source: /note="Description of Artificial Sequence: Synthetic peptide"
HLGKEGYLEK

SEQ ID NO: 11904 - protein, 10 aa, Artificial Sequence
  source: /note="Description of Artificial Sequence: Synthetic peptide"
EEEHLGKEGY

SEQ ID NO: 11905 - protein, 10 aa, Artificial Sequence
  source: /note="Description of Artificial Sequence: Synthetic peptide"
EEHLEEEEHL

SEQ ID NO: 11906 - protein, 10 aa, Artificial Sequence
  source: /note="Description of Artificial Sequence: Synthetic peptide"
EEHLGKEGYL

SEQ ID NO: 11907 - protein, 9 aa, Artificial Sequence
  source: /note="Description of Artificial Sequence: Synthetic peptide"
GISLISFGI

SEQ ID NO: 11908 - protein, 9 aa, Artificial Sequence
  source: /note="Description of Artificial Sequence: Synthetic peptide"
LISFGIFYM

SEQ ID NO: 11909 - protein, 9 aa, Artificial Sequence
  source: /note="Description of Artificial Sequence: Synthetic peptide"
ISFGIFYMV

SEQ ID NO: 11910 - protein, 9 aa, Artificial Sequence
  source: /note="Description of Artificial Sequence: Synthetic peptide"
SLISFGIFY

SEQ ID NO: 11911 - protein, 9 aa, Artificial Sequence
  source: /note="Description of Artificial Sequence: Synthetic peptide"
ISLISFGIF

SEQ ID NO: 11912 - protein, 9 aa, Artificial Sequence
  source: /note="Description of Artificial Sequence: Synthetic peptide"
SFGIFYMVV

SEQ ID NO: 11913 - protein, 9 aa, Artificial Sequence
  source: /note="Description of Artificial Sequence: Synthetic peptide"
HIGISLISF

SEQ ID NO: 11914 - protein, 10 aa, Artificial Sequence
  source: /note="Description of Artificial Sequence: Synthetic peptide"
ISLISFGIFY

SEQ ID NO: 11915 - protein, 10 aa, Artificial Sequence
  source: /note="Description of Artificial Sequence: Synthetic peptide"
SLISFGIFYM

SEQ ID NO: 11916 - protein, 10 aa, Artificial Sequence
  source: /note="Description of Artificial Sequence: Synthetic peptide"
LISFGIFYMV

SEQ ID NO: 11917 - protein, 10 aa, Artificial Sequence
  source: /note="Description of Artificial Sequence: Synthetic peptide"
ISFGIFYMVV

SEQ ID NO: 11918 - protein, 10 aa, Artificial Sequence
  source: /note="Description of Artificial Sequence: Synthetic peptide"
LHIGISLISF

SEQ ID NO: 11919 - protein, 10 aa, Artificial Sequence
  source: /note="Description of Artificial Sequence: Synthetic peptide"
GISLISFGIF

SEQ ID NO: 11920 - protein, 9 aa, Artificial Sequence
  source: /note="Description of Artificial Sequence: Synthetic peptide"
RYPSFPLRL

SEQ ID NO: 11921 - protein, 9 aa, Artificial Sequence
  source: /note="Description of Artificial Sequence: Synthetic peptide"
SFPLRLVPL

SEQ ID NO: 11922 - protein, 9 aa, Artificial Sequence
  source: /note="Description of Artificial Sequence: Synthetic peptide"
STRYPSFPL

SEQ ID NO: 11923 - protein, 9 aa, Artificial Sequence
  source: /note="Description of Artificial Sequence: Synthetic peptide"
RHPPGSTRY

SEQ ID NO: 11924 - protein, 9 aa, Artificial Sequence
  source: /note="Description of Artificial Sequence: Synthetic peptide"
MGYSPAGGR

SEQ ID NO: 11925 - protein, 9 aa, Artificial Sequence
  source: /note="Description of Artificial Sequence: Synthetic peptide"
YPSFPLRLV

SEQ ID NO: 11926 - protein, 9 aa, Artificial Sequence
  source: /note="Description of Artificial Sequence: Synthetic peptide"
SPAGGRHPP

SEQ ID NO: 11927 - protein, 9 aa, Artificial Sequence
  source: /note="Description of Artificial Sequence: Synthetic peptide"
RLVPLSLIG

SEQ ID NO: 11928 - protein, 9 aa, Artificial Sequence
  source: /note="Description of Artificial Sequence: Synthetic peptide"
FPLRLVPLS

SEQ ID NO: 11929 - protein, 10 aa, Artificial Sequence
  source: /note="Description of Artificial Sequence: Synthetic peptide"
STRYPSFPLR

SEQ ID NO: 11930 - protein, 10 aa, Artificial Sequence
  source: /note="Description of Artificial Sequence: Synthetic peptide"
RYPSFPLRLV

SEQ ID NO: 11931 - protein, 10 aa, Artificial Sequence
  source: /note="Description of Artificial Sequence: Synthetic peptide"
GGRHPPGSTR

SEQ ID NO: 11932 - protein, 10 aa, Artificial Sequence
  source: /note="Description of Artificial Sequence: Synthetic peptide"
LMGYSPAGGR

SEQ ID NO: 11933 - protein, 10 aa, Artificial Sequence
  source: /note="Description of Artificial Sequence: Synthetic peptide"
SPAGGRHPPG

SEQ ID NO: 11934 - protein, 10 aa, Artificial Sequence
  source: /note="Description of Artificial Sequence: Synthetic peptide"
FPLRLVPLSL

SEQ ID NO: 11935 - protein, 10 aa, Artificial Sequence
  source: /note="Description of Artificial Sequence: Synthetic peptide"
MGYSPAGGRH

SEQ ID NO: 11936 - protein, 10 aa, Artificial Sequence
  source: /note="Description of Artificial Sequence: Synthetic peptide"
GRHPPGSTRY

SEQ ID NO: 11937 - protein, 10 aa, Artificial Sequence
  source: /note="Description of Artificial Sequence: Synthetic peptide"
GSTRYPSFPL

SEQ ID NO: 11938 - protein, 10 aa, Artificial Sequence
  source: /note="Description of Artificial Sequence: Synthetic peptide"
TRYPSFPLRL

SEQ ID NO: 11939 - protein, 9 aa, Artificial Sequence
  source: /note="Description of Artificial Sequence: Synthetic peptide"
RSSSAESPA

SEQ ID NO: 11940 - protein, 9 aa, Artificial Sequence
  source: /note="Description of Artificial Sequence: Synthetic peptide"
AESPAVAGT

SEQ ID NO: 11941 - protein, 10 aa, Artificial Sequence
  source: /note="Description of Artificial Sequence: Synthetic peptide"
RSSSAESPAV

SEQ ID NO: 11942 - protein, 9 aa, Artificial Sequence
  source: /note="Description of Artificial Sequence: Synthetic peptide"
ASEPRFEHK

SEQ ID NO: 11943 - protein, 9 aa, Artificial Sequence
  source: /note="Description of Artificial Sequence: Synthetic peptide"
KSRSAQAAS

SEQ ID NO: 11944 - protein, 9 aa, Artificial Sequence
  source: /note="Description of Artificial Sequence: Synthetic peptide"
SAQAASEPR

SEQ ID NO: 11945 - protein, 9 aa, Artificial Sequence
  source: /note="Description of Artificial Sequence: Synthetic peptide"
AQAASEPRF

SEQ ID NO: 11946 - protein, 9 aa, Artificial Sequence
  source: /note="Description of Artificial Sequence: Synthetic peptide"
SEPRFEHKV

SEQ ID NO: 11947 - protein, 10 aa, Artificial Sequence
  source: /note="Description of Artificial Sequence: Synthetic peptide"
RSAQAASEPR

SEQ ID NO: 11948 - protein, 10 aa, Artificial Sequence
  source: /note="Description of Artificial Sequence: Synthetic peptide"
AASEPRFEHK

SEQ ID NO: 11949 - protein, 10 aa, Artificial Sequence
  source: /note="Description of Artificial Sequence: Synthetic peptide"
KSRSAQAASE

SEQ ID NO: 11950 - protein, 10 aa, Artificial Sequence
  source: /note="Description of Artificial Sequence: Synthetic peptide"
SAQAASEPRF

SEQ ID NO: 11951 - protein, 9 aa, Artificial Sequence
  source: /note="Description of Artificial Sequence: Synthetic peptide"
VQEATSLWK

SEQ ID NO: 11952 - protein, 9 aa, Artificial Sequence
  source: /note="Description of Artificial Sequence: Synthetic peptide"
EATSLWKPI

SEQ ID NO: 11953 - protein, 9 aa, Artificial Sequence
  source: /note="Description of Artificial Sequence: Synthetic peptide"
SPSPSCQQV

SEQ ID NO: 11954 - protein, 9 aa, Artificial Sequence
  source: /note="Description of Artificial Sequence: Synthetic peptide"
QQVQEATSL

SEQ ID NO: 11955 - protein, 10 aa, Artificial Sequence
  source: /note="Description of Artificial Sequence: Synthetic peptide"
QVQEATSLWK

SEQ ID NO: 11956 - protein, 10 aa, Artificial Sequence
  source: /note="Description of Artificial Sequence: Synthetic peptide"
CQQVQEATSL

SEQ ID NO: 11957 - protein, 10 aa, Artificial Sequence
  source: /note="Description of Artificial Sequence: Synthetic peptide"
QQVQEATSLW

SEQ ID NO: 11958 - protein, 10 aa, Artificial Sequence
  source: /note="Description of Artificial Sequence: Synthetic peptide"
QEATSLWKPI

SEQ ID NO: 11959 - protein, 9 aa, Artificial Sequence
  source: /note="Description of Artificial Sequence: Synthetic peptide"
LSPSPPASK

SEQ ID NO: 11960 - protein, 9 aa, Artificial Sequence
  source: /note="Description of Artificial Sequence: Synthetic peptide"
RGLSPSPPA

SEQ ID NO: 11961 - protein, 10 aa, Artificial Sequence
  source: /note="Description of Artificial Sequence: Synthetic peptide"
GLSPSPPASK

SEQ ID NO: 11962 - protein, 9 aa, Artificial Sequence
  source: /note="Description of Artificial Sequence: Synthetic peptide"
VQRGPLKLK

SEQ ID NO: 11963 - protein, 9 aa, Artificial Sequence
  source: /note="Description of Artificial Sequence: Synthetic peptide"
YEQVQRGPL

SEQ ID NO: 11964 - protein, 10 aa, Artificial Sequence
  source: /note="Description of Artificial Sequence: Synthetic peptide"
QVQRGPLKLK

SEQ ID NO: 11965 - protein, 10 aa, Artificial Sequence
  source: /note="Description of Artificial Sequence: Synthetic peptide"
EQVQRGPLKL

SEQ ID NO: 11966 - protein, 9 aa, Artificial Sequence
  source: /note="Description of Artificial Sequence: Synthetic peptide"
AIYQKVCHR

SEQ ID NO: 11967 - protein, 9 aa, Artificial Sequence
  source: /note="Description of Artificial Sequence: Synthetic peptide"
IYQKVCHRM

SEQ ID NO: 11968 - protein, 10 aa, Artificial Sequence
  source: /note="Description of Artificial Sequence: Synthetic peptide"
AIYQKVCHRM

SEQ ID NO: 11969 - protein, 10 aa, Artificial Sequence
  source: /note="Description of Artificial Sequence: Synthetic peptide"
CHRMNDDWAY

SEQ ID NO: 11970 - protein, 10 aa, Artificial Sequence
  source: /note="Description of Artificial Sequence: Synthetic peptide"
SAIYQKVCHR

SEQ ID NO: 11971 - protein, 9 aa, Artificial Sequence
  source: /note="Description of Artificial Sequence: Synthetic peptide"
LLARAYPTW

SEQ ID NO: 11972 - protein, 9 aa, Artificial Sequence
  source: /note="Description of Artificial Sequence: Synthetic peptide"
LARAYPTWL

SEQ ID NO: 11973 - protein, 9 aa, Artificial Sequence
  source: /note="Description of Artificial Sequence: Synthetic peptide"
RAYPTWLPC

SEQ ID NO: 11974 - protein, 9 aa, Artificial Sequence
  source: /note="Description of Artificial Sequence: Synthetic peptide"
VQPLLARAY

SEQ ID NO: 11975 - protein, 10 aa, Artificial Sequence
  source: /note="Description of Artificial Sequence: Synthetic peptide"
LLARAYPTWL

SEQ ID NO: 11976 - protein, 10 aa, Artificial Sequence
  source: /note="Description of Artificial Sequence: Synthetic peptide"
PVQPLLARAY

SEQ ID NO: 11977 - protein, 9 aa, Artificial Sequence
  source: /note="Description of Artificial Sequence: Synthetic peptide"
KTRRWSSLH

SEQ ID NO: 11978 - protein, 10 aa, Artificial Sequence
  source: /note="Description of Artificial Sequence: Synthetic peptide"
WSSLHAEPSK

SEQ ID NO: 11979 - protein, 10 aa, Artificial Sequence
  source: /note="Description of Artificial Sequence: Synthetic peptide"
KTRRWSSLHA

SEQ ID NO: 11980 - protein, 10 aa, Artificial Sequence
  source: /note="Description of Artificial Sequence: Synthetic peptide"
PPKTRRWSSL

SEQ ID NO: 11981 - protein, 10 aa, Artificial Sequence
  source: /note="Description of Artificial Sequence: Synthetic peptide"
RLAPPKTRRW

SEQ ID NO: 11982 - protein, 9 aa, Artificial Sequence
  source: /note="Description of Artificial Sequence: Synthetic peptide"
NSYTAQLVK

SEQ ID NO: 11983 - protein, 9 aa, Artificial Sequence
  source: /note="Description of Artificial Sequence: Synthetic peptide"
YTAQLVKMK

SEQ ID NO: 11984 - protein, 9 aa, Artificial Sequence
  source: /note="Description of Artificial Sequence: Synthetic peptide"
SYTAQLVKM

SEQ ID NO: 11985 - protein, 10 aa, Artificial Sequence
  source: /note="Description of Artificial Sequence: Synthetic peptide"
YTAQLVKMKY

SEQ ID NO: 11986 - protein, 10 aa, Artificial Sequence
  source: /note="Description of Artificial Sequence: Synthetic peptide"
SNSYTAQLVK

SEQ ID NO: 11987 - protein, 10 aa, Artificial Sequence
  source: /note="Description of Artificial Sequence: Synthetic peptide"
LVKMKYGAWY

SEQ ID NO: 11988 - protein, 10 aa, Artificial Sequence
  source: /note="Description of Artificial Sequence: Synthetic peptide"
TPSNSYTAQL

SEQ ID NO: 11989 - protein, 10 aa, Artificial Sequence
  source: /note="Description of Artificial Sequence: Synthetic peptide"
NSYTAQLVKM

SEQ ID NO: 11990 - protein, 10 aa, Artificial Sequence
  source: /note="Description of Artificial Sequence: Synthetic peptide"
QLVKMKYGAW

SEQ ID NO: 11991 - protein, 9 aa, Artificial Sequence
  source: /note="Description of Artificial Sequence: Synthetic peptide"
KLRSDEPFI

SEQ ID NO: 11992 - protein, 9 aa, Artificial Sequence
  source: /note="Description of Artificial Sequence: Synthetic peptide"
KKLRSDEPF

SEQ ID NO: 11993 - protein, 9 aa, Artificial Sequence
  source: /note="Description of Artificial Sequence: Synthetic peptide"
EPFIDPKPV

SEQ ID NO: 11994 - protein, 10 aa, Artificial Sequence
  source: /note="Description of Artificial Sequence: Synthetic peptide"
RSDEPFIDPK

SEQ ID NO: 11995 - protein, 10 aa, Artificial Sequence
  source: /note="Description of Artificial Sequence: Synthetic peptide"
FIDPKPVLEK

SEQ ID NO: 11996 - protein, 10 aa, Artificial Sequence
  source: /note="Description of Artificial Sequence: Synthetic peptide"
EPFIDPKPVL

SEQ ID NO: 11997 - protein, 10 aa, Artificial Sequence
  source: /note="Description of Artificial Sequence: Synthetic peptide"
GKKLRSDEPF

SEQ ID NO: 11998 - protein, 10 aa, Artificial Sequence
  source: /note="Description of Artificial Sequence: Synthetic peptide"
KKLRSDEPFI

SEQ ID NO: 11999 - protein, 9 aa, Artificial Sequence
  source: /note="Description of Artificial Sequence: Synthetic peptide"
CARCEAREK

SEQ ID NO: 12000 - protein, 9 aa, Artificial Sequence
  source: /note="Description of Artificial Sequence: Synthetic peptide"
DACARCEAR

SEQ ID NO: 12001 - protein, 10 aa, Artificial Sequence
  source: /note="Description of Artificial Sequence: Synthetic peptide"
LEDACARCEA

SEQ ID NO: 12002 - protein, 9 aa, Artificial Sequence
  source: /note="Description of Artificial Sequence: Synthetic peptide"
KTRVSPLRP

SEQ ID NO: 12003 - protein, 9 aa, Artificial Sequence
  source: /note="Description of Artificial Sequence: Synthetic peptide"
RVSPLRPET

SEQ ID NO: 12004 - protein, 9 aa, Artificial Sequence
  source: /note="Description of Artificial Sequence: Synthetic peptide"
PPKTRVSPL

SEQ ID NO: 12005 - protein, 10 aa, Artificial Sequence
  source: /note="Description of Artificial Sequence: Synthetic peptide"
KTRVSPLRPE

SEQ ID NO: 12006 - protein, 10 aa, Artificial Sequence
  source: /note="Description of Artificial Sequence: Synthetic peptide"
EPPKTRVSPL

SEQ ID NO: 12007 - protein, 9 aa, Artificial Sequence
  source: /note="Description of Artificial Sequence: Synthetic peptide"
FSAAAAVAA

SEQ ID NO: 12008 - protein, 9 aa, Artificial Sequence
  source: /note="Description of Artificial Sequence: Synthetic peptide"
SAAAAVAAA

SEQ ID NO: 12009 - protein, 9 aa, Artificial Sequence
  source: /note="Description of Artificial Sequence: Synthetic peptide"
RPFSAAAAV

SEQ ID NO: 12010 - protein, 10 aa, Artificial Sequence
  source: /note="Description of Artificial Sequence: Synthetic peptide"
FSAAAAVAAA

SEQ ID NO: 12011 - protein, 10 aa, Artificial Sequence
  source: /note="Description of Artificial Sequence: Synthetic peptide"
SAAAAVAAAA

SEQ ID NO: 12012 - protein, 10 aa, Artificial Sequence
  source: /note="Description of Artificial Sequence: Synthetic peptide"
RPFSAAAAVA

SEQ ID NO: 12013 - protein, 10 aa, Artificial Sequence
  source: /note="Description of Artificial Sequence: Synthetic peptide"
AAAPAPAPAL

SEQ ID NO: 12014 - protein, 10 aa, Artificial Sequence
  source: /note="Description of Artificial Sequence: Synthetic peptide"
APAPAPALAA

SEQ ID NO: 12015 - protein, 9 aa, Artificial Sequence
  source: /note="Description of Artificial Sequence: Synthetic peptide"
KNKRIFPAS

SEQ ID NO: 12016 - protein, 9 aa, Artificial Sequence
  source: /note="Description of Artificial Sequence: Synthetic peptide"
KRIFPASRW

SEQ ID NO: 12017 - protein, 10 aa, Artificial Sequence
  source: /note="Description of Artificial Sequence: Synthetic peptide"
SWYEKNKRIF

SEQ ID NO: 12018 - protein, 10 aa, Artificial Sequence
  source: /note="Description of Artificial Sequence: Synthetic peptide"
KNKRIFPASR

SEQ ID NO: 12019 - protein, 10 aa, Artificial Sequence
  source: /note="Description of Artificial Sequence: Synthetic peptide"
YEKNKRIFPA

SEQ ID NO: 12020 - protein, 10 aa, Artificial Sequence
  source: /note="Description of Artificial Sequence: Synthetic peptide"
NKRIFPASRW

SEQ ID NO: 12021 - protein, 9 aa, Artificial Sequence
  source: /note="Description of Artificial Sequence: Synthetic peptide"
ILDTFDPYL

SEQ ID NO: 12022 - protein, 9 aa, Artificial Sequence
  source: /note="Description of Artificial Sequence: Synthetic peptide"
TILDTFDPY

SEQ ID NO: 12023 - protein, 9 aa, Artificial Sequence
  source: /note="Description of Artificial Sequence: Synthetic peptide"
DTFDPYLIA

SEQ ID NO: 12024 - protein, 10 aa, Artificial Sequence
  source: /note="Description of Artificial Sequence: Synthetic peptide"
ETILDTFDPY

SEQ ID NO: 12025 - protein, 10 aa, Artificial Sequence
  source: /note="Description of Artificial Sequence: Synthetic peptide"
TILDTFDPYL

SEQ ID NO: 12026 - protein, 10 aa, Artificial Sequence
  source: /note="Description of Artificial Sequence: Synthetic peptide"
ILDTFDPYLI

SEQ ID NO: 12027 - protein, 10 aa, Artificial Sequence
  source: /note="Description of Artificial Sequence: Synthetic peptide"
FFCETILDTF

SEQ ID NO: 12028 - protein, 10 aa, Artificial Sequence
  source: /note="Description of Artificial Sequence: Synthetic peptide"
DTFDPYLIAM

SEQ ID NO: 12029 - protein, 9 aa, Artificial Sequence
  source: /note="Description of Artificial Sequence: Synthetic peptide"
CQPRFRLPK

SEQ ID NO: 12030 - protein, 9 aa, Artificial Sequence
  source: /note="Description of Artificial Sequence: Synthetic peptide"
RCHCQPRFR

SEQ ID NO: 12031 - protein, 9 aa, Artificial Sequence
  source: /note="Description of Artificial Sequence: Synthetic peptide"
KRCHCQPRF

SEQ ID NO: 12032 - protein, 10 aa, Artificial Sequence
  source: /note="Description of Artificial Sequence: Synthetic peptide"
RCHCQPRFRL

SEQ ID NO: 12033 - protein, 10 aa, Artificial Sequence
  source: /note="Description of Artificial Sequence: Synthetic peptide"
HCQPRFRLPK

SEQ ID NO: 12034 - protein, 10 aa, Artificial Sequence
  source: /note="Description of Artificial Sequence: Synthetic peptide"
CKRCHCQPRF

SEQ ID NO: 12035 - protein, 9 aa, Artificial Sequence
  source: /note="Description of Artificial Sequence: Synthetic peptide"
GSFSEETHW

SEQ ID NO: 12036 - protein, 9 aa, Artificial Sequence
  source: /note="Description of Artificial Sequence: Synthetic peptide"
GTRCGTCNT

SEQ ID NO: 12037 - protein, 10 aa, Artificial Sequence
  source: /note="Description of Artificial Sequence: Synthetic peptide"
GTRCGTCNTG

SEQ ID NO: 12038 - protein, 10 aa, Artificial Sequence
  source: /note="Description of Artificial Sequence: Synthetic peptide"
LTCAPDNGTR

SEQ ID NO: 12039 - protein, 9 aa, Artificial Sequence
  source: /note="Description of Artificial Sequence: Synthetic peptide"
LLDPAEGLL

SEQ ID NO: 12040 - protein, 9 aa, Artificial Sequence
  source: /note="Description of Artificial Sequence: Synthetic peptide"
LLRRKKTSL

SEQ ID NO: 12041 - protein, 10 aa, Artificial Sequence
  source: /note="Description of Artificial Sequence: Synthetic peptide"
GLLDPAEGLL

SEQ ID NO: 12042 - protein, 10 aa, Artificial Sequence
  source: /note="Description of Artificial Sequence: Synthetic peptide"
GLLRRKKTSL

SEQ ID NO: 12043 - protein, 10 aa, Artificial Sequence
  source: /note="Description of Artificial Sequence: Synthetic peptide"
LLRRKKTSLW

SEQ ID NO: 12044 - protein, 10 aa, Artificial Sequence
  source: /note="Description of Artificial Sequence: Synthetic peptide"
LRRKKTSLWF

SEQ ID NO: 12045 - protein, 9 aa, Artificial Sequence
  source: /note="Description of Artificial Sequence: Synthetic peptide"
LQPCSRFTV

SEQ ID NO: 12046 - protein, 9 aa, Artificial Sequence
  source: /note="Description of Artificial Sequence: Synthetic peptide"
FTVAPSSAL

SEQ ID NO: 12047 - protein, 9 aa, Artificial Sequence
  source: /note="Description of Artificial Sequence: Synthetic peptide"
TVAPSSALA

SEQ ID NO: 12048 - protein, 9 aa, Artificial Sequence
  source: /note="Description of Artificial Sequence: Synthetic peptide"
CSRFTVAPS

SEQ ID NO: 12049 - protein, 9 aa, Artificial Sequence
  source: /note="Description of Artificial Sequence: Synthetic peptide"
RFTVAPSSA

SEQ ID NO: 12050 - protein, 9 aa, Artificial Sequence
  source: /note="Description of Artificial Sequence: Synthetic peptide"
QPCSRFTVA

SEQ ID NO: 12051 - protein, 10 aa, Artificial Sequence
  source: /note="Description of Artificial Sequence: Synthetic peptide"
FTVAPSSALA

SEQ ID NO: 12052 - protein, 10 aa, Artificial Sequence
  source: /note="Description of Artificial Sequence: Synthetic peptide"
CSRFTVAPSS

SEQ ID NO: 12053 - protein, 10 aa, Artificial Sequence
  source: /note="Description of Artificial Sequence: Synthetic peptide"
LQPCSRFTVA

SEQ ID NO: 12054 - protein, 10 aa, Artificial Sequence
  source: /note="Description of Artificial Sequence: Synthetic peptide"
SRFTVAPSSA

SEQ ID NO: 12055 - protein, 10 aa, Artificial Sequence
  source: /note="Description of Artificial Sequence: Synthetic peptide"
RFTVAPSSAL

SEQ ID NO: 12056 - protein, 10 aa, Artificial Sequence
  source: /note="Description of Artificial Sequence: Synthetic peptide"
PSRKSSDHRK

SEQ ID NO: 12057 - protein, 9 aa, Artificial Sequence
  source: /note="Description of Artificial Sequence: Synthetic peptide"
EKAQGGQEM

SEQ ID NO: 12058 - protein, 9 aa, Artificial Sequence
  source: /note="Description of Artificial Sequence: Synthetic peptide"
AQGGQEMEM

SEQ ID NO: 12059 - protein, 9 aa, Artificial Sequence
  source: /note="Description of Artificial Sequence: Synthetic peptide"
QEMEMISGT

SEQ ID NO: 12060 - protein, 9 aa, Artificial Sequence
  source: /note="Description of Artificial Sequence: Synthetic peptide"
EMEMISGTM

SEQ ID NO: 12061 - protein, 9 aa, Artificial Sequence
  source: /note="Description of Artificial Sequence: Synthetic peptide"
MEMISGTMT

SEQ ID NO: 12062 - protein, 10 aa, Artificial Sequence
  source: /note="Description of Artificial Sequence: Synthetic peptide"
QEMEMISGTM

SEQ ID NO: 12063 - protein, 10 aa, Artificial Sequence
  source: /note="Description of Artificial Sequence: Synthetic peptide"
VEKAQGGQEM

SEQ ID NO: 12064 - protein, 10 aa, Artificial Sequence
  source: /note="Description of Artificial Sequence: Synthetic peptide"
KAQGGQEMEM

SEQ ID NO: 12065 - protein, 10 aa, Artificial Sequence
  source: /note="Description of Artificial Sequence: Synthetic peptide"
MEMISGTMTS

SEQ ID NO: 12066 - protein, 9 aa, Artificial Sequence
  source: /note="Description of Artificial Sequence: Synthetic peptide"
RPAVPVLEL

SEQ ID NO: 12067 - protein, 9 aa, Artificial Sequence
  source: /note="Description of Artificial Sequence: Synthetic peptide"
VGRPAVPVL

SEQ ID NO: 12068 - protein, 9 aa, Artificial Sequence
  source: /note="Description of Artificial Sequence: Synthetic peptide"
LSYFHCDDL

SEQ ID NO: 12069 - protein, 10 aa, Artificial Sequence
  source: /note="Description of Artificial Sequence: Synthetic peptide"
YLSYFHCDDL

SEQ ID NO: 12070 - protein, 9 aa, Artificial Sequence
  source: /note="Description of Artificial Sequence: Synthetic peptide"
VQQDPLSSH

SEQ ID NO: 12071 - protein, 10 aa, Artificial Sequence
  source: /note="Description of Artificial Sequence: Synthetic peptide"
SSHPPETCQM

SEQ ID NO: 12072 - protein, 9 aa, Artificial Sequence
  source: /note="Description of Artificial Sequence: Synthetic peptide"
HLEDSGISV

SEQ ID NO: 12073 - protein, 9 aa, Artificial Sequence
  source: /note="Description of Artificial Sequence: Synthetic peptide"
SVAQKQEPR

SEQ ID NO: 12074 - protein, 9 aa, Artificial Sequence
  source: /note="Description of Artificial Sequence: Synthetic peptide"
LEDSGISVA

SEQ ID NO: 12075 - protein, 10 aa, Artificial Sequence
  source: /note="Description of Artificial Sequence: Synthetic peptide"
HLEDSGISVA

SEQ ID NO: 12076 - protein, 10 aa, Artificial Sequence
  source: /note="Description of Artificial Sequence: Synthetic peptide"
SVAQKQEPRV

SEQ ID NO: 12077 - protein, 9 aa, Artificial Sequence
  source: /note="Description of Artificial Sequence: Synthetic peptide"
PQQLPSPPF

SEQ ID NO: 12078 - protein, 9 aa, Artificial Sequence
  source: /note="Description of Artificial Sequence: Synthetic peptide"
LPSPPFPPH

SEQ ID NO: 12079 - protein, 10 aa, Artificial Sequence
  source: /note="Description of Artificial Sequence: Synthetic peptide"
LPQQLPSPPF

SEQ ID NO: 12080 - protein, 10 aa, Artificial Sequence
  source: /note="Description of Artificial Sequence: Synthetic peptide"
QQLPSPPFPP

SEQ ID NO: 12081 - protein, 9 aa, Artificial Sequence
  source: /note="Description of Artificial Sequence: Synthetic peptide"
LLVATNTST

SEQ ID NO: 12082 - protein, 9 aa, Artificial Sequence
  source: /note="Description of Artificial Sequence: Synthetic peptide"
YRDQSFTTL

SEQ ID NO: 12083 - protein, 9 aa, Artificial Sequence
  source: /note="Description of Artificial Sequence: Synthetic peptide"
RDQSFTTLL

SEQ ID NO: 12084 - protein, 9 aa, Artificial Sequence
  source: /note="Description of Artificial Sequence: Synthetic peptide"
QSFTTLLVA

SEQ ID NO: 12085 - protein, 10 aa, Artificial Sequence
  source: /note="Description of Artificial Sequence: Synthetic peptide"
IYRDQSFTTL

SEQ ID NO: 12086 - protein, 10 aa, Artificial Sequence
  source: /note="Description of Artificial Sequence: Synthetic peptide"
YRDQSFTTLL

SEQ ID NO: 12087 - protein, 10 aa, Artificial Sequence
  source: /note="Description of Artificial Sequence: Synthetic peptide"
DQSFTTLLVA

SEQ ID NO: 12088 - protein, 9 aa, Artificial Sequence
  source: /note="Description of Artificial Sequence: Synthetic peptide"
VQRLRNIQV

SEQ ID NO: 12089 - protein, 9 aa, Artificial Sequence
  source: /note="Description of Artificial Sequence: Synthetic peptide"
RLRNIQVRT

SEQ ID NO: 12090 - protein, 9 aa, Artificial Sequence
  source: /note="Description of Artificial Sequence: Synthetic peptide"
RNIQVRTVK

SEQ ID NO: 12091 - protein, 10 aa, Artificial Sequence
  source: /note="Description of Artificial Sequence: Synthetic peptide"
RLRNIQVRTV

SEQ ID NO: 12092 - protein, 10 aa, Artificial Sequence
  source: /note="Description of Artificial Sequence: Synthetic peptide"
VQRLRNIQVR

SEQ ID NO: 12093 - protein, 10 aa, Artificial Sequence
  source: /note="Description of Artificial Sequence: Synthetic peptide"
QVRTVKGQDY

SEQ ID NO: 12094 - protein, 9 aa, Artificial Sequence
  source: /note="Description of Artificial Sequence: Synthetic peptide"
LVTWDTALY

SEQ ID NO: 12095 - protein, 9 aa, Artificial Sequence
  source: /note="Description of Artificial Sequence: Synthetic peptide"
GLVTWDTAL

SEQ ID NO: 12096 - protein, 9 aa, Artificial Sequence
  source: /note="Description of Artificial Sequence: Synthetic peptide"
VTWDTALYL

SEQ ID NO: 12097 - protein, 10 aa, Artificial Sequence
  source: /note="Description of Artificial Sequence: Synthetic peptide"
VTWDTALYLA

SEQ ID NO: 12098 - protein, 10 aa, Artificial Sequence
  source: /note="Description of Artificial Sequence: Synthetic peptide"
GLVTWDTALY

SEQ ID NO: 12099 - protein, 10 aa, Artificial Sequence
  source: /note="Description of Artificial Sequence: Synthetic peptide"
LVTWDTALYL

SEQ ID NO: 12100 - protein, 10 aa, Artificial Sequence
  source: /note="Description of Artificial Sequence: Synthetic peptide"
DTALYLAEWA

SEQ ID NO: 12101 - protein, 10 aa, Artificial Sequence
  source: /note="Description of Artificial Sequence: Synthetic peptide"
TALYLAEWAI

SEQ ID NO: 12102 - protein, 9 aa, Artificial Sequence
  source: /note="Description of Artificial Sequence: Synthetic peptide"
MTRNYFPTK

SEQ ID NO: 12103 - protein, 9 aa, Artificial Sequence
  source: /note="Description of Artificial Sequence: Synthetic peptide"
NYFPTKSTW

SEQ ID NO: 12104 - protein, 9 aa, Artificial Sequence
  source: /note="Description of Artificial Sequence: Synthetic peptide"
YFPTKSTWR

SEQ ID NO: 12105 - protein, 9 aa, Artificial Sequence
  source: /note="Description of Artificial Sequence: Synthetic peptide"
NLVMTRNYF

SEQ ID NO: 12106 - protein, 9 aa, Artificial Sequence
  source: /note="Description of Artificial Sequence: Synthetic peptide"
WNLVMTRNY

SEQ ID NO: 12107 - protein, 10 aa, Artificial Sequence
  source: /note="Description of Artificial Sequence: Synthetic peptide"
VMTRNYFPTK

SEQ ID NO: 12108 - protein, 10 aa, Artificial Sequence
  source: /note="Description of Artificial Sequence: Synthetic peptide"
YFPTKSTWRW

SEQ ID NO: 12109 - protein, 10 aa, Artificial Sequence
  source: /note="Description of Artificial Sequence: Synthetic peptide"
MTRNYFPTKS

SEQ ID NO: 12110 - protein, 10 aa, Artificial Sequence
  source: /note="Description of Artificial Sequence: Synthetic peptide"
KWNLVMTRNY

SEQ ID NO: 12111 - protein, 10 aa, Artificial Sequence
  source: /note="Description of Artificial Sequence: Synthetic peptide"
NYFPTKSTWR

SEQ ID NO: 12112 - protein, 10 aa, Artificial Sequence
  source: /note="Description of Artificial Sequence: Synthetic peptide"
LVMTRNYFPT

SEQ ID NO: 12113 - protein, 10 aa, Artificial Sequence
  source: /note="Description of Artificial Sequence: Synthetic peptide"
WNLVMTRNYF

SEQ ID NO: 12114 - protein, 10 aa, Artificial Sequence
  source: /note="Description of Artificial Sequence: Synthetic peptide"
RNYFPTKSTW

SEQ ID NO: 12115 - protein, 9 aa, Artificial Sequence
  source: /note="Description of Artificial Sequence: Synthetic peptide"
QPTELNLEV

SEQ ID NO: 12116 - protein, 10 aa, Artificial Sequence
  source: /note="Description of Artificial Sequence: Synthetic peptide"
SQPTELNLEV

SEQ ID NO: 12117 - protein, 10 aa, Artificial Sequence
  source: /note="Description of Artificial Sequence: Synthetic peptide"
LASQPTELNL

SEQ ID NO: 12118 - protein, 10 aa, Artificial Sequence
  source: /note="Description of Artificial Sequence: Synthetic peptide"
QPTELNLEVL

SEQ ID NO: 12119 - protein, 9 aa, Artificial Sequence
  source: /note="Description of Artificial Sequence: Synthetic peptide"
FLMASLDFC

SEQ ID NO: 12120 - protein, 9 aa, Artificial Sequence
  source: /note="Description of Artificial Sequence: Synthetic peptide"
TLEFLMASL

SEQ ID NO: 12121 - protein, 9 aa, Artificial Sequence
  source: /note="Description of Artificial Sequence: Synthetic peptide"
LMASLDFCK

SEQ ID NO: 12122 - protein, 9 aa, Artificial Sequence
  source: /note="Description of Artificial Sequence: Synthetic peptide"
EFLMASLDF

SEQ ID NO: 12123 - protein, 9 aa, Artificial Sequence
  source: /note="Description of Artificial Sequence: Synthetic peptide"
ASLDFCKSF

SEQ ID NO: 12124 - protein, 10 aa, Artificial Sequence
  source: /note="Description of Artificial Sequence: Synthetic peptide"
FLMASLDFCK

SEQ ID NO: 12125 - protein, 10 aa, Artificial Sequence
  source: /note="Description of Artificial Sequence: Synthetic peptide"
SLDFCKSFWK

SEQ ID NO: 12126 - protein, 10 aa, Artificial Sequence
  source: /note="Description of Artificial Sequence: Synthetic peptide"
DTLEFLMASL

SEQ ID NO: 12127 - protein, 10 aa, Artificial Sequence
  source: /note="Description of Artificial Sequence: Synthetic peptide"
MASLDFCKSF

SEQ ID NO: 12128 - protein, 10 aa, Artificial Sequence
  source: /note="Description of Artificial Sequence: Synthetic peptide"
LEFLMASLDF

SEQ ID NO: 12129 - protein, 10 aa, Artificial Sequence
  source: /note="Description of Artificial Sequence: Synthetic peptide"
ASLDFCKSFW

SEQ ID NO: 12130 - protein, 10 aa, Artificial Sequence
  source: /note="Description of Artificial Sequence: Synthetic peptide"
LDFCKSFWKI

SEQ ID NO: 12131 - protein, 9 aa, Artificial Sequence
  source: /note="Description of Artificial Sequence: Synthetic peptide"
GVNEAKIDK

SEQ ID NO: 12132 - protein, 9 aa, Artificial Sequence
  source: /note="Description of Artificial Sequence: Synthetic peptide"
YLSILLESV

SEQ ID NO: 12133 - protein, 9 aa, Artificial Sequence
  source: /note="Description of Artificial Sequence: Synthetic peptide"
IGYKYASSK

SEQ ID NO: 12134 - protein, 9 aa, Artificial Sequence
  source: /note="Description of Artificial Sequence: Synthetic peptide"
KYASSKSYL

SEQ ID NO: 12135 - protein, 9 aa, Artificial Sequence
  source: /note="Description of Artificial Sequence: Synthetic peptide"
SYLSILLES

SEQ ID NO: 12136 - protein, 9 aa, Artificial Sequence
  source: /note="Description of Artificial Sequence: Synthetic peptide"
CFPRVIGYK

SEQ ID NO: 12137 - protein, 9 aa, Artificial Sequence
  source: /note="Description of Artificial Sequence: Synthetic peptide"
ASSKSYLSI

SEQ ID NO: 12138 - protein, 9 aa, Artificial Sequence
  source: /note="Description of Artificial Sequence: Synthetic peptide"
SSKSYLSIL

SEQ ID NO: 12139 - protein, 9 aa, Artificial Sequence
  source: /note="Description of Artificial Sequence: Synthetic peptide"
YKYASSKSY

SEQ ID NO: 12140 - protein, 9 aa, Artificial Sequence
  source: /note="Description of Artificial Sequence: Synthetic peptide"
SVSISTHQL

SEQ ID NO: 12141 - protein, 9 aa, Artificial Sequence
  source: /note="Description of Artificial Sequence: Synthetic peptide"
TCFPRVIGY

SEQ ID NO: 12142 - protein, 9 aa, Artificial Sequence
  source: /note="Description of Artificial Sequence: Synthetic peptide"
FPRVIGYKY

SEQ ID NO: 12143 - protein, 9 aa, Artificial Sequence
  source: /note="Description of Artificial Sequence: Synthetic peptide"
KKNTCFPRV

SEQ ID NO: 12144 - protein, 9 aa, Artificial Sequence
  source: /note="Description of Artificial Sequence: Synthetic peptide"
SKSYLSILL

SEQ ID NO: 12145 - protein, 9 aa, Artificial Sequence
  source: /note="Description of Artificial Sequence: Synthetic peptide"
LESVSISTH

SEQ ID NO: 12146 - protein, 10 aa, Artificial Sequence
  source: /note="Description of Artificial Sequence: Synthetic peptide"
ILLESVSIST

SEQ ID NO: 12147 - protein, 10 aa, Artificial Sequence
  source: /note="Description of Artificial Sequence: Synthetic peptide"
VIGYKYASSK

SEQ ID NO: 12148 - protein, 10 aa, Artificial Sequence
  source: /note="Description of Artificial Sequence: Synthetic peptide"
TCFPRVIGYK

SEQ ID NO: 12149 - protein, 10 aa, Artificial Sequence
  source: /note="Description of Artificial Sequence: Synthetic peptide"
CFPRVIGYKY

SEQ ID NO: 12150 - protein, 10 aa, Artificial Sequence
  source: /note="Description of Artificial Sequence: Synthetic peptide"
SYLSILLESV

SEQ ID NO: 12151 - protein, 10 aa, Artificial Sequence
  source: /note="Description of Artificial Sequence: Synthetic peptide"
SSKSYLSILL

SEQ ID NO: 12152 - protein, 10 aa, Artificial Sequence
  source: /note="Description of Artificial Sequence: Synthetic peptide"
NTCFPRVIGY

SEQ ID NO: 12153 - protein, 10 aa, Artificial Sequence
  source: /note="Description of Artificial Sequence: Synthetic peptide"
GYKYASSKSY

SEQ ID NO: 12154 - protein, 10 aa, Artificial Sequence
  source: /note="Description of Artificial Sequence: Synthetic peptide"
ESVSISTHQL

SEQ ID NO: 12155 - protein, 10 aa, Artificial Sequence
  source: /note="Description of Artificial Sequence: Synthetic peptide"
FPRVIGYKYA

SEQ ID NO: 12156 - protein, 10 aa, Artificial Sequence
  source: /note="Description of Artificial Sequence: Synthetic peptide"
YASSKSYLSI

SEQ ID NO: 12157 - protein, 10 aa, Artificial Sequence
  source: /note="Description of Artificial Sequence: Synthetic peptide"
MKKNTCFPRV

SEQ ID NO: 12158 - protein, 10 aa, Artificial Sequence
  source: /note="Description of Artificial Sequence: Synthetic peptide"
KKNTCFPRVI

SEQ ID NO: 12159 - protein, 10 aa, Artificial Sequence
  source: /note="Description of Artificial Sequence: Synthetic peptide"
YKYASSKSYL

SEQ ID NO: 12160 - protein, 10 aa, Artificial Sequence
  source: /note="Description of Artificial Sequence: Synthetic peptide"
ASSKSYLSIL

SEQ ID NO: 12161 - protein, 10 aa, Artificial Sequence
  source: /note="Description of Artificial Sequence: Synthetic peptide"
LSILLESVSI

SEQ ID NO: 12162 - protein, 9 aa, Artificial Sequence
  source: /note="Description of Artificial Sequence: Synthetic peptide"
HLQLLGYEV

SEQ ID NO: 12163 - protein, 9 aa, Artificial Sequence
  source: /note="Description of Artificial Sequence: Synthetic peptide"
LQLLGYEVV

SEQ ID NO: 12164 - protein, 9 aa, Artificial Sequence
  source: /note="Description of Artificial Sequence: Synthetic peptide"
LLGYEVVQI

SEQ ID NO: 12165 - protein, 9 aa, Artificial Sequence
  source: /note="Description of Artificial Sequence: Synthetic peptide"
GYEVVQIPY

SEQ ID NO: 12166 - protein, 9 aa, Artificial Sequence
  source: /note="Description of Artificial Sequence: Synthetic peptide"
YEVVQIPYH

SEQ ID NO: 12167 - protein, 10 aa, Artificial Sequence
  source: /note="Description of Artificial Sequence: Synthetic peptide"
HLQLLGYEVV

SEQ ID NO: 12168 - protein, 10 aa, Artificial Sequence
  source: /note="Description of Artificial Sequence: Synthetic peptide"
QLLGYEVVQI

SEQ ID NO: 12169 - protein, 10 aa, Artificial Sequence
  source: /note="Description of Artificial Sequence: Synthetic peptide"
LGYEVVQIPY

SEQ ID NO: 12170 - protein, 10 aa, Artificial Sequence
  source: /note="Description of Artificial Sequence: Synthetic peptide"
EVVQIPYHEI

SEQ ID NO: 12171 - protein, 10 aa, Artificial Sequence
  source: /note="Description of Artificial Sequence: Synthetic peptide"
RHLQLLGYEV

SEQ ID NO: 12172 - protein, 9 aa, Artificial Sequence
  source: /note="Description of Artificial Sequence: Synthetic peptide"
SALESLSEV

SEQ ID NO: 12173 - protein, 9 aa, Artificial Sequence
  source: /note="Description of Artificial Sequence: Synthetic peptide"
KPSQPYSAL

SEQ ID NO: 12174 - protein, 9 aa, Artificial Sequence
  source: /note="Description of Artificial Sequence: Synthetic peptide"
QPYSALESL

SEQ ID NO: 12175 - protein, 10 aa, Artificial Sequence
  source: /note="Description of Artificial Sequence: Synthetic peptide"
YSALESLSEV

SEQ ID NO: 12176 - protein, 10 aa, Artificial Sequence
  source: /note="Description of Artificial Sequence: Synthetic peptide"
SQPYSALESL

SEQ ID NO: 12177 - protein, 10 aa, Artificial Sequence
  source: /note="Description of Artificial Sequence: Synthetic peptide"
LESLSEVQSL

SEQ ID NO: 12178 - protein, 9 aa, Artificial Sequence
  source: /note="Description of Artificial Sequence: Synthetic peptide"
KINATDQDM

SEQ ID NO: 12179 - protein, 10 aa, Artificial Sequence
  source: /note="Description of Artificial Sequence: Synthetic peptide"
KINATDQDMY

SEQ ID NO: 12180 - protein, 10 aa, Artificial Sequence
  source: /note="Description of Artificial Sequence: Synthetic peptide"
NATDQDMYDV

SEQ ID NO: 12181 - protein, 10 aa, Artificial Sequence
  source: /note="Description of Artificial Sequence: Synthetic peptide"
GKINATDQDM

SEQ ID NO: 12182 - protein, 9 aa, Artificial Sequence
  source: /note="Description of Artificial Sequence: Synthetic peptide"
ELIGITVVL

SEQ ID NO: 12183 - protein, 9 aa, Artificial Sequence
  source: /note="Description of Artificial Sequence: Synthetic peptide"
ITVVLFVIF

SEQ ID NO: 12184 - protein, 9 aa, Artificial Sequence
  source: /note="Description of Artificial Sequence: Synthetic peptide"
TVVLFVIFI

SEQ ID NO: 12185 - protein, 9 aa, Artificial Sequence
  source: /note="Description of Artificial Sequence: Synthetic peptide"
KEELIGITV

SEQ ID NO: 12186 - protein, 9 aa, Artificial Sequence
  source: /note="Description of Artificial Sequence: Synthetic peptide"
LIGITVVLF

SEQ ID NO: 12187 - protein, 9 aa, Artificial Sequence
  source: /note="Description of Artificial Sequence: Synthetic peptide"
EELIGITVV

SEQ ID NO: 12188 - protein, 10 aa, Artificial Sequence
  source: /note="Description of Artificial Sequence: Synthetic peptide"
LIGITVVLFV

SEQ ID NO: 12189 - protein, 10 aa, Artificial Sequence
  source: /note="Description of Artificial Sequence: Synthetic peptide"
IGITVVLFVI

SEQ ID NO: 12190 - protein, 10 aa, Artificial Sequence
  source: /note="Description of Artificial Sequence: Synthetic peptide"
ITVVLFVIFI

SEQ ID NO: 12191 - protein, 10 aa, Artificial Sequence
  source: /note="Description of Artificial Sequence: Synthetic peptide"
TVVLFVIFIL

SEQ ID NO: 12192 - protein, 10 aa, Artificial Sequence
  source: /note="Description of Artificial Sequence: Synthetic peptide"
ELIGITVVLF

SEQ ID NO: 12193 - protein, 10 aa, Artificial Sequence
  source: /note="Description of Artificial Sequence: Synthetic peptide"
KEELIGITVV

SEQ ID NO: 12194 - protein, 10 aa, Artificial Sequence
  source: /note="Description of Artificial Sequence: Synthetic peptide"
GITVVLFVIF

SEQ ID NO: 12195 - protein, 10 aa, Artificial Sequence
  source: /note="Description of Artificial Sequence: Synthetic peptide"
EELIGITVVL

SEQ ID NO: 12196 - protein, 10 aa, Artificial Sequence
  source: /note="Description of Artificial Sequence: Synthetic peptide"
KVYQIKLPEH

SEQ ID NO: 12197 - protein, 10 aa, Artificial Sequence
  source: /note="Description of Artificial Sequence: Synthetic peptide"
QIKLPEHDRK

SEQ ID NO: 12198 - protein, 9 aa, Artificial Sequence
  source: /note="Description of Artificial Sequence: Synthetic peptide"
ILLLPTYVV

SEQ ID NO: 12199 - protein, 9 aa, Artificial Sequence
  source: /note="Description of Artificial Sequence: Synthetic peptide"
LLLPTYVVV

SEQ ID NO: 12200 - protein, 9 aa, Artificial Sequence
  source: /note="Description of Artificial Sequence: Synthetic peptide"
YVVVEVLKV

SEQ ID NO: 12201 - protein, 9 aa, Artificial Sequence
  source: /note="Description of Artificial Sequence: Synthetic peptide"
LPTYVVVEV

SEQ ID NO: 12202 - protein, 10 aa, Artificial Sequence
  source: /note="Description of Artificial Sequence: Synthetic peptide"
TILLLPTYVV

SEQ ID NO: 12203 - protein, 10 aa, Artificial Sequence
  source: /note="Description of Artificial Sequence: Synthetic peptide"
ILLLPTYVVV

SEQ ID NO: 12204 - protein, 10 aa, Artificial Sequence
  source: /note="Description of Artificial Sequence: Synthetic peptide"
LLPTYVVVEV

SEQ ID NO: 12205 - protein, 10 aa, Artificial Sequence
  source: /note="Description of Artificial Sequence: Synthetic peptide"
PTYVVVEVLK

SEQ ID NO: 12206 - protein, 10 aa, Artificial Sequence
  source: /note="Description of Artificial Sequence: Synthetic peptide"
TYVVVEVLKV

SEQ ID NO: 12207 - protein, 10 aa, Artificial Sequence
  source: /note="Description of Artificial Sequence: Synthetic peptide"
LPTYVVVEVL

SEQ ID NO: 12208 - protein, 9 aa, Artificial Sequence
  source: /note="Description of Artificial Sequence: Synthetic peptide"
EVAKMPARA

SEQ ID NO: 12209 - protein, 9 aa, Artificial Sequence
  source: /note="Description of Artificial Sequence: Synthetic peptide"
KEEVAKMPA

SEQ ID NO: 12210 - protein, 10 aa, Artificial Sequence
  source: /note="Description of Artificial Sequence: Synthetic peptide"
RSPAKEEVAK

SEQ ID NO: 12211 - protein, 10 aa, Artificial Sequence
  source: /note="Description of Artificial Sequence: Synthetic peptide"
SPAKEEVAKM

SEQ ID NO: 12212 - protein, 10 aa, Artificial Sequence
  source: /note="Description of Artificial Sequence: Synthetic peptide"
EEVAKMPARA

SEQ ID NO: 12213 - protein, 9 aa, Artificial Sequence
  source: /note="Description of Artificial Sequence: Synthetic peptide"
RNTARHKRK

SEQ ID NO: 12214 - protein, 9 aa, Artificial Sequence
  source: /note="Description of Artificial Sequence: Synthetic peptide"
TARHKRKKK

SEQ ID NO: 12215 - protein, 10 aa, Artificial Sequence
  source: /note="Description of Artificial Sequence: Synthetic peptide"
KWRNTARHKR

SEQ ID NO: 12216 - protein, 10 aa, Artificial Sequence
  source: /note="Description of Artificial Sequence: Synthetic peptide"
RNTARHKRKK

SEQ ID NO: 12217 - protein, 10 aa, Artificial Sequence
  source: /note="Description of Artificial Sequence: Synthetic peptide"
RKKKEDELIL

SEQ ID NO: 12218 - protein, 9 aa, Artificial Sequence
  source: /note="Description of Artificial Sequence: Synthetic peptide"
SVWRGGEAK

SEQ ID NO: 12219 - protein, 9 aa, Artificial Sequence
  source: /note="Description of Artificial Sequence: Synthetic peptide"
KSVWRGGEA

SEQ ID NO: 12220 - protein, 10 aa, Artificial Sequence
  source: /note="Description of Artificial Sequence: Synthetic peptide"
KSVWRGGEAK

SEQ ID NO: 12221 - protein, 10 aa, Artificial Sequence
  source: /note="Description of Artificial Sequence: Synthetic peptide"
GEAKLHLRRA

SEQ ID NO: 12222 - protein, 9 aa, Artificial Sequence
  source: /note="Description of Artificial Sequence: Synthetic peptide"
CQDSEGDII

SEQ ID NO: 12223 - protein, 9 aa, Artificial Sequence
  source: /note="Description of Artificial Sequence: Synthetic peptide"
SEGDIIFPA

SEQ ID NO: 12224 - protein, 10 aa, Artificial Sequence
  source: /note="Description of Artificial Sequence: Synthetic peptide"
IIFPAESSCA

SEQ ID NO: 12225 - protein, 10 aa, Artificial Sequence
  source: /note="Description of Artificial Sequence: Synthetic peptide"
CQDSEGDIIF

SEQ ID NO: 12226 - protein, 9 aa, Artificial Sequence
  source: /note="Description of Artificial Sequence: Synthetic peptide"
IFLRMNWCV

SEQ ID NO: 12227 - protein, 9 aa, Artificial Sequence
  source: /note="Description of Artificial Sequence: Synthetic peptide"
FLRMNWCVS

SEQ ID NO: 12228 - protein, 9 aa, Artificial Sequence
  source: /note="Description of Artificial Sequence: Synthetic peptide"
PEIFLRMNW

SEQ ID NO: 12229 - protein, 10 aa, Artificial Sequence
  source: /note="Description of Artificial Sequence: Synthetic peptide"
EIFLRMNWCV

SEQ ID NO: 12230 - protein, 10 aa, Artificial Sequence
  source: /note="Description of Artificial Sequence: Synthetic peptide"
LEGPEIFLRM

SEQ ID NO: 12231 - protein, 10 aa, Artificial Sequence
  source: /note="Description of Artificial Sequence: Synthetic peptide"
GPEIFLRMNW

SEQ ID NO: 12232 - protein, 9 aa, Artificial Sequence
  source: /note="Description of Artificial Sequence: Synthetic peptide"
GVAQACEEY

SEQ ID NO: 12233 - protein, 9 aa, Artificial Sequence
  source: /note="Description of Artificial Sequence: Synthetic peptide"
APQDPGGVA

SEQ ID NO: 12234 - protein, 10 aa, Artificial Sequence
  source: /note="Description of Artificial Sequence: Synthetic peptide"
GGVAQACEEY

SEQ ID NO: 12235 - protein, 9 aa, Artificial Sequence
  source: /note="Description of Artificial Sequence: Synthetic peptide"
AQCGQGAAV

SEQ ID NO: 12236 - protein, 9 aa, Artificial Sequence
  source: /note="Description of Artificial Sequence: Synthetic peptide"
AVRAARGRE

SEQ ID NO: 12237 - protein, 9 aa, Artificial Sequence
  source: /note="Description of Artificial Sequence: Synthetic peptide"
QGAAVRAAR

SEQ ID NO: 12238 - protein, 9 aa, Artificial Sequence
  source: /note="Description of Artificial Sequence: Synthetic peptide"
GQGAAVRAA

SEQ ID NO: 12239 - protein, 9 aa, Artificial Sequence
  source: /note="Description of Artificial Sequence: Synthetic peptide"
VRAARGREL

SEQ ID NO: 12240 - protein, 10 aa, Artificial Sequence
  source: /note="Description of Artificial Sequence: Synthetic peptide"
AVRAARGREL

SEQ ID NO: 12241 - protein, 10 aa, Artificial Sequence
  source: /note="Description of Artificial Sequence: Synthetic peptide"
QPAQCGQGAA

SEQ ID NO: 12242 - protein, 9 aa, Artificial Sequence
  source: /note="Description of Artificial Sequence: Synthetic peptide"
TLVGHTGVV

SEQ ID NO: 12243 - protein, 9 aa, Artificial Sequence
  source: /note="Description of Artificial Sequence: Synthetic peptide"
GVVWSSQMR

SEQ ID NO: 12244 - protein, 9 aa, Artificial Sequence
  source: /note="Description of Artificial Sequence: Synthetic peptide"
RTLVGHTGV

SEQ ID NO: 12245 - protein, 9 aa, Artificial Sequence
  source: /note="Description of Artificial Sequence: Synthetic peptide"
LVGHTGVVW

SEQ ID NO: 12246 - protein, 9 aa, Artificial Sequence
  source: /note="Description of Artificial Sequence: Synthetic peptide"
TGVVWSSQM

SEQ ID NO: 12247 - protein, 10 aa, Artificial Sequence
  source: /note="Description of Artificial Sequence: Synthetic peptide"
RTLVGHTGVV

SEQ ID NO: 12248 - protein, 10 aa, Artificial Sequence
  source: /note="Description of Artificial Sequence: Synthetic peptide"
TLVGHTGVVW

SEQ ID NO: 12249 - protein, 10 aa, Artificial Sequence
  source: /note="Description of Artificial Sequence: Synthetic peptide"
HTGVVWSSQM

SEQ ID NO: 12250 - protein, 9 aa, Artificial Sequence
  source: /note="Description of Artificial Sequence: Synthetic peptide"
STVCCMHLH

SEQ ID NO: 12251 - protein, 9 aa, Artificial Sequence
  source: /note="Description of Artificial Sequence: Synthetic peptide"
GHTSTVCCM

SEQ ID NO: 12252 - protein, 10 aa, Artificial Sequence
  source: /note="Description of Artificial Sequence: Synthetic peptide"
TLYGHTSTVC

SEQ ID NO: 12253 - protein, 10 aa, Artificial Sequence
  source: /note="Description of Artificial Sequence: Synthetic peptide"
TVCCMHLHEK

SEQ ID NO: 12254 - protein, 10 aa, Artificial Sequence
  source: /note="Description of Artificial Sequence: Synthetic peptide"
HTSTVCCMHL

SEQ ID NO: 12255 - protein, 10 aa, Artificial Sequence
  source: /note="Description of Artificial Sequence: Synthetic peptide"
YGHTSTVCCM

SEQ ID NO: 12256 - protein, 9 aa, Artificial Sequence
  source: /note="Description of Artificial Sequence: Synthetic peptide"
STVHCMHLH

SEQ ID NO: 12257 - protein, 9 aa, Artificial Sequence
  source: /note="Description of Artificial Sequence: Synthetic peptide"
HCMHLHEKR

SEQ ID NO: 12258 - protein, 9 aa, Artificial Sequence
  source: /note="Description of Artificial Sequence: Synthetic peptide"
GHTSTVHCM

SEQ ID NO: 12259 - protein, 10 aa, Artificial Sequence
  source: /note="Description of Artificial Sequence: Synthetic peptide"
TVHCMHLHEK

SEQ ID NO: 12260 - protein, 10 aa, Artificial Sequence
  source: /note="Description of Artificial Sequence: Synthetic peptide"
HTSTVHCMHL

SEQ ID NO: 12261 - protein, 10 aa, Artificial Sequence
  source: /note="Description of Artificial Sequence: Synthetic peptide"
TLYGHTSTVH

SEQ ID NO: 12262 - protein, 10 aa, Artificial Sequence
  source: /note="Description of Artificial Sequence: Synthetic peptide"
YGHTSTVHCM

SEQ ID NO: 12263 - protein, 9 aa, Artificial Sequence
  source: /note="Description of Artificial Sequence: Synthetic peptide"
SQDATLRVW

SEQ ID NO: 12264 - protein, 9 aa, Artificial Sequence
  source: /note="Description of Artificial Sequence: Synthetic peptide"
VAAVGCVQY

SEQ ID NO: 12265 - protein, 10 aa, Artificial Sequence
  source: /note="Description of Artificial Sequence: Synthetic peptide"
HVAAVGCVQY

SEQ ID NO: 12266 - protein, 9 aa, Artificial Sequence
  source: /note="Description of Artificial Sequence: Synthetic peptide"
VAAVCCVQY

SEQ ID NO: 12267 - protein, 10 aa, Artificial Sequence
  source: /note="Description of Artificial Sequence: Synthetic peptide"
VLMGHVAAVC

SEQ ID NO: 12268 - protein, 10 aa, Artificial Sequence
  source: /note="Description of Artificial Sequence: Synthetic peptide"
HVAAVCCVQY

SEQ ID NO: 12269 - protein, 10 aa, Artificial Sequence
  source: /note="Description of Artificial Sequence: Synthetic peptide"
AVCCVQYDGR

SEQ ID NO: 12270 - protein, 9 aa, Artificial Sequence
  source: /note="Description of Artificial Sequence: Synthetic peptide"
LLQFDGIHV

SEQ ID NO: 12271 - protein, 9 aa, Artificial Sequence
  source: /note="Description of Artificial Sequence: Synthetic peptide"
VYLLQFDGI

SEQ ID NO: 12272 - protein, 9 aa, Artificial Sequence
  source: /note="Description of Artificial Sequence: Synthetic peptide"
TNRVYLLQF

SEQ ID NO: 12273 - protein, 9 aa, Artificial Sequence
  source: /note="Description of Artificial Sequence: Synthetic peptide"
YLLQFDGIH

SEQ ID NO: 12274 - protein, 10 aa, Artificial Sequence
  source: /note="Description of Artificial Sequence: Synthetic peptide"
YLLQFDGIHV

SEQ ID NO: 12275 - protein, 10 aa, Artificial Sequence
  source: /note="Description of Artificial Sequence: Synthetic peptide"
LLQFDGIHVV

SEQ ID NO: 12276 - protein, 10 aa, Artificial Sequence
  source: /note="Description of Artificial Sequence: Synthetic peptide"
RVYLLQFDGI

SEQ ID NO: 12277 - protein, 10 aa, Artificial Sequence
  source: /note="Description of Artificial Sequence: Synthetic peptide"
HTNRVYLLQF

SEQ ID NO: 12278 - protein, 10 aa, Artificial Sequence
  source: /note="Description of Artificial Sequence: Synthetic peptide"
LQGHTNRVYL

SEQ ID NO: 12279 - protein, 9 aa, Artificial Sequence
  source: /note="Description of Artificial Sequence: Synthetic peptide"
QLLTSGMEL

SEQ ID NO: 12280 - protein, 9 aa, Artificial Sequence
  source: /note="Description of Artificial Sequence: Synthetic peptide"
LLTSGMELK

SEQ ID NO: 12281 - protein, 9 aa, Artificial Sequence
  source: /note="Description of Artificial Sequence: Synthetic peptide"
HTLTGHQLL

SEQ ID NO: 12282 - protein, 9 aa, Artificial Sequence
  source: /note="Description of Artificial Sequence: Synthetic peptide"
IHTLTGHQL

SEQ ID NO: 12283 - protein, 9 aa, Artificial Sequence
  source: /note="Description of Artificial Sequence: Synthetic peptide"
GHQLLTSGM

SEQ ID NO: 12284 - protein, 10 aa, Artificial Sequence
  source: /note="Description of Artificial Sequence: Synthetic peptide"
QLLTSGMELK

SEQ ID NO: 12285 - protein, 10 aa, Artificial Sequence
  source: /note="Description of Artificial Sequence: Synthetic peptide"
IHTLTGHQLL

SEQ ID NO: 12286 - protein, 10 aa, Artificial Sequence
  source: /note="Description of Artificial Sequence: Synthetic peptide"
TGHQLLTSGM

SEQ ID NO: 12287 - protein, 10 aa, Artificial Sequence
  source: /note="Description of Artificial Sequence: Synthetic peptide"
HQLLTSGMEL

SEQ ID NO: 12288 - protein, 9 aa, Artificial Sequence
  source: /note="Description of Artificial Sequence: Synthetic peptide"
KLVCAVGSW

SEQ ID NO: 12289 - protein, 10 aa, Artificial Sequence
  source: /note="Description of Artificial Sequence: Synthetic peptide"
GSWNGTEETK

SEQ ID NO: 12290 - protein, 10 aa, Artificial Sequence
  source: /note="Description of Artificial Sequence: Synthetic peptide"
TKLVCAVGSW

SEQ ID NO: 12291 - protein, 9 aa, Artificial Sequence
  source: /note="Description of Artificial Sequence: Synthetic peptide"
KRRQTGGSL

SEQ ID NO: 12292 - protein, 9 aa, Artificial Sequence
  source: /note="Description of Artificial Sequence: Synthetic peptide"
RQTGGSLRG

SEQ ID NO: 12293 - protein, 10 aa, Artificial Sequence
  source: /note="Description of Artificial Sequence: Synthetic peptide"
KRRQTGGSLR

SEQ ID NO: 12294 - protein, 10 aa, Artificial Sequence
  source: /note="Description of Artificial Sequence: Synthetic peptide"
SKRRQTGGSL

SEQ ID NO: 12295 - protein, 9 aa, Artificial Sequence
  source: /note="Description of Artificial Sequence: Synthetic peptide"
GWGGAFEGL

SEQ ID NO: 12296 - protein, 9 aa, Artificial Sequence
  source: /note="Description of Artificial Sequence: Synthetic peptide"
ALMGWGGAF

SEQ ID NO: 12297 - protein, 10 aa, Artificial Sequence
  source: /note="Description of Artificial Sequence: Synthetic peptide"
DALMGWGGAF

SEQ ID NO: 12298 - protein, 10 aa, Artificial Sequence
  source: /note="Description of Artificial Sequence: Synthetic peptide"
MGWGGAFEGL

SEQ ID NO: 12299 - protein, 9 aa, Artificial Sequence
  source: /note="Description of Artificial Sequence: Synthetic peptide"
RMAMAGLVL

SEQ ID NO: 12300 - protein, 9 aa, Artificial Sequence
  source: /note="Description of Artificial Sequence: Synthetic peptide"
MAMAGLVLV

SEQ ID NO: 12301 - protein, 9 aa, Artificial Sequence
  source: /note="Description of Artificial Sequence: Synthetic peptide"
AMAGLVLVA

SEQ ID NO: 12302 - protein, 9 aa, Artificial Sequence
  source: /note="Description of Artificial Sequence: Synthetic peptide"
LIRMAMAGL

SEQ ID NO: 12303 - protein, 9 aa, Artificial Sequence
  source: /note="Description of Artificial Sequence: Synthetic peptide"
TQNLIRMAM

SEQ ID NO: 12304 - protein, 9 aa, Artificial Sequence
  source: /note="Description of Artificial Sequence: Synthetic peptide"
IRMAMAGLV

SEQ ID NO: 12305 - protein, 9 aa, Artificial Sequence
  source: /note="Description of Artificial Sequence: Synthetic peptide"
MAGLVLVAL

SEQ ID NO: 12306 - protein, 10 aa, Artificial Sequence
  source: /note="Description of Artificial Sequence: Synthetic peptide"
NLIRMAMAGL

SEQ ID NO: 12307 - protein, 10 aa, Artificial Sequence
  source: /note="Description of Artificial Sequence: Synthetic peptide"
RMAMAGLVLV

SEQ ID NO: 12308 - protein, 10 aa, Artificial Sequence
  source: /note="Description of Artificial Sequence: Synthetic peptide"
MAMAGLVLVA

SEQ ID NO: 12309 - protein, 10 aa, Artificial Sequence
  source: /note="Description of Artificial Sequence: Synthetic peptide"
AMAGLVLVAL

SEQ ID NO: 12310 - protein, 10 aa, Artificial Sequence
  source: /note="Description of Artificial Sequence: Synthetic peptide"
LIRMAMAGLV

SEQ ID NO: 12311 - protein, 10 aa, Artificial Sequence
  source: /note="Description of Artificial Sequence: Synthetic peptide"
IRMAMAGLVL

SEQ ID NO: 12312 - protein, 10 aa, Artificial Sequence
  source: /note="Description of Artificial Sequence: Synthetic peptide"
VMVCQEHSCK

SEQ ID NO: 12313 - protein, 9 aa, Artificial Sequence
  source: /note="Description of Artificial Sequence: Synthetic peptide"
ALRGGGQSA

SEQ ID NO: 12314 - protein, 9 aa, Artificial Sequence
  source: /note="Description of Artificial Sequence: Synthetic peptide"
GQSANALAF

SEQ ID NO: 12315 - protein, 10 aa, Artificial Sequence
  source: /note="Description of Artificial Sequence: Synthetic peptide"
LALRGGGQSA

SEQ ID NO: 12316 - protein, 10 aa, Artificial Sequence
  source: /note="Description of Artificial Sequence: Synthetic peptide"
GGQSANALAF

SEQ ID NO: 12317 - protein, 9 aa, Artificial Sequence
  source: /note="Description of Artificial Sequence: Synthetic peptide"
RPGLHRFVV

SEQ ID NO: 12318 - protein, 9 aa, Artificial Sequence
  source: /note="Description of Artificial Sequence: Synthetic peptide"
VVLQENVAW

SEQ ID NO: 12319 - protein, 10 aa, Artificial Sequence
  source: /note="Description of Artificial Sequence: Synthetic peptide"
GTRPGLHRFV

SEQ ID NO: 12320 - protein, 10 aa, Artificial Sequence
  source: /note="Description of Artificial Sequence: Synthetic peptide"
RPGLHRFVVL

SEQ ID NO: 12321 - protein, 10 aa, Artificial Sequence
  source: /note="Description of Artificial Sequence: Synthetic peptide"
FVVLQENVAW

SEQ ID NO: 12322 - protein, 9 aa, Artificial Sequence
  source: /note="Description of Artificial Sequence: Synthetic peptide"
IVAGVIATA

SEQ ID NO: 12323 - protein, 9 aa, Artificial Sequence
  source: /note="Description of Artificial Sequence: Synthetic peptide"
PMGIIVAGV

SEQ ID NO: 12324 - protein, 9 aa, Artificial Sequence
  source: /note="Description of Artificial Sequence: Synthetic peptide"
SPMGIIVAG

SEQ ID NO: 12325 - protein, 10 aa, Artificial Sequence
  source: /note="Description of Artificial Sequence: Synthetic peptide"
IIVAGVIATA

SEQ ID NO: 12326 - protein, 10 aa, Artificial Sequence
  source: /note="Description of Artificial Sequence: Synthetic peptide"
IVAGVIATAV

SEQ ID NO: 12327 - protein, 10 aa, Artificial Sequence
  source: /note="Description of Artificial Sequence: Synthetic peptide"
GVIATAVAAI

SEQ ID NO: 12328 - protein, 10 aa, Artificial Sequence
  source: /note="Description of Artificial Sequence: Synthetic peptide"
SPMGIIVAGV

SEQ ID NO: 12329 - protein, 9 aa, Artificial Sequence
  source: /note="Description of Artificial Sequence: Synthetic peptide"
HLTAVSSAA

SEQ ID NO: 12330 - protein, 9 aa, Artificial Sequence
  source: /note="Description of Artificial Sequence: Synthetic peptide"
SSAAPGTPA

SEQ ID NO: 12331 - protein, 9 aa, Artificial Sequence
  source: /note="Description of Artificial Sequence: Synthetic peptide"
SAAPGTPAF

SEQ ID NO: 12332 - protein, 9 aa, Artificial Sequence
  source: /note="Description of Artificial Sequence: Synthetic peptide"
YHLTAVSSA

SEQ ID NO: 12333 - protein, 10 aa, Artificial Sequence
  source: /note="Description of Artificial Sequence: Synthetic peptide"
SSAAPGTPAF

SEQ ID NO: 12334 - protein, 10 aa, Artificial Sequence
  source: /note="Description of Artificial Sequence: Synthetic peptide"
YHLTAVSSAA

SEQ ID NO: 12335 - protein, 10 aa, Artificial Sequence
  source: /note="Description of Artificial Sequence: Synthetic peptide"
SAAPGTPAFW

SEQ ID NO: 12336 - protein, 9 aa, Artificial Sequence
  source: /note="Description of Artificial Sequence: Synthetic peptide"
SQVIYSSLK

SEQ ID NO: 12337 - protein, 9 aa, Artificial Sequence
  source: /note="Description of Artificial Sequence: Synthetic peptide"
QVIYSSLKK

SEQ ID NO: 12338 - protein, 10 aa, Artificial Sequence
  source: /note="Description of Artificial Sequence: Synthetic peptide"
SQVIYSSLKK

SEQ ID NO: 12339 - protein, 10 aa, Artificial Sequence
  source: /note="Description of Artificial Sequence: Synthetic peptide"
DSQVIYSSLK

SEQ ID NO: 12340 - protein, 10 aa, Artificial Sequence
  source: /note="Description of Artificial Sequence: Synthetic peptide"
KDSQVIYSSL

SEQ ID NO: 12341 - protein, 9 aa, Artificial Sequence
  source: /note="Description of Artificial Sequence: Synthetic peptide"
TAYEMLDEK

SEQ ID NO: 12342 - protein, 9 aa, Artificial Sequence
  source: /note="Description of Artificial Sequence: Synthetic peptide"
AFKKTAYEM

SEQ ID NO: 12343 - protein, 9 aa, Artificial Sequence
  source: /note="Description of Artificial Sequence: Synthetic peptide"
FKKTAYEML

SEQ ID NO: 12344 - protein, 9 aa, Artificial Sequence
  source: /note="Description of Artificial Sequence: Synthetic peptide"
YEMLDEKLL

SEQ ID NO: 12345 - protein, 10 aa, Artificial Sequence
  source: /note="Description of Artificial Sequence: Synthetic peptide"
KTAYEMLDEK

SEQ ID NO: 12346 - protein, 10 aa, Artificial Sequence
  source: /note="Description of Artificial Sequence: Synthetic peptide"
EMLDEKLLAR

SEQ ID NO: 12347 - protein, 10 aa, Artificial Sequence
  source: /note="Description of Artificial Sequence: Synthetic peptide"
NAFKKTAYEM

SEQ ID NO: 12348 - protein, 10 aa, Artificial Sequence
  source: /note="Description of Artificial Sequence: Synthetic peptide"
YEMLDEKLLA

SEQ ID NO: 12349 - protein, 9 aa, Artificial Sequence
  source: /note="Description of Artificial Sequence: Synthetic peptide"
CIDSRALGF

SEQ ID NO: 12350 - protein, 9 aa, Artificial Sequence
  source: /note="Description of Artificial Sequence: Synthetic peptide"
RVMGNLVNM

SEQ ID NO: 12351 - protein, 9 aa, Artificial Sequence
  source: /note="Description of Artificial Sequence: Synthetic peptide"
ILMDRGDIL

SEQ ID NO: 12352 - protein, 9 aa, Artificial Sequence
  source: /note="Description of Artificial Sequence: Synthetic peptide"
LVNMSFLYI

SEQ ID NO: 12353 - protein, 9 aa, Artificial Sequence
  source: /note="Description of Artificial Sequence: Synthetic peptide"
NMSFLYILM

SEQ ID NO: 12354 - protein, 9 aa, Artificial Sequence
  source: /note="Description of Artificial Sequence: Synthetic peptide"
LITCIDSRA

SEQ ID NO: 12355 - protein, 9 aa, Artificial Sequence
  source: /note="Description of Artificial Sequence: Synthetic peptide"
SYNMLITCI

SEQ ID NO: 12356 - protein, 9 aa, Artificial Sequence
  source: /note="Description of Artificial Sequence: Synthetic peptide"
RALGFQTFL

SEQ ID NO: 12357 - protein, 9 aa, Artificial Sequence
  source: /note="Description of Artificial Sequence: Synthetic peptide"
NLVNMSFLY

SEQ ID NO: 12358 - protein, 9 aa, Artificial Sequence
  source: /note="Description of Artificial Sequence: Synthetic peptide"
MDRGDILSY

SEQ ID NO: 12359 - protein, 9 aa, Artificial Sequence
  source: /note="Description of Artificial Sequence: Synthetic peptide"
SFLYILMDR

SEQ ID NO: 12360 - protein, 9 aa, Artificial Sequence
  source: /note="Description of Artificial Sequence: Synthetic peptide"
MLITCIDSR

SEQ ID NO: 12361 - protein, 9 aa, Artificial Sequence
  source: /note="Description of Artificial Sequence: Synthetic peptide"
ETFWCERVM

SEQ ID NO: 12362 - protein, 9 aa, Artificial Sequence
  source: /note="Description of Artificial Sequence: Synthetic peptide"
DILSYNMLI

SEQ ID NO: 12363 - protein, 9 aa, Artificial Sequence
  source: /note="Description of Artificial Sequence: Synthetic peptide"
MGNLVNMSF

SEQ ID NO: 12364 - protein, 9 aa, Artificial Sequence
  source: /note="Description of Artificial Sequence: Synthetic peptide"
CERVMGNLV

SEQ ID NO: 12365 - protein, 9 aa, Artificial Sequence
  source: /note="Description of Artificial Sequence: Synthetic peptide"
VNMSFLYIL

SEQ ID NO: 12366 - protein, 9 aa, Artificial Sequence
  source: /note="Description of Artificial Sequence: Synthetic peptide"
RGDILSYNM

SEQ ID NO: 12367 - protein, 9 aa, Artificial Sequence
  source: /note="Description of Artificial Sequence: Synthetic peptide"
SRALGFQTF

SEQ ID NO: 12368 - protein, 9 aa, Artificial Sequence
  source: /note="Description of Artificial Sequence: Synthetic peptide"
LGFQTFLNL

SEQ ID NO: 12369 - protein, 9 aa, Artificial Sequence
  source: /note="Description of Artificial Sequence: Synthetic peptide"
KETFWCERV

SEQ ID NO: 12370 - protein, 9 aa, Artificial Sequence
  source: /note="Description of Artificial Sequence: Synthetic peptide"
GDILSYNML

SEQ ID NO: 12371 - protein, 10 aa, Artificial Sequence
  source: /note="Description of Artificial Sequence: Synthetic peptide"
LMDRGDILSY

SEQ ID NO: 12372 - protein, 10 aa, Artificial Sequence
  source: /note="Description of Artificial Sequence: Synthetic peptide"
NLVNMSFLYI

SEQ ID NO: 12373 - protein, 10 aa, Artificial Sequence
  source: /note="Description of Artificial Sequence: Synthetic peptide"
MLITCIDSRA

SEQ ID NO: 12374 - protein, 10 aa, Artificial Sequence
  source: /note="Description of Artificial Sequence: Synthetic peptide"
ALGFQTFLNL

SEQ ID NO: 12375 - protein, 10 aa, Artificial Sequence
  source: /note="Description of Artificial Sequence: Synthetic peptide"
MSFLYILMDR

SEQ ID NO: 12376 - protein, 10 aa, Artificial Sequence
  source: /note="Description of Artificial Sequence: Synthetic peptide"
VMGNLVNMSF

SEQ ID NO: 12377 - protein, 10 aa, Artificial Sequence
  source: /note="Description of Artificial Sequence: Synthetic peptide"
LYILMDRGDI

SEQ ID NO: 12378 - protein, 10 aa, Artificial Sequence
  source: /note="Description of Artificial Sequence: Synthetic peptide"
KNKETFWCER

SEQ ID NO: 12379 - protein, 10 aa, Artificial Sequence
  source: /note="Description of Artificial Sequence: Synthetic peptide"
GNLVNMSFLY

SEQ ID NO: 12380 - protein, 10 aa, Artificial Sequence
  source: /note="Description of Artificial Sequence: Synthetic peptide"
NMLITCIDSR

SEQ ID NO: 12381 - protein, 10 aa, Artificial Sequence
  source: /note="Description of Artificial Sequence: Synthetic peptide"
DSRALGFQTF

SEQ ID NO: 12382 - protein, 10 aa, Artificial Sequence
  source: /note="Description of Artificial Sequence: Synthetic peptide"
QELLKNKETF

SEQ ID NO: 12383 - protein, 10 aa, Artificial Sequence
  source: /note="Description of Artificial Sequence: Synthetic peptide"
KETFWCERVM

SEQ ID NO: 12384 - protein, 10 aa, Artificial Sequence
  source: /note="Description of Artificial Sequence: Synthetic peptide"
LVNMSFLYIL

SEQ ID NO: 12385 - protein, 10 aa, Artificial Sequence
  source: /note="Description of Artificial Sequence: Synthetic peptide"
VNMSFLYILM

SEQ ID NO: 12386 - protein, 10 aa, Artificial Sequence
  source: /note="Description of Artificial Sequence: Synthetic peptide"
LSYNMLITCI

SEQ ID NO: 12387 - protein, 10 aa, Artificial Sequence
  source: /note="Description of Artificial Sequence: Synthetic peptide"
TCIDSRALGF

SEQ ID NO: 12388 - protein, 10 aa, Artificial Sequence
  source: /note="Description of Artificial Sequence: Synthetic peptide"
SRALGFQTFL

SEQ ID NO: 12389 - protein, 10 aa, Artificial Sequence
  source: /note="Description of Artificial Sequence: Synthetic peptide"
GDILSYNMLI

SEQ ID NO: 12390 - protein, 9 aa, Artificial Sequence
  source: /note="Description of Artificial Sequence: Synthetic peptide"
SLLGRHKRK

SEQ ID NO: 12391 - protein, 9 aa, Artificial Sequence
  source: /note="Description of Artificial Sequence: Synthetic peptide"
GVSLLGRHK

SEQ ID NO: 12392 - protein, 9 aa, Artificial Sequence
  source: /note="Description of Artificial Sequence: Synthetic peptide"
VSLLGRHKR

SEQ ID NO: 12393 - protein, 9 aa, Artificial Sequence
  source: /note="Description of Artificial Sequence: Synthetic peptide"
HKRKRVITY

SEQ ID NO: 12394 - protein, 10 aa, Artificial Sequence
  source: /note="Description of Artificial Sequence: Synthetic peptide"
VSLLGRHKRK

SEQ ID NO: 12395 - protein, 10 aa, Artificial Sequence
  source: /note="Description of Artificial Sequence: Synthetic peptide"
RGVSLLGRHK

SEQ ID NO: 12396 - protein, 10 aa, Artificial Sequence
  source: /note="Description of Artificial Sequence: Synthetic peptide"
SLLGRHKRKR

SEQ ID NO: 12397 - protein, 10 aa, Artificial Sequence
  source: /note="Description of Artificial Sequence: Synthetic peptide"
LGRHKRKRVI

SEQ ID NO: 12398 - protein, 10 aa, Artificial Sequence
  source: /note="Description of Artificial Sequence: Synthetic peptide"
RHKRKRVITY

SEQ ID NO: 12399 - protein, 9 aa, Artificial Sequence
  source: /note="Description of Artificial Sequence: Synthetic peptide"
ALACSLEEK

SEQ ID NO: 12400 - protein, 9 aa, Artificial Sequence
  source: /note="Description of Artificial Sequence: Synthetic peptide"
GGADGFPAL

SEQ ID NO: 12401 - protein, 10 aa, Artificial Sequence
  source: /note="Description of Artificial Sequence: Synthetic peptide"
ALACSLEEKL

SEQ ID NO: 12402 - protein, 10 aa, Artificial Sequence
  source: /note="Description of Artificial Sequence: Synthetic peptide"
FPALACSLEE

SEQ ID NO: 12403 - protein, 9 aa, Artificial Sequence
  source: /note="Description of Artificial Sequence: Synthetic peptide"
YKVPSKTLL

SEQ ID NO: 12404 - protein, 10 aa, Artificial Sequence
  source: /note="Description of Artificial Sequence: Synthetic peptide"
MIPLQPLGYK

SEQ ID NO: 12405 - protein, 10 aa, Artificial Sequence
  source: /note="Description of Artificial Sequence: Synthetic peptide"
KVPSKTLLSY

SEQ ID NO: 12406 - protein, 10 aa, Artificial Sequence
  source: /note="Description of Artificial Sequence: Synthetic peptide"
LGYKVPSKTL

SEQ ID NO: 12407 - protein, 10 aa, Artificial Sequence
  source: /note="Description of Artificial Sequence: Synthetic peptide"
IPLQPLGYKV

SEQ ID NO: 12408 - protein, 9 aa, Artificial Sequence
  source: /note="Description of Artificial Sequence: Synthetic peptide"
RMGPTQLLI

SEQ ID NO: 12409 - protein, 9 aa, Artificial Sequence
  source: /note="Description of Artificial Sequence: Synthetic peptide"
LTRMGPTQL

SEQ ID NO: 12410 - protein, 9 aa, Artificial Sequence
  source: /note="Description of Artificial Sequence: Synthetic peptide"
GPTQLLIEM

SEQ ID NO: 12411 - protein, 9 aa, Artificial Sequence
  source: /note="Description of Artificial Sequence: Synthetic peptide"
TRMGPTQLL

SEQ ID NO: 12412 - protein, 10 aa, Artificial Sequence
  source: /note="Description of Artificial Sequence: Synthetic peptide"
QLTRMGPTQL

SEQ ID NO: 12413 - protein, 10 aa, Artificial Sequence
  source: /note="Description of Artificial Sequence: Synthetic peptide"
LTRMGPTQLL

SEQ ID NO: 12414 - protein, 10 aa, Artificial Sequence
  source: /note="Description of Artificial Sequence: Synthetic peptide"
SQLTRMGPTQ

SEQ ID NO: 12415 - protein, 9 aa, Artificial Sequence
  source: /note="Description of Artificial Sequence: Synthetic peptide"
VMPSKSTSA

SEQ ID NO: 12416 - protein, 9 aa, Artificial Sequence
  source: /note="Description of Artificial Sequence: Synthetic peptide"
MPSKSTSAS

SEQ ID NO: 12417 - protein, 10 aa, Artificial Sequence
  source: /note="Description of Artificial Sequence: Synthetic peptide"
GVMPSKSTSA

SEQ ID NO: 12418 - protein, 10 aa, Artificial Sequence
  source: /note="Description of Artificial Sequence: Synthetic peptide"
VPKPGVMPSK

SEQ ID NO: 12419 - protein, 10 aa, Artificial Sequence
  source: /note="Description of Artificial Sequence: Synthetic peptide"
MPSKSTSASA

SEQ ID NO: 12420 - protein, 10 aa, Artificial Sequence
  source: /note="Description of Artificial Sequence: Synthetic peptide"
GETVPKPGVM

SEQ ID NO: 12421 - protein, 9 aa, Artificial Sequence
  source: /note="Description of Artificial Sequence: Synthetic peptide"
VTPSKSTSV

SEQ ID NO: 12422 - protein, 9 aa, Artificial Sequence
  source: /note="Description of Artificial Sequence: Synthetic peptide"
VSAIMNGGK

SEQ ID NO: 12423 - protein, 9 aa, Artificial Sequence
  source: /note="Description of Artificial Sequence: Synthetic peptide"
KSTSVSAIM

SEQ ID NO: 12424 - protein, 9 aa, Artificial Sequence
  source: /note="Description of Artificial Sequence: Synthetic peptide"
SKSTSVSAI

SEQ ID NO: 12425 - protein, 10 aa, Artificial Sequence
  source: /note="Description of Artificial Sequence: Synthetic peptide"
GVTPSKSTSV

SEQ ID NO: 12426 - protein, 10 aa, Artificial Sequence
  source: /note="Description of Artificial Sequence: Synthetic peptide"
SVSAIMNGGK

SEQ ID NO: 12427 - protein, 10 aa, Artificial Sequence
  source: /note="Description of Artificial Sequence: Synthetic peptide"
TPSKSTSVSA

SEQ ID NO: 12428 - protein, 10 aa, Artificial Sequence
  source: /note="Description of Artificial Sequence: Synthetic peptide"
SKSTSVSAIM

SEQ ID NO: 12429 - protein, 9 aa, Artificial Sequence
  source: /note="Description of Artificial Sequence: Synthetic peptide"
YAGILSYRV

SEQ ID NO: 12430 - protein, 9 aa, Artificial Sequence
  source: /note="Description of Artificial Sequence: Synthetic peptide"
ILSYRVGFF

SEQ ID NO: 12431 - protein, 9 aa, Artificial Sequence
  source: /note="Description of Artificial Sequence: Synthetic peptide"
SYRVGFFLF

SEQ ID NO: 12432 - protein, 9 aa, Artificial Sequence
  source: /note="Description of Artificial Sequence: Synthetic peptide"
VYAGILSYR

SEQ ID NO: 12433 - protein, 9 aa, Artificial Sequence
  source: /note="Description of Artificial Sequence: Synthetic peptide"
GILSYRVGF

SEQ ID NO: 12434 - protein, 9 aa, Artificial Sequence
  source: /note="Description of Artificial Sequence: Synthetic peptide"
LSYRVGFFL

SEQ ID NO: 12435 - protein, 10 aa, Artificial Sequence
  source: /note="Description of Artificial Sequence: Synthetic peptide"
ILSYRVGFFL

SEQ ID NO: 12436 - protein, 10 aa, Artificial Sequence
  source: /note="Description of Artificial Sequence: Synthetic peptide"
RVGFFLFILV

SEQ ID NO: 12437 - protein, 10 aa, Artificial Sequence
  source: /note="Description of Artificial Sequence: Synthetic peptide"
SVYAGILSYR

SEQ ID NO: 12438 - protein, 10 aa, Artificial Sequence
  source: /note="Description of Artificial Sequence: Synthetic peptide"
VYAGILSYRV

SEQ ID NO: 12439 - protein, 10 aa, Artificial Sequence
  source: /note="Description of Artificial Sequence: Synthetic peptide"
LSYRVGFFLF

SEQ ID NO: 12440 - protein, 10 aa, Artificial Sequence
  source: /note="Description of Artificial Sequence: Synthetic peptide"
SYRVGFFLFI

SEQ ID NO: 12441 - protein, 10 aa, Artificial Sequence
  source: /note="Description of Artificial Sequence: Synthetic peptide"
AGILSYRVGF

SEQ ID NO: 12442 - protein, 10 aa, Artificial Sequence
  source: /note="Description of Artificial Sequence: Synthetic peptide"
GILSYRVGFF

SEQ ID NO: 12443 - protein, 10 aa, Artificial Sequence
  source: /note="Description of Artificial Sequence: Synthetic peptide"
YRVGFFLFIL

SEQ ID NO: 12444 - protein, 9 aa, Artificial Sequence
  source: /note="Description of Artificial Sequence: Synthetic peptide"
LLLRHLQAA

SEQ ID NO: 12445 - protein, 9 aa, Artificial Sequence
  source: /note="Description of Artificial Sequence: Synthetic peptide"
RARRAPGPG

SEQ ID NO: 12446 - protein, 9 aa, Artificial Sequence
  source: /note="Description of Artificial Sequence: Synthetic peptide"
LLRHLQAAR

SEQ ID NO: 12447 - protein, 9 aa, Artificial Sequence
  source: /note="Description of Artificial Sequence: Synthetic peptide"
RLRAGPGRA

SEQ ID NO: 12448 - protein, 9 aa, Artificial Sequence
  source: /note="Description of Artificial Sequence: Synthetic peptide"
GPGHGVLGL

SEQ ID NO: 12449 - protein, 9 aa, Artificial Sequence
  source: /note="Description of Artificial Sequence: Synthetic peptide"
FLRARRAPG

SEQ ID NO: 12450 - protein, 9 aa, Artificial Sequence
  source: /note="Description of Artificial Sequence: Synthetic peptide"
LQAARGAAH

SEQ ID NO: 12451 - protein, 9 aa, Artificial Sequence
  source: /note="Description of Artificial Sequence: Synthetic peptide"
REFLRARRA

SEQ ID NO: 12452 - protein, 9 aa, Artificial Sequence
  source: /note="Description of Artificial Sequence: Synthetic peptide"
ARRAPGPGL

SEQ ID NO: 12453 - protein, 9 aa, Artificial Sequence
  source: /note="Description of Artificial Sequence: Synthetic peptide"
RRAPGPGLL

SEQ ID NO: 12454 - protein, 9 aa, Artificial Sequence
  source: /note="Description of Artificial Sequence: Synthetic peptide"
RAPGPGLLL

SEQ ID NO: 12455 - protein, 9 aa, Artificial Sequence
  source: /note="Description of Artificial Sequence: Synthetic peptide"
RHLQAARGA

SEQ ID NO: 12456 - protein, 9 aa, Artificial Sequence
  source: /note="Description of Artificial Sequence: Synthetic peptide"
AHLQGPGVL

SEQ ID NO: 12457 - protein, 9 aa, Artificial Sequence
  source: /note="Description of Artificial Sequence: Synthetic peptide"
LQGPGVLCL

SEQ ID NO: 12458 - protein, 9 aa, Artificial Sequence
  source: /note="Description of Artificial Sequence: Synthetic peptide"
LQEDDQRPA

SEQ ID NO: 12459 - protein, 9 aa, Artificial Sequence
  source: /note="Description of Artificial Sequence: Synthetic peptide"
LPGGPGHGV

SEQ ID NO: 12460 - protein, 10 aa, Artificial Sequence
  source: /note="Description of Artificial Sequence: Synthetic peptide"
CLPGGPGHGV

SEQ ID NO: 12461 - protein, 10 aa, Artificial Sequence
  source: /note="Description of Artificial Sequence: Synthetic peptide"
GLLLRHLQAA

SEQ ID NO: 12462 - protein, 10 aa, Artificial Sequence
  source: /note="Description of Artificial Sequence: Synthetic peptide"
LQAARGAAHL

SEQ ID NO: 12463 - protein, 10 aa, Artificial Sequence
  source: /note="Description of Artificial Sequence: Synthetic peptide"
LLQEDDQRPA

SEQ ID NO: 12464 - protein, 10 aa, Artificial Sequence
  source: /note="Description of Artificial Sequence: Synthetic peptide"
RARRAPGPGL

SEQ ID NO: 12465 - protein, 10 aa, Artificial Sequence
  source: /note="Description of Artificial Sequence: Synthetic peptide"
RLRAGPGRAQ

SEQ ID NO: 12466 - protein, 10 aa, Artificial Sequence
  source: /note="Description of Artificial Sequence: Synthetic peptide"
RAGPGRAQPR

SEQ ID NO: 12467 - protein, 10 aa, Artificial Sequence
  source: /note="Description of Artificial Sequence: Synthetic peptide"
LLLRHLQAAR

SEQ ID NO: 12468 - protein, 10 aa, Artificial Sequence
  source: /note="Description of Artificial Sequence: Synthetic peptide"
LPGGPGHGVL

SEQ ID NO: 12469 - protein, 10 aa, Artificial Sequence
  source: /note="Description of Artificial Sequence: Synthetic peptide"
RPAAREVDGA

SEQ ID NO: 12470 - protein, 10 aa, Artificial Sequence
  source: /note="Description of Artificial Sequence: Synthetic peptide"
FLRARRAPGP

SEQ ID NO: 12471 - protein, 10 aa, Artificial Sequence
  source: /note="Description of Artificial Sequence: Synthetic peptide"
REFLRARRAP

SEQ ID NO: 12472 - protein, 10 aa, Artificial Sequence
  source: /note="Description of Artificial Sequence: Synthetic peptide"
RRAPGPGLLL

SEQ ID NO: 12473 - protein, 10 aa, Artificial Sequence
  source: /note="Description of Artificial Sequence: Synthetic peptide"
RHLQAARGAA

SEQ ID NO: 12474 - protein, 10 aa, Artificial Sequence
  source: /note="Description of Artificial Sequence: Synthetic peptide"
HLQAARGAAH

SEQ ID NO: 12475 - protein, 10 aa, Artificial Sequence
  source: /note="Description of Artificial Sequence: Synthetic peptide"
AAHLQGPGVL

SEQ ID NO: 12476 - protein, 10 aa, Artificial Sequence
  source: /note="Description of Artificial Sequence: Synthetic peptide"
HLQGPGVLCL

SEQ ID NO: 12477 - protein, 10 aa, Artificial Sequence
  source: /note="Description of Artificial Sequence: Synthetic peptide"
LQEDDQRPAA

SEQ ID NO: 12478 - protein, 9 aa, Artificial Sequence
  source: /note="Description of Artificial Sequence: Synthetic peptide"
HANCTHDLY

SEQ ID NO: 12479 - protein, 10 aa, Artificial Sequence
  source: /note="Description of Artificial Sequence: Synthetic peptide"
KHANCTHDLY

SEQ ID NO: 12480 - protein, 10 aa, Artificial Sequence
  source: /note="Description of Artificial Sequence: Synthetic peptide"
RMDKHANCTH

SEQ ID NO: 12481 - protein, 10 aa, Artificial Sequence
  source: /note="Description of Artificial Sequence: Synthetic peptide"
HANCTHDLYM

SEQ ID NO: 12482 - protein, 9 aa, Artificial Sequence
  source: /note="Description of Artificial Sequence: Synthetic peptide"
RILPPGAEV

SEQ ID NO: 12483 - protein, 9 aa, Artificial Sequence
  source: /note="Description of Artificial Sequence: Synthetic peptide"
RLSADGETA

SEQ ID NO: 12484 - protein, 9 aa, Artificial Sequence
  source: /note="Description of Artificial Sequence: Synthetic peptide"
CVCVCAHPR

SEQ ID NO: 12485 - protein, 9 aa, Artificial Sequence
  source: /note="Description of Artificial Sequence: Synthetic peptide"
GSRTSRATG

SEQ ID NO: 12486 - protein, 9 aa, Artificial Sequence
  source: /note="Description of Artificial Sequence: Synthetic peptide"
GSLAAHPAA

SEQ ID NO: 12487 - protein, 9 aa, Artificial Sequence
  source: /note="Description of Artificial Sequence: Synthetic peptide"
CVRILPPGA

SEQ ID NO: 12488 - protein, 9 aa, Artificial Sequence
  source: /note="Description of Artificial Sequence: Synthetic peptide"
LLTGAAAPR

SEQ ID NO: 12489 - protein, 9 aa, Artificial Sequence
  source: /note="Description of Artificial Sequence: Synthetic peptide"
LAAHPAAGA

SEQ ID NO: 12490 - protein, 9 aa, Artificial Sequence
  source: /note="Description of Artificial Sequence: Synthetic peptide"
ETATQSFGL

SEQ ID NO: 12491 - protein, 9 aa, Artificial Sequence
  source: /note="Description of Artificial Sequence: Synthetic peptide"
QSFGLCVCV

SEQ ID NO: 12492 - protein, 9 aa, Artificial Sequence
  source: /note="Description of Artificial Sequence: Synthetic peptide"
EVPWVSPLL

SEQ ID NO: 12493 - protein, 9 aa, Artificial Sequence
  source: /note="Description of Artificial Sequence: Synthetic peptide"
GPQQCEGSL

SEQ ID NO: 12494 - protein, 9 aa, Artificial Sequence
  source: /note="Description of Artificial Sequence: Synthetic peptide"
HPAAGAQPL

SEQ ID NO: 12495 - protein, 9 aa, Artificial Sequence
  source: /note="Description of Artificial Sequence: Synthetic peptide"
SPLLCNGLL

SEQ ID NO: 12496 - protein, 9 aa, Artificial Sequence
  source: /note="Description of Artificial Sequence: Synthetic peptide"
QQCEGSLAA

SEQ ID NO: 12497 - protein, 9 aa, Artificial Sequence
  source: /note="Description of Artificial Sequence: Synthetic peptide"
AGAQPLPGM

SEQ ID NO: 12498 - protein, 9 aa, Artificial Sequence
  source: /note="Description of Artificial Sequence: Synthetic peptide"
AQPLPGMRL

SEQ ID NO: 12499 - protein, 9 aa, Artificial Sequence
  source: /note="Description of Artificial Sequence: Synthetic peptide"
AEVPWVSPL

SEQ ID NO: 12500 - protein, 9 aa, Artificial Sequence
  source: /note="Description of Artificial Sequence: Synthetic peptide"
LPPGAEVPW

SEQ ID NO: 12501 - protein, 9 aa, Artificial Sequence
  source: /note="Description of Artificial Sequence: Synthetic peptide"
VPWVSPLLC

SEQ ID NO: 12502 - protein, 10 aa, Artificial Sequence
  source: /note="Description of Artificial Sequence: Synthetic peptide"
SLAAHPAAGA

SEQ ID NO: 12503 - protein, 10 aa, Artificial Sequence
  source: /note="Description of Artificial Sequence: Synthetic peptide"
TQSFGLCVCV

SEQ ID NO: 12504 - protein, 10 aa, Artificial Sequence
  source: /note="Description of Artificial Sequence: Synthetic peptide"
GLCVCVCVCV

SEQ ID NO: 12505 - protein, 10 aa, Artificial Sequence
  source: /note="Description of Artificial Sequence: Synthetic peptide"
LLCNGLLTGA

SEQ ID NO: 12506 - protein, 10 aa, Artificial Sequence
  source: /note="Description of Artificial Sequence: Synthetic peptide"
WVSPLLCNGL

SEQ ID NO: 12507 - protein, 10 aa, Artificial Sequence
  source: /note="Description of Artificial Sequence: Synthetic peptide"
ILPPGAEVPW

SEQ ID NO: 12508 - protein, 10 aa, Artificial Sequence
  source: /note="Description of Artificial Sequence: Synthetic peptide"
ETATQSFGLC

SEQ ID NO: 12509 - protein, 10 aa, Artificial Sequence
  source: /note="Description of Artificial Sequence: Synthetic peptide"
CVCAHPRVPV

SEQ ID NO: 12510 - protein, 10 aa, Artificial Sequence
  source: /note="Description of Artificial Sequence: Synthetic peptide"
QPLPGMRLSA

SEQ ID NO: 12511 - protein, 10 aa, Artificial Sequence
  source: /note="Description of Artificial Sequence: Synthetic peptide"
HPRVPVCVRI

SEQ ID NO: 12512 - protein, 10 aa, Artificial Sequence
  source: /note="Description of Artificial Sequence: Synthetic peptide"
QQCEGSLAAH

SEQ ID NO: 12513 - protein, 10 aa, Artificial Sequence
  source: /note="Description of Artificial Sequence: Synthetic peptide"
ADGETATQSF

SEQ ID NO: 12514 - protein, 10 aa, Artificial Sequence
  source: /note="Description of Artificial Sequence: Synthetic peptide"
GETATQSFGL

SEQ ID NO: 12515 - protein, 10 aa, Artificial Sequence
  source: /note="Description of Artificial Sequence: Synthetic peptide"
AEVPWVSPLL

SEQ ID NO: 12516 - protein, 10 aa, Artificial Sequence
  source: /note="Description of Artificial Sequence: Synthetic peptide"
CEGSLAAHPA

SEQ ID NO: 12517 - protein, 10 aa, Artificial Sequence
  source: /note="Description of Artificial Sequence: Synthetic peptide"
LPPGAEVPWV

SEQ ID NO: 12518 - protein, 9 aa, Artificial Sequence
  source: /note="Description of Artificial Sequence: Synthetic peptide"
DVLECSPHR

SEQ ID NO: 12519 - protein, 9 aa, Artificial Sequence
  source: /note="Description of Artificial Sequence: Synthetic peptide"
LECSPHRPI

SEQ ID NO: 12520 - protein, 10 aa, Artificial Sequence
  source: /note="Description of Artificial Sequence: Synthetic peptide"
LECSPHRPIL

SEQ ID NO: 12521 - protein, 9 aa, Artificial Sequence
  source: /note="Description of Artificial Sequence: Synthetic peptide"
DVLERCPHR

SEQ ID NO: 12522 - protein, 9 aa, Artificial Sequence
  source: /note="Description of Artificial Sequence: Synthetic peptide"
LERCPHRPI

SEQ ID NO: 12523 - protein, 9 aa, Artificial Sequence
  source: /note="Description of Artificial Sequence: Synthetic peptide"
CPHRPILQA

SEQ ID NO: 12524 - protein, 10 aa, Artificial Sequence
  source: /note="Description of Artificial Sequence: Synthetic peptide"
LERCPHRPIL

SEQ ID NO: 12525 - protein, 9 aa, Artificial Sequence
  source: /note="Description of Artificial Sequence: Synthetic peptide"
SVLDGTVSA

SEQ ID NO: 12526 - protein, 9 aa, Artificial Sequence
  source: /note="Description of Artificial Sequence: Synthetic peptide"
VLDGTVSAV

SEQ ID NO: 12527 - protein, 9 aa, Artificial Sequence
  source: /note="Description of Artificial Sequence: Synthetic peptide"
HTHTHTLSH

SEQ ID NO: 12528 - protein, 9 aa, Artificial Sequence
  source: /note="Description of Artificial Sequence: Synthetic peptide"
HTLSHTLTR

SEQ ID NO: 12529 - protein, 9 aa, Artificial Sequence
  source: /note="Description of Artificial Sequence: Synthetic peptide"
HTHTLSHTL

SEQ ID NO: 12530 - protein, 9 aa, Artificial Sequence
  source: /note="Description of Artificial Sequence: Synthetic peptide"
RSCRRRQGT

SEQ ID NO: 12531 - protein, 9 aa, Artificial Sequence
  source: /note="Description of Artificial Sequence: Synthetic peptide"
DIHTHTHTL

SEQ ID NO: 12532 - protein, 9 aa, Artificial Sequence
  source: /note="Description of Artificial Sequence: Synthetic peptide"
GPPAHPLSV

SEQ ID NO: 12533 - protein, 9 aa, Artificial Sequence
  source: /note="Description of Artificial Sequence: Synthetic peptide"
PPAHPLSVL

SEQ ID NO: 12534 - protein, 9 aa, Artificial Sequence
  source: /note="Description of Artificial Sequence: Synthetic peptide"
WPAPQAVCV

SEQ ID NO: 12535 - protein, 9 aa, Artificial Sequence
  source: /note="Description of Artificial Sequence: Synthetic peptide"
GQGPPAHPL

SEQ ID NO: 12536 - protein, 9 aa, Artificial Sequence
  source: /note="Description of Artificial Sequence: Synthetic peptide"
EEWPAPQAV

SEQ ID NO: 12537 - protein, 9 aa, Artificial Sequence
  source: /note="Description of Artificial Sequence: Synthetic peptide"
EEEWPAPQA

SEQ ID NO: 12538 - protein, 10 aa, Artificial Sequence
  source: /note="Description of Artificial Sequence: Synthetic peptide"
SVLDGTVSAV

SEQ ID NO: 12539 - protein, 10 aa, Artificial Sequence
  source: /note="Description of Artificial Sequence: Synthetic peptide"
HTHTHTLSHT

SEQ ID NO: 12540 - protein, 10 aa, Artificial Sequence
  source: /note="Description of Artificial Sequence: Synthetic peptide"
HTHTLSHTLT

SEQ ID NO: 12541 - protein, 10 aa, Artificial Sequence
  source: /note="Description of Artificial Sequence: Synthetic peptide"
LTRGGQGPPA

SEQ ID NO: 12542 - protein, 10 aa, Artificial Sequence
  source: /note="Description of Artificial Sequence: Synthetic peptide"
RSCRRRQGTH

SEQ ID NO: 12543 - protein, 10 aa, Artificial Sequence
  source: /note="Description of Artificial Sequence: Synthetic peptide"
GPPAHPLSVL

SEQ ID NO: 12544 - protein, 10 aa, Artificial Sequence
  source: /note="Description of Artificial Sequence: Synthetic peptide"
HPLSVLDGTV

SEQ ID NO: 12545 - protein, 10 aa, Artificial Sequence
  source: /note="Description of Artificial Sequence: Synthetic peptide"
TDIHTHTHTL

SEQ ID NO: 12546 - protein, 10 aa, Artificial Sequence
  source: /note="Description of Artificial Sequence: Synthetic peptide"
IHTHTHTLSH

SEQ ID NO: 12547 - protein, 10 aa, Artificial Sequence
  source: /note="Description of Artificial Sequence: Synthetic peptide"
RQGTHGEEEW

SEQ ID NO: 12548 - protein, 10 aa, Artificial Sequence
  source: /note="Description of Artificial Sequence: Synthetic peptide"
EEWPAPQAVC

SEQ ID NO: 12549 - protein, 10 aa, Artificial Sequence
  source: /note="Description of Artificial Sequence: Synthetic peptide"
EEEWPAPQAV

SEQ ID NO: 12550 - protein, 10 aa, Artificial Sequence
  source: /note="Description of Artificial Sequence: Synthetic peptide"
GEEEWPAPQA

SEQ ID NO: 12551 - protein, 9 aa, Artificial Sequence
  source: /note="Description of Artificial Sequence: Synthetic peptide"
RTLSKPVLT

SEQ ID NO: 12552 - protein, 9 aa, Artificial Sequence
  source: /note="Description of Artificial Sequence: Synthetic peptide"
IQRTLSKPV

SEQ ID NO: 12553 - protein, 10 aa, Artificial Sequence
  source: /note="Description of Artificial Sequence: Synthetic peptide"
VIQRTLSKPV

SEQ ID NO: 12554 - protein, 10 aa, Artificial Sequence
  source: /note="Description of Artificial Sequence: Synthetic peptide"
TLSKPVLTGT

SEQ ID NO: 12555 - protein, 10 aa, Artificial Sequence
  source: /note="Description of Artificial Sequence: Synthetic peptide"
RTLSKPVLTG

SEQ ID NO: 12556 - protein, 10 aa, Artificial Sequence
  source: /note="Description of Artificial Sequence: Synthetic peptide"
IQRTLSKPVL

SEQ ID NO: 12557 - protein, 10 aa, Artificial Sequence
  source: /note="Description of Artificial Sequence: Synthetic peptide"
YKVDVIQRTL

SEQ ID NO: 12558 - protein, 9 aa, Artificial Sequence
  source: /note="Description of Artificial Sequence: Synthetic peptide"
KVRSDLKPV

SEQ ID NO: 12559 - protein, 9 aa, Artificial Sequence
  source: /note="Description of Artificial Sequence: Synthetic peptide"
QCKVRSDLK

SEQ ID NO: 12560 - protein, 9 aa, Artificial Sequence
  source: /note="Description of Artificial Sequence: Synthetic peptide"
FQCKVRSDL

SEQ ID NO: 12561 - protein, 10 aa, Artificial Sequence
  source: /note="Description of Artificial Sequence: Synthetic peptide"
KVRSDLKPVI

SEQ ID NO: 12562 - protein, 10 aa, Artificial Sequence
  source: /note="Description of Artificial Sequence: Synthetic peptide"
DLKPVIQWLK

SEQ ID NO: 12563 - protein, 10 aa, Artificial Sequence
  source: /note="Description of Artificial Sequence: Synthetic peptide"
CKVRSDLKPV

SEQ ID NO: 12564 - protein, 9 aa, Artificial Sequence
  source: /note="Description of Artificial Sequence: Synthetic peptide"
SVAERELER

SEQ ID NO: 12565 - protein, 9 aa, Artificial Sequence
  source: /note="Description of Artificial Sequence: Synthetic peptide"
LQYVGGGDV

SEQ ID NO: 12566 - protein, 9 aa, Artificial Sequence
  source: /note="Description of Artificial Sequence: Synthetic peptide"
AERELERDL

SEQ ID NO: 12567 - protein, 10 aa, Artificial Sequence
  source: /note="Description of Artificial Sequence: Synthetic peptide"
VLQYVGGGDV

SEQ ID NO: 12568 - protein, 10 aa, Artificial Sequence
  source: /note="Description of Artificial Sequence: Synthetic peptide"
LQYVGGGDVC

SEQ ID NO: 12569 - protein, 10 aa, Artificial Sequence
  source: /note="Description of Artificial Sequence: Synthetic peptide"
AERELERDLL

SEQ ID NO: 12570 - protein, 9 aa, Artificial Sequence
  source: /note="Description of Artificial Sequence: Synthetic peptide"
RMRSFFGKL

SEQ ID NO: 12571 - protein, 9 aa, Artificial Sequence
  source: /note="Description of Artificial Sequence: Synthetic peptide"
RSFFGKLFR

SEQ ID NO: 12572 - protein, 9 aa, Artificial Sequence
  source: /note="Description of Artificial Sequence: Synthetic peptide"
KRMRSFFGK

SEQ ID NO: 12573 - protein, 9 aa, Artificial Sequence
  source: /note="Description of Artificial Sequence: Synthetic peptide"
SFFGKLFRR

SEQ ID NO: 12574 - protein, 9 aa, Artificial Sequence
  source: /note="Description of Artificial Sequence: Synthetic peptide"
KTPPSLPFL

SEQ ID NO: 12575 - protein, 9 aa, Artificial Sequence
  source: /note="Description of Artificial Sequence: Synthetic peptide"
KKRMRSFFG

SEQ ID NO: 12576 - protein, 9 aa, Artificial Sequence
  source: /note="Description of Artificial Sequence: Synthetic peptide"
FGKLFRRSK

SEQ ID NO: 12577 - protein, 9 aa, Artificial Sequence
  source: /note="Description of Artificial Sequence: Synthetic peptide"
LFRRSKFEA

SEQ ID NO: 12578 - protein, 9 aa, Artificial Sequence
  source: /note="Description of Artificial Sequence: Synthetic peptide"
RSKFEAKPT

SEQ ID NO: 12579 - protein, 9 aa, Artificial Sequence
  source: /note="Description of Artificial Sequence: Synthetic peptide"
TTKLIQRPL

SEQ ID NO: 12580 - protein, 9 aa, Artificial Sequence
  source: /note="Description of Artificial Sequence: Synthetic peptide"
IQRPLRSSL

SEQ ID NO: 12581 - protein, 9 aa, Artificial Sequence
  source: /note="Description of Artificial Sequence: Synthetic peptide"
PLRSSLGSR

SEQ ID NO: 12582 - protein, 9 aa, Artificial Sequence
  source: /note="Description of Artificial Sequence: Synthetic peptide"
GSRKTPPSL

SEQ ID NO: 12583 - protein, 9 aa, Artificial Sequence
  source: /note="Description of Artificial Sequence: Synthetic peptide"
TSGPWQPGR

SEQ ID NO: 12584 - protein, 9 aa, Artificial Sequence
  source: /note="Description of Artificial Sequence: Synthetic peptide"
NITTKLIQR

SEQ ID NO: 12585 - protein, 9 aa, Artificial Sequence
  source: /note="Description of Artificial Sequence: Synthetic peptide"
GPWQPGRNI

SEQ ID NO: 12586 - protein, 9 aa, Artificial Sequence
  source: /note="Description of Artificial Sequence: Synthetic peptide"
LPFLGEEEL

SEQ ID NO: 12587 - protein, 9 aa, Artificial Sequence
  source: /note="Description of Artificial Sequence: Synthetic peptide"
MRSFFGKLF

SEQ ID NO: 12588 - protein, 9 aa, Artificial Sequence
  source: /note="Description of Artificial Sequence: Synthetic peptide"
GKLFRRSKF

SEQ ID NO: 12589 - protein, 9 aa, Artificial Sequence
  source: /note="Description of Artificial Sequence: Synthetic peptide"
RKTPPSLPF

SEQ ID NO: 12590 - protein, 10 aa, Artificial Sequence
  source: /note="Description of Artificial Sequence: Synthetic peptide"
KLFRRSKFEA

SEQ ID NO: 12591 - protein, 10 aa, Artificial Sequence
  source: /note="Description of Artificial Sequence: Synthetic peptide"
SLPFLGEEEL

SEQ ID NO: 12592 - protein, 10 aa, Artificial Sequence
  source: /note="Description of Artificial Sequence: Synthetic peptide"
RSFFGKLFRR

SEQ ID NO: 12593 - protein, 10 aa, Artificial Sequence
  source: /note="Description of Artificial Sequence: Synthetic peptide"
RMRSFFGKLF

SEQ ID NO: 12594 - protein, 10 aa, Artificial Sequence
  source: /note="Description of Artificial Sequence: Synthetic peptide"
KKRMRSFFGK

SEQ ID NO: 12595 - protein, 10 aa, Artificial Sequence
  source: /note="Description of Artificial Sequence: Synthetic peptide"
LFRRSKFEAK

SEQ ID NO: 12596 - protein, 10 aa, Artificial Sequence
  source: /note="Description of Artificial Sequence: Synthetic peptide"
RSKFEAKPTS

SEQ ID NO: 12597 - protein, 10 aa, Artificial Sequence
  source: /note="Description of Artificial Sequence: Synthetic peptide"
TTKLIQRPLR

SEQ ID NO: 12598 - protein, 10 aa, Artificial Sequence
  source: /note="Description of Artificial Sequence: Synthetic peptide"
IQRPLRSSLG

SEQ ID NO: 12599 - protein, 10 aa, Artificial Sequence
  source: /note="Description of Artificial Sequence: Synthetic peptide"
PLRSSLGSRK

SEQ ID NO: 12600 - protein, 10 aa, Artificial Sequence
  source: /note="Description of Artificial Sequence: Synthetic peptide"
GPWQPGRNIT

SEQ ID NO: 12601 - protein, 10 aa, Artificial Sequence
  source: /note="Description of Artificial Sequence: Synthetic peptide"
LIQRPLRSSL

SEQ ID NO: 12602 - protein, 10 aa, Artificial Sequence
  source: /note="Description of Artificial Sequence: Synthetic peptide"
KRMRSFFGKL

SEQ ID NO: 12603 - protein, 10 aa, Artificial Sequence
  source: /note="Description of Artificial Sequence: Synthetic peptide"
FGKLFRRSKF

SEQ ID NO: 12604 - protein, 10 aa, Artificial Sequence
  source: /note="Description of Artificial Sequence: Synthetic peptide"
SKFEAKPTSG

SEQ ID NO: 12605 - protein, 10 aa, Artificial Sequence
  source: /note="Description of Artificial Sequence: Synthetic peptide"
FEAKPTSGPW

SEQ ID NO: 12606 - protein, 10 aa, Artificial Sequence
  source: /note="Description of Artificial Sequence: Synthetic peptide"
SRKTPPSLPF

SEQ ID NO: 12607 - protein, 10 aa, Artificial Sequence
  source: /note="Description of Artificial Sequence: Synthetic peptide"
RKTPPSLPFL

SEQ ID NO: 12608 - protein, 9 aa, Artificial Sequence
  source: /note="Description of Artificial Sequence: Synthetic peptide"
YSLWIEAMV

SEQ ID NO: 12609 - protein, 9 aa, Artificial Sequence
  source: /note="Description of Artificial Sequence: Synthetic peptide"
SLWIEAMVL

SEQ ID NO: 12610 - protein, 9 aa, Artificial Sequence
  source: /note="Description of Artificial Sequence: Synthetic peptide"
LWIEAMVLK

SEQ ID NO: 12611 - protein, 9 aa, Artificial Sequence
  source: /note="Description of Artificial Sequence: Synthetic peptide"
WIEAMVLKK

SEQ ID NO: 12612 - protein, 9 aa, Artificial Sequence
  source: /note="Description of Artificial Sequence: Synthetic peptide"
IQVPNYSLW

SEQ ID NO: 12613 - protein, 9 aa, Artificial Sequence
  source: /note="Description of Artificial Sequence: Synthetic peptide"
NYSLWIEAM

SEQ ID NO: 12614 - protein, 10 aa, Artificial Sequence
  source: /note="Description of Artificial Sequence: Synthetic peptide"
IQVPNYSLWI

SEQ ID NO: 12615 - protein, 10 aa, Artificial Sequence
  source: /note="Description of Artificial Sequence: Synthetic peptide"
SLWIEAMVLK

SEQ ID NO: 12616 - protein, 10 aa, Artificial Sequence
  source: /note="Description of Artificial Sequence: Synthetic peptide"
NYSLWIEAMV

SEQ ID NO: 12617 - protein, 10 aa, Artificial Sequence
  source: /note="Description of Artificial Sequence: Synthetic peptide"
YSLWIEAMVL

SEQ ID NO: 12618 - protein, 10 aa, Artificial Sequence
  source: /note="Description of Artificial Sequence: Synthetic peptide"
VPNYSLWIEA

SEQ ID NO: 12619 - protein, 9 aa, Artificial Sequence
  source: /note="Description of Artificial Sequence: Synthetic peptide"
AECFVCVTC

SEQ ID NO: 12620 - protein, 9 aa, Artificial Sequence
  source: /note="Description of Artificial Sequence: Synthetic peptide"
QPWHAECFV

SEQ ID NO: 12621 - protein, 10 aa, Artificial Sequence
  source: /note="Description of Artificial Sequence: Synthetic peptide"
AECFVCVTCS

SEQ ID NO: 12622 - protein, 9 aa, Artificial Sequence
  source: /note="Description of Artificial Sequence: Synthetic peptide"
SVHQGLHMV

SEQ ID NO: 12623 - protein, 9 aa, Artificial Sequence
  source: /note="Description of Artificial Sequence: Synthetic peptide"
LSVHQGLHM

SEQ ID NO: 12624 - protein, 9 aa, Artificial Sequence
  source: /note="Description of Artificial Sequence: Synthetic peptide"
DQQKSTTNL

SEQ ID NO: 12625 - protein, 9 aa, Artificial Sequence
  source: /note="Description of Artificial Sequence: Synthetic peptide"
QKSTTNLSV

SEQ ID NO: 12626 - protein, 10 aa, Artificial Sequence
  source: /note="Description of Artificial Sequence: Synthetic peptide"
SVHQGLHMVV

SEQ ID NO: 12627 - protein, 10 aa, Artificial Sequence
  source: /note="Description of Artificial Sequence: Synthetic peptide"
QQKSTTNLSV

SEQ ID NO: 12628 - protein, 10 aa, Artificial Sequence
  source: /note="Description of Artificial Sequence: Synthetic peptide"
TTNLSVHQGL

SEQ ID NO: 12629 - protein, 10 aa, Artificial Sequence
  source: /note="Description of Artificial Sequence: Synthetic peptide"
QKSTTNLSVH

SEQ ID NO: 12630 - protein, 10 aa, Artificial Sequence
  source: /note="Description of Artificial Sequence: Synthetic peptide"
NLSVHQGLHM

SEQ ID NO: 12631 - protein, 10 aa, Artificial Sequence
  source: /note="Description of Artificial Sequence: Synthetic peptide"
MMEKKKQEER

SEQ ID NO: 12632 - protein, 9 aa, Artificial Sequence
  source: /note="Description of Artificial Sequence: Synthetic peptide"
ETWGELIQK

SEQ ID NO: 12633 - protein, 9 aa, Artificial Sequence
  source: /note="Description of Artificial Sequence: Synthetic peptide"
LIQKCLESM

SEQ ID NO: 12634 - protein, 10 aa, Artificial Sequence
  source: /note="Description of Artificial Sequence: Synthetic peptide"
ELIQKCLESM

SEQ ID NO: 12635 - protein, 9 aa, Artificial Sequence
  source: /note="Description of Artificial Sequence: Synthetic peptide"
VLAIDPKNL

SEQ ID NO: 12636 - protein, 9 aa, Artificial Sequence
  source: /note="Description of Artificial Sequence: Synthetic peptide"
KNLAAQEEL

SEQ ID NO: 12637 - protein, 10 aa, Artificial Sequence
  source: /note="Description of Artificial Sequence: Synthetic peptide"
VLAIDPKNLA

SEQ ID NO: 12638 - protein, 9 aa, Artificial Sequence
  source: /note="Description of Artificial Sequence: Synthetic peptide"
KTIITQVKK

SEQ ID NO: 12639 - protein, 9 aa, Artificial Sequence
  source: /note="Description of Artificial Sequence: Synthetic peptide"
LIEKKNMEK

SEQ ID NO: 12640 - protein, 9 aa, Artificial Sequence
  source: /note="Description of Artificial Sequence: Synthetic peptide"
TIITQVKKR

SEQ ID NO: 12641 - protein, 9 aa, Artificial Sequence
  source: /note="Description of Artificial Sequence: Synthetic peptide"
QVKKRKTRL

SEQ ID NO: 12642 - protein, 9 aa, Artificial Sequence
  source: /note="Description of Artificial Sequence: Synthetic peptide"
KKKEKDIHL

SEQ ID NO: 12643 - protein, 9 aa, Artificial Sequence
  source: /note="Description of Artificial Sequence: Synthetic peptide"
KEKDIHLLI

SEQ ID NO: 12644 - protein, 9 aa, Artificial Sequence
  source: /note="Description of Artificial Sequence: Synthetic peptide"
KKNMEKTII

SEQ ID NO: 12645 - protein, 9 aa, Artificial Sequence
  source: /note="Description of Artificial Sequence: Synthetic peptide"
MEKTIITQV

SEQ ID NO: 12646 - protein, 9 aa, Artificial Sequence
  source: /note="Description of Artificial Sequence: Synthetic peptide"
KKRKTRLKI

SEQ ID NO: 12647 - protein, 10 aa, Artificial Sequence
  source: /note="Description of Artificial Sequence: Synthetic peptide"
NMEKTIITQV

SEQ ID NO: 12648 - protein, 10 aa, Artificial Sequence
  source: /note="Description of Artificial Sequence: Synthetic peptide"
LLIEKKNMEK

SEQ ID NO: 12649 - protein, 10 aa, Artificial Sequence
  source: /note="Description of Artificial Sequence: Synthetic peptide"
KTIITQVKKR

SEQ ID NO: 12650 - protein, 10 aa, Artificial Sequence
  source: /note="Description of Artificial Sequence: Synthetic peptide"
TIITQVKKRK

SEQ ID NO: 12651 - protein, 10 aa, Artificial Sequence
  source: /note="Description of Artificial Sequence: Synthetic peptide"
QVKKRKTRLK

SEQ ID NO: 12652 - protein, 10 aa, Artificial Sequence
  source: /note="Description of Artificial Sequence: Synthetic peptide"
ITQVKKRKTR

SEQ ID NO: 12653 - protein, 10 aa, Artificial Sequence
  source: /note="Description of Artificial Sequence: Synthetic peptide"
KKKEKDIHLL

SEQ ID NO: 12654 - protein, 10 aa, Artificial Sequence
  source: /note="Description of Artificial Sequence: Synthetic peptide"
TQVKKRKTRL

SEQ ID NO: 12655 - protein, 10 aa, Artificial Sequence
  source: /note="Description of Artificial Sequence: Synthetic peptide"
KKRKTRLKIL

SEQ ID NO: 12656 - protein, 9 aa, Artificial Sequence
  source: /note="Description of Artificial Sequence: Synthetic peptide"
GSRRSRHQG

SEQ ID NO: 12657 - protein, 9 aa, Artificial Sequence
  source: /note="Description of Artificial Sequence: Synthetic peptide"
RSRHQGSSV

SEQ ID NO: 12658 - protein, 10 aa, Artificial Sequence
  source: /note="Description of Artificial Sequence: Synthetic peptide"
RSRHQGSSVS

SEQ ID NO: 12659 - protein, 10 aa, Artificial Sequence
  source: /note="Description of Artificial Sequence: Synthetic peptide"
RRSRHQGSSV

SEQ ID NO: 12660 - protein, 9 aa, Artificial Sequence
  source: /note="Description of Artificial Sequence: Synthetic peptide"
GSRHHRSHH

SEQ ID NO: 12661 - protein, 10 aa, Artificial Sequence
  source: /note="Description of Artificial Sequence: Synthetic peptide"
QSRHGSRHHR

SEQ ID NO: 12662 - protein, 9 aa, Artificial Sequence
  source: /note="Description of Artificial Sequence: Synthetic peptide"
FGSGQSTGF

SEQ ID NO: 12663 - protein, 10 aa, Artificial Sequence
  source: /note="Description of Artificial Sequence: Synthetic peptide"
GFGSGQSTGF

SEQ ID NO: 12664 - protein, 9 aa, Artificial Sequence
  source: /note="Description of Artificial Sequence: Synthetic peptide"
HVQTGDTTR

SEQ ID NO: 12665 - protein, 9 aa, Artificial Sequence
  source: /note="Description of Artificial Sequence: Synthetic peptide"
HSSQETPNY

SEQ ID NO: 12666 - protein, 9 aa, Artificial Sequence
  source: /note="Description of Artificial Sequence: Synthetic peptide"
TWRVRIHSS

SEQ ID NO: 12667 - protein, 9 aa, Artificial Sequence
  source: /note="Description of Artificial Sequence: Synthetic peptide"
RVRIHSSQE

SEQ ID NO: 12668 - protein, 9 aa, Artificial Sequence
  source: /note="Description of Artificial Sequence: Synthetic peptide"
QVSTWRVRI

SEQ ID NO: 12669 - protein, 9 aa, Artificial Sequence
  source: /note="Description of Artificial Sequence: Synthetic peptide"
TQPSQVSTW

SEQ ID NO: 12670 - protein, 9 aa, Artificial Sequence
  source: /note="Description of Artificial Sequence: Synthetic peptide"
SQETPNYSW

SEQ ID NO: 12671 - protein, 10 aa, Artificial Sequence
  source: /note="Description of Artificial Sequence: Synthetic peptide"
HTHSGHTQPS

SEQ ID NO: 12672 - protein, 10 aa, Artificial Sequence
  source: /note="Description of Artificial Sequence: Synthetic peptide"
RVRIHSSQET

SEQ ID NO: 12673 - protein, 10 aa, Artificial Sequence
  source: /note="Description of Artificial Sequence: Synthetic peptide"
IHSSQETPNY

SEQ ID NO: 12674 - protein, 10 aa, Artificial Sequence
  source: /note="Description of Artificial Sequence: Synthetic peptide"
ETPNYSWTDR

SEQ ID NO: 12675 - protein, 10 aa, Artificial Sequence
  source: /note="Description of Artificial Sequence: Synthetic peptide"
HTQPSQVSTW

SEQ ID NO: 12676 - protein, 10 aa, Artificial Sequence
  source: /note="Description of Artificial Sequence: Synthetic peptide"
SQVSTWRVRI

SEQ ID NO: 12677 - protein, 10 aa, Artificial Sequence
  source: /note="Description of Artificial Sequence: Synthetic peptide"
SSQETPNYSW

SEQ ID NO: 12678 - protein, 10 aa, Artificial Sequence
  source: /note="Description of Artificial Sequence: Synthetic peptide"
QPSQVSTWRV

SEQ ID NO: 12679 - protein, 9 aa, Artificial Sequence
  source: /note="Description of Artificial Sequence: Synthetic peptide"
LVLTTLLGL

SEQ ID NO: 12680 - protein, 9 aa, Artificial Sequence
  source: /note="Description of Artificial Sequence: Synthetic peptide"
TLLGLSAGA

SEQ ID NO: 12681 - protein, 9 aa, Artificial Sequence
  source: /note="Description of Artificial Sequence: Synthetic peptide"
GLSAGATPA

SEQ ID NO: 12682 - protein, 9 aa, Artificial Sequence
  source: /note="Description of Artificial Sequence: Synthetic peptide"
ALCLGAEPA

SEQ ID NO: 12683 - protein, 9 aa, Artificial Sequence
  source: /note="Description of Artificial Sequence: Synthetic peptide"
AQPPKLQHV

SEQ ID NO: 12684 - protein, 9 aa, Artificial Sequence
  source: /note="Description of Artificial Sequence: Synthetic peptide"
ATPAHRCQR

SEQ ID NO: 12685 - protein, 9 aa, Artificial Sequence
  source: /note="Description of Artificial Sequence: Synthetic peptide"
AARAAVCPG

SEQ ID NO: 12686 - protein, 9 aa, Artificial Sequence
  source: /note="Description of Artificial Sequence: Synthetic peptide"
GGGRAQPPK

SEQ ID NO: 12687 - protein, 9 aa, Artificial Sequence
  source: /note="Description of Artificial Sequence: Synthetic peptide"
EPAVHHGAL

SEQ ID NO: 12688 - protein, 9 aa, Artificial Sequence
  source: /note="Description of Artificial Sequence: Synthetic peptide"
HRCQRQQPL

SEQ ID NO: 12689 - protein, 9 aa, Artificial Sequence
  source: /note="Description of Artificial Sequence: Synthetic peptide"
LSAGATPAH

SEQ ID NO: 12690 - protein, 9 aa, Artificial Sequence
  source: /note="Description of Artificial Sequence: Synthetic peptide"
PQGEDLPAF

SEQ ID NO: 12691 - protein, 9 aa, Artificial Sequence
  source: /note="Description of Artificial Sequence: Synthetic peptide"
HEHAARAAV

SEQ ID NO: 12692 - protein, 9 aa, Artificial Sequence
  source: /note="Description of Artificial Sequence: Synthetic peptide"
VQAGRAGGL

SEQ ID NO: 12693 - protein, 9 aa, Artificial Sequence
  source: /note="Description of Artificial Sequence: Synthetic peptide"
RAGGLPQAL

SEQ ID NO: 12694 - protein, 9 aa, Artificial Sequence
  source: /note="Description of Artificial Sequence: Synthetic peptide"
AQRAPQAAG

SEQ ID NO: 12695 - protein, 9 aa, Artificial Sequence
  source: /note="Description of Artificial Sequence: Synthetic peptide"
LQHVTGGTE

SEQ ID NO: 12696 - protein, 9 aa, Artificial Sequence
  source: /note="Description of Artificial Sequence: Synthetic peptide"
LPQGEDLPA

SEQ ID NO: 12697 - protein, 10 aa, Artificial Sequence
  source: /note="Description of Artificial Sequence: Synthetic peptide"
HLVLTTLLGL

SEQ ID NO: 12698 - protein, 10 aa, Artificial Sequence
  source: /note="Description of Artificial Sequence: Synthetic peptide"
VLTTLLGLSA

SEQ ID NO: 12699 - protein, 10 aa, Artificial Sequence
  source: /note="Description of Artificial Sequence: Synthetic peptide"
AVCPGVQAGR

SEQ ID NO: 12700 - protein, 10 aa, Artificial Sequence
  source: /note="Description of Artificial Sequence: Synthetic peptide"
AARAAVCPGV

SEQ ID NO: 12701 - protein, 10 aa, Artificial Sequence
  source: /note="Description of Artificial Sequence: Synthetic peptide"
AGRAGGLPQA

SEQ ID NO: 12702 - protein, 10 aa, Artificial Sequence
  source: /note="Description of Artificial Sequence: Synthetic peptide"
RAQPPKLQHV

SEQ ID NO: 12703 - protein, 10 aa, Artificial Sequence
  source: /note="Description of Artificial Sequence: Synthetic peptide"
LSAGATPAHR

SEQ ID NO: 12704 - protein, 10 aa, Artificial Sequence
  source: /note="Description of Artificial Sequence: Synthetic peptide"
FAGCHEHAAR

SEQ ID NO: 12705 - protein, 10 aa, Artificial Sequence
  source: /note="Description of Artificial Sequence: Synthetic peptide"
TTLLGLSAGA

SEQ ID NO: 12706 - protein, 10 aa, Artificial Sequence
  source: /note="Description of Artificial Sequence: Synthetic peptide"
HVTGGTEEPA

SEQ ID NO: 12707 - protein, 10 aa, Artificial Sequence
  source: /note="Description of Artificial Sequence: Synthetic peptide"
LPQGEDLPAF

SEQ ID NO: 12708 - protein, 10 aa, Artificial Sequence
  source: /note="Description of Artificial Sequence: Synthetic peptide"
LPGPPHPDAL

SEQ ID NO: 12709 - protein, 10 aa, Artificial Sequence
  source: /note="Description of Artificial Sequence: Synthetic peptide"
AHRCQRQQPL

SEQ ID NO: 12710 - protein, 10 aa, Artificial Sequence
  source: /note="Description of Artificial Sequence: Synthetic peptide"
GLSAGATPAH

SEQ ID NO: 12711 - protein, 10 aa, Artificial Sequence
  source: /note="Description of Artificial Sequence: Synthetic peptide"
GRAGGLPQAL

SEQ ID NO: 12712 - protein, 10 aa, Artificial Sequence
  source: /note="Description of Artificial Sequence: Synthetic peptide"
LQHVTGGTEE

SEQ ID NO: 12713 - protein, 10 aa, Artificial Sequence
  source: /note="Description of Artificial Sequence: Synthetic peptide"
EEPAVHHGAL

SEQ ID NO: 12714 - protein, 10 aa, Artificial Sequence
  source: /note="Description of Artificial Sequence: Synthetic peptide"
LPAFAGCHEH

SEQ ID NO: 12715 - protein, 10 aa, Artificial Sequence
  source: /note="Description of Artificial Sequence: Synthetic peptide"
LPQALPGPPH

SEQ ID NO: 12716 - protein, 10 aa, Artificial Sequence
  source: /note="Description of Artificial Sequence: Synthetic peptide"
HEHAARAAVC

SEQ ID NO: 12717 - protein, 10 aa, Artificial Sequence
  source: /note="Description of Artificial Sequence: Synthetic peptide"
AEPAQRAPQA

SEQ ID NO: 12718 - protein, 10 aa, Artificial Sequence
  source: /note="Description of Artificial Sequence: Synthetic peptide"
TEEPAVHHGA

SEQ ID NO: 12719 - protein, 9 aa, Artificial Sequence
  source: /note="Description of Artificial Sequence: Synthetic peptide"
TIKYGGQPM

SEQ ID NO: 12720 - protein, 9 aa, Artificial Sequence
  source: /note="Description of Artificial Sequence: Synthetic peptide"
YGGQPMPNF

SEQ ID NO: 12721 - protein, 10 aa, Artificial Sequence
  source: /note="Description of Artificial Sequence: Synthetic peptide"
KYGGQPMPNF

SEQ ID NO: 12722 - protein, 10 aa, Artificial Sequence
  source: /note="Description of Artificial Sequence: Synthetic peptide"
GQPMPNFPSK

SEQ ID NO: 12723 - protein, 10 aa, Artificial Sequence
  source: /note="Description of Artificial Sequence: Synthetic peptide"
QPMPNFPSKL

SEQ ID NO: 12724 - protein, 10 aa, Artificial Sequence
  source: /note="Description of Artificial Sequence: Synthetic peptide"
MPNFPSKLQV

SEQ ID NO: 12725 - protein, 10 aa, Artificial Sequence
  source: /note="Description of Artificial Sequence: Synthetic peptide"
VTIKYGGQPM

SEQ ID NO: 12726 - protein, 10 aa, Artificial Sequence
  source: /note="Description of Artificial Sequence: Synthetic peptide"
ITWGGTPHSK

SEQ ID NO: 12727 - protein, 10 aa, Artificial Sequence
  source: /note="Description of Artificial Sequence: Synthetic peptide"
YSIAITWGGT

SEQ ID NO: 12728 - protein, 10 aa, Artificial Sequence
  source: /note="Description of Artificial Sequence: Synthetic peptide"
IAITWGGTPH

SEQ ID NO: 12729 - protein, 9 aa, Artificial Sequence
  source: /note="Description of Artificial Sequence: Synthetic peptide"
VLGALGSMV

SEQ ID NO: 12730 - protein, 9 aa, Artificial Sequence
  source: /note="Description of Artificial Sequence: Synthetic peptide"
TTFQRAPLK

SEQ ID NO: 12731 - protein, 9 aa, Artificial Sequence
  source: /note="Description of Artificial Sequence: Synthetic peptide"
LALKRVCRK

SEQ ID NO: 12732 - protein, 9 aa, Artificial Sequence
  source: /note="Description of Artificial Sequence: Synthetic peptide"
TFQRAPLKF

SEQ ID NO: 12733 - protein, 9 aa, Artificial Sequence
  source: /note="Description of Artificial Sequence: Synthetic peptide"
FQRAPLKFK

SEQ ID NO: 12734 - protein, 9 aa, Artificial Sequence
  source: /note="Description of Artificial Sequence: Synthetic peptide"
RAPLKFKLA

SEQ ID NO: 12735 - protein, 9 aa, Artificial Sequence
  source: /note="Description of Artificial Sequence: Synthetic peptide"
PLKFKLALK

SEQ ID NO: 12736 - protein, 9 aa, Artificial Sequence
  source: /note="Description of Artificial Sequence: Synthetic peptide"
KFKLALKRV

SEQ ID NO: 12737 - protein, 9 aa, Artificial Sequence
  source: /note="Description of Artificial Sequence: Synthetic peptide"
KLALKRVCR

SEQ ID NO: 12738 - protein, 9 aa, Artificial Sequence
  source: /note="Description of Artificial Sequence: Synthetic peptide"
RVCRKSVLG

SEQ ID NO: 12739 - protein, 9 aa, Artificial Sequence
  source: /note="Description of Artificial Sequence: Synthetic peptide"
TWGDTTFQR

SEQ ID NO: 12740 - protein, 9 aa, Artificial Sequence
  source: /note="Description of Artificial Sequence: Synthetic peptide"
MVGLSGGQR

SEQ ID NO: 12741 - protein, 9 aa, Artificial Sequence
  source: /note="Description of Artificial Sequence: Synthetic peptide"
DTTFQRAPL

SEQ ID NO: 12742 - protein, 9 aa, Artificial Sequence
  source: /note="Description of Artificial Sequence: Synthetic peptide"
APLKFKLAL

SEQ ID NO: 12743 - protein, 9 aa, Artificial Sequence
  source: /note="Description of Artificial Sequence: Synthetic peptide"
AITWGDTTF

SEQ ID NO: 12744 - protein, 9 aa, Artificial Sequence
  source: /note="Description of Artificial Sequence: Synthetic peptide"
SVLGALGSM

SEQ ID NO: 12745 - protein, 9 aa, Artificial Sequence
  source: /note="Description of Artificial Sequence: Synthetic peptide"
KRVCRKSVL

SEQ ID NO: 12746 - protein, 9 aa, Artificial Sequence
  source: /note="Description of Artificial Sequence: Synthetic peptide"
LSGGQRTSW

SEQ ID NO: 12747 - protein, 10 aa, Artificial Sequence
  source: /note="Description of Artificial Sequence: Synthetic peptide"
SVLGALGSMV

SEQ ID NO: 12748 - protein, 10 aa, Artificial Sequence
  source: /note="Description of Artificial Sequence: Synthetic peptide"
ALKRVCRKSV

SEQ ID NO: 12749 - protein, 10 aa, Artificial Sequence
  source: /note="Description of Artificial Sequence: Synthetic peptide"
KLALKRVCRK

SEQ ID NO: 12750 - protein, 10 aa, Artificial Sequence
  source: /note="Description of Artificial Sequence: Synthetic peptide"
ITWGDTTFQR

SEQ ID NO: 12751 - protein, 10 aa, Artificial Sequence
  source: /note="Description of Artificial Sequence: Synthetic peptide"
TFQRAPLKFK

SEQ ID NO: 12752 - protein, 10 aa, Artificial Sequence
  source: /note="Description of Artificial Sequence: Synthetic peptide"
IAITWGDTTF

SEQ ID NO: 12753 - protein, 10 aa, Artificial Sequence
  source: /note="Description of Artificial Sequence: Synthetic peptide"
TTFQRAPLKF

SEQ ID NO: 12754 - protein, 10 aa, Artificial Sequence
  source: /note="Description of Artificial Sequence: Synthetic peptide"
RVCRKSVLGA

SEQ ID NO: 12755 - protein, 10 aa, Artificial Sequence
  source: /note="Description of Artificial Sequence: Synthetic peptide"
DTTFQRAPLK

SEQ ID NO: 12756 - protein, 10 aa, Artificial Sequence
  source: /note="Description of Artificial Sequence: Synthetic peptide"
RAPLKFKLAL

SEQ ID NO: 12757 - protein, 10 aa, Artificial Sequence
  source: /note="Description of Artificial Sequence: Synthetic peptide"
LKRVCRKSVL

SEQ ID NO: 12758 - protein, 10 aa, Artificial Sequence
  source: /note="Description of Artificial Sequence: Synthetic peptide"
KSVLGALGSM

SEQ ID NO: 12759 - protein, 10 aa, Artificial Sequence
  source: /note="Description of Artificial Sequence: Synthetic peptide"
FQRAPLKFKL

SEQ ID NO: 12760 - protein, 10 aa, Artificial Sequence
  source: /note="Description of Artificial Sequence: Synthetic peptide"
LKFKLALKRV

SEQ ID NO: 12761 - protein, 10 aa, Artificial Sequence
  source: /note="Description of Artificial Sequence: Synthetic peptide"
GLSGGQRTSW

SEQ ID NO: 12762 - protein, 9 aa, Artificial Sequence
  source: /note="Description of Artificial Sequence: Synthetic peptide"
YEYDFREYE

SEQ ID NO: 12763 - protein, 9 aa, Artificial Sequence
  source: /note="Description of Artificial Sequence: Synthetic peptide"
REYEYDFRE

SEQ ID NO: 12764 - protein, 10 aa, Artificial Sequence
  source: /note="Description of Artificial Sequence: Synthetic peptide"
REYEYDFREY

SEQ ID NO: 12765 - protein, 10 aa, Artificial Sequence
  source: /note="Description of Artificial Sequence: Synthetic peptide"
YEYDFREYEY

SEQ ID NO: 12766 - protein, 10 aa, Artificial Sequence
  source: /note="Description of Artificial Sequence: Synthetic peptide"
DFREYEYDFR

SEQ ID NO: 12767 - protein, 10 aa, Artificial Sequence
  source: /note="Description of Artificial Sequence: Synthetic peptide"
VDFREYEYDF

SEQ ID NO: 12768 - protein, 10 aa, Artificial Sequence
  source: /note="Description of Artificial Sequence: Synthetic peptide"
YDFREYEYDL

SEQ ID NO: 12769 - protein, 9 aa, Artificial Sequence
  source: /note="Description of Artificial Sequence: Synthetic peptide"
HIMSDSNYV

SEQ ID NO: 12770 - protein, 9 aa, Artificial Sequence
  source: /note="Description of Artificial Sequence: Synthetic peptide"
RHIMSDSNY

SEQ ID NO: 12771 - protein, 9 aa, Artificial Sequence
  source: /note="Description of Artificial Sequence: Synthetic peptide"
CDFGLARHI

SEQ ID NO: 12772 - protein, 10 aa, Artificial Sequence
  source: /note="Description of Artificial Sequence: Synthetic peptide"
HIMSDSNYVV

SEQ ID NO: 12773 - protein, 10 aa, Artificial Sequence
  source: /note="Description of Artificial Sequence: Synthetic peptide"
CDFGLARHIM

SEQ ID NO: 12774 - protein, 10 aa, Artificial Sequence
  source: /note="Description of Artificial Sequence: Synthetic peptide"
ARHIMSDSNY

SEQ ID NO: 12775 - protein, 10 aa, Artificial Sequence
  source: /note="Description of Artificial Sequence: Synthetic peptide"
RHIMSDSNYV

SEQ ID NO: 12776 - protein, 9 aa, Artificial Sequence
  source: /note="Description of Artificial Sequence: Synthetic peptide"
ICDFGLARY

SEQ ID NO: 12777 - protein, 9 aa, Artificial Sequence
  source: /note="Description of Artificial Sequence: Synthetic peptide"
YIMSDSNYV

SEQ ID NO: 12778 - protein, 9 aa, Artificial Sequence
  source: /note="Description of Artificial Sequence: Synthetic peptide"
RYIMSDSNY

SEQ ID NO: 12779 - protein, 9 aa, Artificial Sequence
  source: /note="Description of Artificial Sequence: Synthetic peptide"
CDFGLARYI

SEQ ID NO: 12780 - protein, 10 aa, Artificial Sequence
  source: /note="Description of Artificial Sequence: Synthetic peptide"
YIMSDSNYVV

SEQ ID NO: 12781 - protein, 10 aa, Artificial Sequence
  source: /note="Description of Artificial Sequence: Synthetic peptide"
KICDFGLARY

SEQ ID NO: 12782 - protein, 10 aa, Artificial Sequence
  source: /note="Description of Artificial Sequence: Synthetic peptide"
RYIMSDSNYV

SEQ ID NO: 12783 - protein, 10 aa, Artificial Sequence
  source: /note="Description of Artificial Sequence: Synthetic peptide"
CDFGLARYIM

SEQ ID NO: 12784 - protein, 10 aa, Artificial Sequence
  source: /note="Description of Artificial Sequence: Synthetic peptide"
ARYIMSDSNY

SEQ ID NO: 12785 - protein, 9 aa, Artificial Sequence
  source: /note="Description of Artificial Sequence: Synthetic peptide"
EIMSDSNYV

SEQ ID NO: 12786 - protein, 9 aa, Artificial Sequence
  source: /note="Description of Artificial Sequence: Synthetic peptide"
REIMSDSNY

SEQ ID NO: 12787 - protein, 9 aa, Artificial Sequence
  source: /note="Description of Artificial Sequence: Synthetic peptide"
CDFGLAREI

SEQ ID NO: 12788 - protein, 10 aa, Artificial Sequence
  source: /note="Description of Artificial Sequence: Synthetic peptide"
EIMSDSNYVV

SEQ ID NO: 12789 - protein, 10 aa, Artificial Sequence
  source: /note="Description of Artificial Sequence: Synthetic peptide"
CDFGLAREIM

SEQ ID NO: 12790 - protein, 10 aa, Artificial Sequence
  source: /note="Description of Artificial Sequence: Synthetic peptide"
AREIMSDSNY

SEQ ID NO: 12791 - protein, 10 aa, Artificial Sequence
  source: /note="Description of Artificial Sequence: Synthetic peptide"
REIMSDSNYV

SEQ ID NO: 12792 - protein, 9 aa, Artificial Sequence
  source: /note="Description of Artificial Sequence: Synthetic peptide"
FPTEEGGVL

SEQ ID NO: 12793 - protein, 9 aa, Artificial Sequence
  source: /note="Description of Artificial Sequence: Synthetic peptide"
LEAKSIQTF

SEQ ID NO: 12794 - protein, 10 aa, Artificial Sequence
  source: /note="Description of Artificial Sequence: Synthetic peptide"
QTFPTEEGGV

SEQ ID NO: 12795 - protein, 10 aa, Artificial Sequence
  source: /note="Description of Artificial Sequence: Synthetic peptide"
ILEAKSIQTF

SEQ ID NO: 12796 - protein, 10 aa, Artificial Sequence
  source: /note="Description of Artificial Sequence: Synthetic peptide"
FPTEEGGVLT

SEQ ID NO: 12797 - protein, 9 aa, Artificial Sequence
  source: /note="Description of Artificial Sequence: Synthetic peptide"
AGIPTPPPL

SEQ ID NO: 12798 - protein, 9 aa, Artificial Sequence
  source: /note="Description of Artificial Sequence: Synthetic peptide"
SLQRGLQLT

SEQ ID NO: 12799 - protein, 9 aa, Artificial Sequence
  source: /note="Description of Artificial Sequence: Synthetic peptide"
RSLQRGLQL

SEQ ID NO: 12800 - protein, 9 aa, Artificial Sequence
  source: /note="Description of Artificial Sequence: Synthetic peptide"
QLTQREFVR

SEQ ID NO: 12801 - protein, 9 aa, Artificial Sequence
  source: /note="Description of Artificial Sequence: Synthetic peptide"
LQRGLQLTQ

SEQ ID NO: 12802 - protein, 9 aa, Artificial Sequence
  source: /note="Description of Artificial Sequence: Synthetic peptide"
GLQLTQREF

SEQ ID NO: 12803 - protein, 9 aa, Artificial Sequence
  source: /note="Description of Artificial Sequence: Synthetic peptide"
LQLTQREFV

SEQ ID NO: 12804 - protein, 10 aa, Artificial Sequence
  source: /note="Description of Artificial Sequence: Synthetic peptide"
GLQLTQREFV

SEQ ID NO: 12805 - protein, 10 aa, Artificial Sequence
  source: /note="Description of Artificial Sequence: Synthetic peptide"
RGLQLTQREF

SEQ ID NO: 12806 - protein, 9 aa, Artificial Sequence
  source: /note="Description of Artificial Sequence: Synthetic peptide"
CLFFHWLKL

SEQ ID NO: 12807 - protein, 9 aa, Artificial Sequence
  source: /note="Description of Artificial Sequence: Synthetic peptide"
RLQKPCLFF

SEQ ID NO: 12808 - protein, 9 aa, Artificial Sequence
  source: /note="Description of Artificial Sequence: Synthetic peptide"
LFFHWLKLF

SEQ ID NO: 12809 - protein, 9 aa, Artificial Sequence
  source: /note="Description of Artificial Sequence: Synthetic peptide"
LQKPCLFFH

SEQ ID NO: 12810 - protein, 10 aa, Artificial Sequence
  source: /note="Description of Artificial Sequence: Synthetic peptide"
RLQKPCLFFH

SEQ ID NO: 12811 - protein, 10 aa, Artificial Sequence
  source: /note="Description of Artificial Sequence: Synthetic peptide"
LQKPCLFFHW

SEQ ID NO: 12812 - protein, 10 aa, Artificial Sequence
  source: /note="Description of Artificial Sequence: Synthetic peptide"
CLFFHWLKLF

SEQ ID NO: 12813 - protein, 10 aa, Artificial Sequence
  source: /note="Description of Artificial Sequence: Synthetic peptide"
KPCLFFHWLK

SEQ ID NO: 12814 - protein, 10 aa, Artificial Sequence
  source: /note="Description of Artificial Sequence: Synthetic peptide"
GRLQKPCLFF

SEQ ID NO: 12815 - protein, 9 aa, Artificial Sequence
  source: /note="Description of Artificial Sequence: Synthetic peptide"
FSIRSFCTV

SEQ ID NO: 12816 - protein, 9 aa, Artificial Sequence
  source: /note="Description of Artificial Sequence: Synthetic peptide"
SIRSFCTVV

SEQ ID NO: 12817 - protein, 9 aa, Artificial Sequence
  source: /note="Description of Artificial Sequence: Synthetic peptide"
RSFCTVVDV

SEQ ID NO: 12818 - protein, 9 aa, Artificial Sequence
  source: /note="Description of Artificial Sequence: Synthetic peptide"
INEFSIRSF

SEQ ID NO: 12819 - protein, 10 aa, Artificial Sequence
  source: /note="Description of Artificial Sequence: Synthetic peptide"
FSIRSFCTVV

SEQ ID NO: 12820 - protein, 10 aa, Artificial Sequence
  source: /note="Description of Artificial Sequence: Synthetic peptide"
RSFCTVVDVV

SEQ ID NO: 12821 - protein, 10 aa, Artificial Sequence
  source: /note="Description of Artificial Sequence: Synthetic peptide"
RINEFSIRSF

SEQ ID NO: 12822 - protein, 10 aa, Artificial Sequence
  source: /note="Description of Artificial Sequence: Synthetic peptide"
NEFSIRSFCT

SEQ ID NO: 12823 - protein, 9 aa, Artificial Sequence
  source: /note="Description of Artificial Sequence: Synthetic peptide"
FTDVCAAVY

SEQ ID NO: 12824 - protein, 10 aa, Artificial Sequence
  source: /note="Description of Artificial Sequence: Synthetic peptide"
GPFTDVCAAV

SEQ ID NO: 12825 - protein, 9 aa, Artificial Sequence
  source: /note="Description of Artificial Sequence: Synthetic peptide"
APSAATTTA

SEQ ID NO: 12826 - protein, 10 aa, Artificial Sequence
  source: /note="Description of Artificial Sequence: Synthetic peptide"
ATTTAVTAAA

SEQ ID NO: 12827 - protein, 10 aa, Artificial Sequence
  source: /note="Description of Artificial Sequence: Synthetic peptide"
APSAATTTAV

SEQ ID NO: 12828 - protein, 9 aa, Artificial Sequence
  source: /note="Description of Artificial Sequence: Synthetic peptide"
HAVGSLHPK

SEQ ID NO: 12829 - protein, 9 aa, Artificial Sequence
  source: /note="Description of Artificial Sequence: Synthetic peptide"
DEHAVGSLH

SEQ ID NO: 12830 - protein, 10 aa, Artificial Sequence
  source: /note="Description of Artificial Sequence: Synthetic peptide"
DEDEHAVGSL

SEQ ID NO: 12831 - protein, 10 aa, Artificial Sequence
  source: /note="Description of Artificial Sequence: Synthetic peptide"
AEDEEEDAGF

SEQ ID NO: 12832 - protein, 9 aa, Artificial Sequence
  source: /note="Description of Artificial Sequence: Synthetic peptide"
KVLPQSSVA

SEQ ID NO: 12833 - protein, 9 aa, Artificial Sequence
  source: /note="Description of Artificial Sequence: Synthetic peptide"
YESWTKKVL

SEQ ID NO: 12834 - protein, 9 aa, Artificial Sequence
  source: /note="Description of Artificial Sequence: Synthetic peptide"
KKVLPQSSV

SEQ ID NO: 12835 - protein, 10 aa, Artificial Sequence
  source: /note="Description of Artificial Sequence: Synthetic peptide"
SLYESWTKKV

SEQ ID NO: 12836 - protein, 10 aa, Artificial Sequence
  source: /note="Description of Artificial Sequence: Synthetic peptide"
LYESWTKKVL

SEQ ID NO: 12837 - protein, 10 aa, Artificial Sequence
  source: /note="Description of Artificial Sequence: Synthetic peptide"
KKVLPQSSVA

SEQ ID NO: 12838 - protein, 9 aa, Artificial Sequence
  source: /note="Description of Artificial Sequence: Synthetic peptide"
KNFTEISSK

SEQ ID NO: 12839 - protein, 9 aa, Artificial Sequence
  source: /note="Description of Artificial Sequence: Synthetic peptide"
NFTEISSKF

SEQ ID NO: 12840 - protein, 9 aa, Artificial Sequence
  source: /note="Description of Artificial Sequence: Synthetic peptide"
EISSKFSER

SEQ ID NO: 12841 - protein, 9 aa, Artificial Sequence
  source: /note="Description of Artificial Sequence: Synthetic peptide"
ISSKFSERL

SEQ ID NO: 12842 - protein, 10 aa, Artificial Sequence
  source: /note="Description of Artificial Sequence: Synthetic peptide"
EISSKFSERL

SEQ ID NO: 12843 - protein, 10 aa, Artificial Sequence
  source: /note="Description of Artificial Sequence: Synthetic peptide"
KNFTEISSKF

SEQ ID NO: 12844 - protein, 9 aa, Artificial Sequence
  source: /note="Description of Artificial Sequence: Synthetic peptide"
RARCGRAPV

SEQ ID NO: 12845 - protein, 9 aa, Artificial Sequence
  source: /note="Description of Artificial Sequence: Synthetic peptide"
CGRAPVGLV

SEQ ID NO: 12846 - protein, 9 aa, Artificial Sequence
  source: /note="Description of Artificial Sequence: Synthetic peptide"
EVSGSGGGL

SEQ ID NO: 12847 - protein, 9 aa, Artificial Sequence
  source: /note="Description of Artificial Sequence: Synthetic peptide"
APVGLVGAA

SEQ ID NO: 12848 - protein, 10 aa, Artificial Sequence
  source: /note="Description of Artificial Sequence: Synthetic peptide"
RARCGRAPVG

SEQ ID NO: 12849 - protein, 10 aa, Artificial Sequence
  source: /note="Description of Artificial Sequence: Synthetic peptide"
AEVSGSGGGL

SEQ ID NO: 12850 - protein, 9 aa, Artificial Sequence
  source: /note="Description of Artificial Sequence: Synthetic peptide"
WQNSIWHNL

SEQ ID NO: 12851 - protein, 9 aa, Artificial Sequence
  source: /note="Description of Artificial Sequence: Synthetic peptide"
NSIWHNLSL

SEQ ID NO: 12852 - protein, 9 aa, Artificial Sequence
  source: /note="Description of Artificial Sequence: Synthetic peptide"
WHNLSLNRY

SEQ ID NO: 12853 - protein, 10 aa, Artificial Sequence
  source: /note="Description of Artificial Sequence: Synthetic peptide"
SIWHNLSLNR

SEQ ID NO: 12854 - protein, 10 aa, Artificial Sequence
  source: /note="Description of Artificial Sequence: Synthetic peptide"
GWQNSIWHNL

SEQ ID NO: 12855 - protein, 10 aa, Artificial Sequence
  source: /note="Description of Artificial Sequence: Synthetic peptide"
IWHNLSLNRY

SEQ ID NO: 12856 - protein, 10 aa, Artificial Sequence
  source: /note="Description of Artificial Sequence: Synthetic peptide"
WHNLSLNRYF

SEQ ID NO: 12857 - protein, 9 aa, Artificial Sequence
  source: /note="Description of Artificial Sequence: Synthetic peptide"
TMPGRTPTA

SEQ ID NO: 12858 - protein, 9 aa, Artificial Sequence
  source: /note="Description of Artificial Sequence: Synthetic peptide"
LTCPTMPGR

SEQ ID NO: 12859 - protein, 9 aa, Artificial Sequence
  source: /note="Description of Artificial Sequence: Synthetic peptide"
AASYLWPSR

SEQ ID NO: 12860 - protein, 9 aa, Artificial Sequence
  source: /note="Description of Artificial Sequence: Synthetic peptide"
SYLWPSRTL

SEQ ID NO: 12861 - protein, 9 aa, Artificial Sequence
  source: /note="Description of Artificial Sequence: Synthetic peptide"
DTPHPLPTL

SEQ ID NO: 12862 - protein, 9 aa, Artificial Sequence
  source: /note="Description of Artificial Sequence: Synthetic peptide"
SAASYLWPS

SEQ ID NO: 12863 - protein, 9 aa, Artificial Sequence
  source: /note="Description of Artificial Sequence: Synthetic peptide"
LPTLTCPTM

SEQ ID NO: 12864 - protein, 9 aa, Artificial Sequence
  source: /note="Description of Artificial Sequence: Synthetic peptide"
PPTPSAASY

SEQ ID NO: 12865 - protein, 9 aa, Artificial Sequence
  source: /note="Description of Artificial Sequence: Synthetic peptide"
TPSAASYLW

SEQ ID NO: 12866 - protein, 10 aa, Artificial Sequence
  source: /note="Description of Artificial Sequence: Synthetic peptide"
SAASYLWPSR

SEQ ID NO: 12867 - protein, 10 aa, Artificial Sequence
  source: /note="Description of Artificial Sequence: Synthetic peptide"
ASYLWPSRTL

SEQ ID NO: 12868 - protein, 10 aa, Artificial Sequence
  source: /note="Description of Artificial Sequence: Synthetic peptide"
TLTCPTMPGR

SEQ ID NO: 12869 - protein, 10 aa, Artificial Sequence
  source: /note="Description of Artificial Sequence: Synthetic peptide"
HPLPTLTCPT

SEQ ID NO: 12870 - protein, 10 aa, Artificial Sequence
  source: /note="Description of Artificial Sequence: Synthetic peptide"
CPTMPGRTPT

SEQ ID NO: 12871 - protein, 10 aa, Artificial Sequence
  source: /note="Description of Artificial Sequence: Synthetic peptide"
WPSRTLQPSA

SEQ ID NO: 12872 - protein, 10 aa, Artificial Sequence
  source: /note="Description of Artificial Sequence: Synthetic peptide"
NPPTPSAASY

SEQ ID NO: 12873 - protein, 9 aa, Artificial Sequence
  source: /note="Description of Artificial Sequence: Synthetic peptide"
AIRDLAGGR

SEQ ID NO: 12874 - protein, 9 aa, Artificial Sequence
  source: /note="Description of Artificial Sequence: Synthetic peptide"
IAMAIRDLA

SEQ ID NO: 12875 - protein, 10 aa, Artificial Sequence
  source: /note="Description of Artificial Sequence: Synthetic peptide"
ALIAMAIRDL

SEQ ID NO: 12876 - protein, 10 aa, Artificial Sequence
  source: /note="Description of Artificial Sequence: Synthetic peptide"
LIAMAIRDLA

SEQ ID NO: 12877 - protein, 10 aa, Artificial Sequence
  source: /note="Description of Artificial Sequence: Synthetic peptide"
AIRDLAGGRL

SEQ ID NO: 12878 - protein, 10 aa, Artificial Sequence
  source: /note="Description of Artificial Sequence: Synthetic peptide"
MAIRDLAGGR

SEQ ID NO: 12879 - protein, 10 aa, Artificial Sequence
  source: /note="Description of Artificial Sequence: Synthetic peptide"
RDLAGGRLTL

SEQ ID NO: 12880 - protein, 9 aa, Artificial Sequence
  source: /note="Description of Artificial Sequence: Synthetic peptide"
SLFSASFLL

SEQ ID NO: 12881 - protein, 9 aa, Artificial Sequence
  source: /note="Description of Artificial Sequence: Synthetic peptide"
FSASFLLNI

SEQ ID NO: 12882 - protein, 9 aa, Artificial Sequence
  source: /note="Description of Artificial Sequence: Synthetic peptide"
FLLNINEYL

SEQ ID NO: 12883 - protein, 9 aa, Artificial Sequence
  source: /note="Description of Artificial Sequence: Synthetic peptide"
LLNINEYLA

SEQ ID NO: 12884 - protein, 9 aa, Artificial Sequence
  source: /note="Description of Artificial Sequence: Synthetic peptide"
SFLLNINEY

SEQ ID NO: 12885 - protein, 9 aa, Artificial Sequence
  source: /note="Description of Artificial Sequence: Synthetic peptide"
LNINEYLAV

SEQ ID NO: 12886 - protein, 10 aa, Artificial Sequence
  source: /note="Description of Artificial Sequence: Synthetic peptide"
FLLNINEYLA

SEQ ID NO: 12887 - protein, 10 aa, Artificial Sequence
  source: /note="Description of Artificial Sequence: Synthetic peptide"
LLNINEYLAV

SEQ ID NO: 12888 - protein, 10 aa, Artificial Sequence
  source: /note="Description of Artificial Sequence: Synthetic peptide"
ASFLLNINEY

SEQ ID NO: 12889 - protein, 10 aa, Artificial Sequence
  source: /note="Description of Artificial Sequence: Synthetic peptide"
LFSASFLLNI

SEQ ID NO: 12890 - protein, 10 aa, Artificial Sequence
  source: /note="Description of Artificial Sequence: Synthetic peptide"
SFLLNINEYL

SEQ ID NO: 12891 - protein, 10 aa, Artificial Sequence
  source: /note="Description of Artificial Sequence: Synthetic peptide"
LSLFSASFLL

SEQ ID NO: 12892 - protein, 10 aa, Artificial Sequence
  source: /note="Description of Artificial Sequence: Synthetic peptide"
LNINEYLAVV

SEQ ID NO: 12893 - protein, 9 aa, Artificial Sequence
  source: /note="Description of Artificial Sequence: Synthetic peptide"
SARGVTTQV

SEQ ID NO: 12894 - protein, 9 aa, Artificial Sequence
  source: /note="Description of Artificial Sequence: Synthetic peptide"
GVTTQVAAR

SEQ ID NO: 12895 - protein, 9 aa, Artificial Sequence
  source: /note="Description of Artificial Sequence: Synthetic peptide"
VTTQVAARR

SEQ ID NO: 12896 - protein, 9 aa, Artificial Sequence
  source: /note="Description of Artificial Sequence: Synthetic peptide"
LAAASARGV

SEQ ID NO: 12897 - protein, 10 aa, Artificial Sequence
  source: /note="Description of Artificial Sequence: Synthetic peptide"
FLAAASARGV

SEQ ID NO: 12898 - protein, 10 aa, Artificial Sequence
  source: /note="Description of Artificial Sequence: Synthetic peptide"
ASARGVTTQV

SEQ ID NO: 12899 - protein, 10 aa, Artificial Sequence
  source: /note="Description of Artificial Sequence: Synthetic peptide"
SARGVTTQVA

SEQ ID NO: 12900 - protein, 9 aa, Artificial Sequence
  source: /note="Description of Artificial Sequence: Synthetic peptide"
CYHGHIHLV

SEQ ID NO: 12901 - protein, 9 aa, Artificial Sequence
  source: /note="Description of Artificial Sequence: Synthetic peptide"
HIHLVQFLL

SEQ ID NO: 12902 - protein, 9 aa, Artificial Sequence
  source: /note="Description of Artificial Sequence: Synthetic peptide"
ACYHGHIHL

SEQ ID NO: 12903 - protein, 9 aa, Artificial Sequence
  source: /note="Description of Artificial Sequence: Synthetic peptide"
HGHIHLVQF

SEQ ID NO: 12904 - protein, 9 aa, Artificial Sequence
  source: /note="Description of Artificial Sequence: Synthetic peptide"
GHIHLVQFL

SEQ ID NO: 12905 - protein, 10 aa, Artificial Sequence
  source: /note="Description of Artificial Sequence: Synthetic peptide"
YHGHIHLVQF

SEQ ID NO: 12906 - protein, 10 aa, Artificial Sequence
  source: /note="Description of Artificial Sequence: Synthetic peptide"
HSACYHGHIH

SEQ ID NO: 12907 - protein, 10 aa, Artificial Sequence
  source: /note="Description of Artificial Sequence: Synthetic peptide"
SACYHGHIHL

SEQ ID NO: 12908 - protein, 10 aa, Artificial Sequence
  source: /note="Description of Artificial Sequence: Synthetic peptide"
GHIHLVQFLL

SEQ ID NO: 12909 - protein, 9 aa, Artificial Sequence
  source: /note="Description of Artificial Sequence: Synthetic peptide"
FQMTRTVTT

SEQ ID NO: 12910 - protein, 9 aa, Artificial Sequence
  source: /note="Description of Artificial Sequence: Synthetic peptide"
QMTRTVTTI

SEQ ID NO: 12911 - protein, 9 aa, Artificial Sequence
  source: /note="Description of Artificial Sequence: Synthetic peptide"
WVAGFQMTR

SEQ ID NO: 12912 - protein, 9 aa, Artificial Sequence
  source: /note="Description of Artificial Sequence: Synthetic peptide"
VIWVAGFQM

SEQ ID NO: 12913 - protein, 9 aa, Artificial Sequence
  source: /note="Description of Artificial Sequence: Synthetic peptide"
AGFQMTRTV

SEQ ID NO: 12914 - protein, 10 aa, Artificial Sequence
  source: /note="Description of Artificial Sequence: Synthetic peptide"
FQMTRTVTTI

SEQ ID NO: 12915 - protein, 10 aa, Artificial Sequence
  source: /note="Description of Artificial Sequence: Synthetic peptide"
IWVAGFQMTR

SEQ ID NO: 12916 - protein, 10 aa, Artificial Sequence
  source: /note="Description of Artificial Sequence: Synthetic peptide"
LVIWVAGFQM

SEQ ID NO: 12917 - protein, 9 aa, Artificial Sequence
  source: /note="Description of Artificial Sequence: Synthetic peptide"
WEDGPCKVF

SEQ ID NO: 12918 - protein, 9 aa, Artificial Sequence
  source: /note="Description of Artificial Sequence: Synthetic peptide"
FECRGAQVT

SEQ ID NO: 12919 - protein, 10 aa, Artificial Sequence
  source: /note="Description of Artificial Sequence: Synthetic peptide"
KVFECRGAQV

SEQ ID NO: 12920 - protein, 10 aa, Artificial Sequence
  source: /note="Description of Artificial Sequence: Synthetic peptide"
KWEDGPCKVF

SEQ ID NO: 12921 - protein, 9 aa, Artificial Sequence
  source: /note="Description of Artificial Sequence: Synthetic peptide"
FTLGAPHKV

SEQ ID NO: 12922 - protein, 10 aa, Artificial Sequence
  source: /note="Description of Artificial Sequence: Synthetic peptide"
DELVGHSDAT

SEQ ID NO: 12923 - protein, 9 aa, Artificial Sequence
  source: /note="Description of Artificial Sequence: Synthetic peptide"
GPKEQWEPV

SEQ ID NO: 12924 - protein, 9 aa, Artificial Sequence
  source: /note="Description of Artificial Sequence: Synthetic peptide"
DAIGPKEQW

SEQ ID NO: 12925 - protein, 10 aa, Artificial Sequence
  source: /note="Description of Artificial Sequence: Synthetic peptide"
VGHSDAIGPK

SEQ ID NO: 12926 - protein, 9 aa, Artificial Sequence
  source: /note="Description of Artificial Sequence: Synthetic peptide"
GPREKWEPV

SEQ ID NO: 12927 - protein, 9 aa, Artificial Sequence
  source: /note="Description of Artificial Sequence: Synthetic peptide"
DAIGPREKW

SEQ ID NO: 12928 - protein, 10 aa, Artificial Sequence
  source: /note="Description of Artificial Sequence: Synthetic peptide"
HSDAIGPREK

SEQ ID NO: 12929 - protein, 10 aa, Artificial Sequence
  source: /note="Description of Artificial Sequence: Synthetic peptide"
KWEPVFQNGK

SEQ ID NO: 12930 - protein, 10 aa, Artificial Sequence
  source: /note="Description of Artificial Sequence: Synthetic peptide"
GPREKWEPVF

SEQ ID NO: 12931 - protein, 9 aa, Artificial Sequence
  source: /note="Description of Artificial Sequence: Synthetic peptide"
GPREQWEQV

SEQ ID NO: 12932 - protein, 9 aa, Artificial Sequence
  source: /note="Description of Artificial Sequence: Synthetic peptide"
EQVFQNGKM

SEQ ID NO: 12933 - protein, 10 aa, Artificial Sequence
  source: /note="Description of Artificial Sequence: Synthetic peptide"
GPREQWEQVF

SEQ ID NO: 12934 - protein, 10 aa, Artificial Sequence
  source: /note="Description of Artificial Sequence: Synthetic peptide"
WEQVFQNGKM

SEQ ID NO: 12935 - protein, 10 aa, Artificial Sequence
  source: /note="Description of Artificial Sequence: Synthetic peptide"
QVFQNGKMAL

SEQ ID NO: 12936 - protein, 10 aa, Artificial Sequence
  source: /note="Description of Artificial Sequence: Synthetic peptide"
REQWEQVFQN

SEQ ID NO: 12937 - protein, 9 aa, Artificial Sequence
  source: /note="Description of Artificial Sequence: Synthetic peptide"
FQNGKVALL

SEQ ID NO: 12938 - protein, 10 aa, Artificial Sequence
  source: /note="Description of Artificial Sequence: Synthetic peptide"
FQNGKVALLA

SEQ ID NO: 12939 - protein, 10 aa, Artificial Sequence
  source: /note="Description of Artificial Sequence: Synthetic peptide"
VFQNGKVALL

SEQ ID NO: 12940 - protein, 10 aa, Artificial Sequence
  source: /note="Description of Artificial Sequence: Synthetic peptide"
VALLASNSCF

SEQ ID NO: 12941 - protein, 10 aa, Artificial Sequence
  source: /note="Description of Artificial Sequence: Synthetic peptide"
WEPVFQNGKV

SEQ ID NO: 12942 - protein, 9 aa, Artificial Sequence
  source: /note="Description of Artificial Sequence: Synthetic peptide"
FQNGKMPLL

SEQ ID NO: 12943 - protein, 9 aa, Artificial Sequence
  source: /note="Description of Artificial Sequence: Synthetic peptide"
VFQNGKMPL

SEQ ID NO: 12944 - protein, 9 aa, Artificial Sequence
  source: /note="Description of Artificial Sequence: Synthetic peptide"
MPLLASNSC

SEQ ID NO: 12945 - protein, 9 aa, Artificial Sequence
  source: /note="Description of Artificial Sequence: Synthetic peptide"
PLLASNSCF

SEQ ID NO: 12946 - protein, 10 aa, Artificial Sequence
  source: /note="Description of Artificial Sequence: Synthetic peptide"
FQNGKMPLLA

SEQ ID NO: 12947 - protein, 10 aa, Artificial Sequence
  source: /note="Description of Artificial Sequence: Synthetic peptide"
VFQNGKMPLL

SEQ ID NO: 12948 - protein, 10 aa, Artificial Sequence
  source: /note="Description of Artificial Sequence: Synthetic peptide"
MPLLASNSCF

SEQ ID NO: 12949 - protein, 9 aa, Artificial Sequence
  source: /note="Description of Artificial Sequence: Synthetic peptide"
SASNSCFIR

SEQ ID NO: 12950 - protein, 9 aa, Artificial Sequence
  source: /note="Description of Artificial Sequence: Synthetic peptide"
LSASNSCFI

SEQ ID NO: 12951 - protein, 9 aa, Artificial Sequence
  source: /note="Description of Artificial Sequence: Synthetic peptide"
ALSASNSCF

SEQ ID NO: 12952 - protein, 10 aa, Artificial Sequence
  source: /note="Description of Artificial Sequence: Synthetic peptide"
FQNGKMALSA

SEQ ID NO: 12953 - protein, 10 aa, Artificial Sequence
  source: /note="Description of Artificial Sequence: Synthetic peptide"
ALSASNSCFI

SEQ ID NO: 12954 - protein, 10 aa, Artificial Sequence
  source: /note="Description of Artificial Sequence: Synthetic peptide"
KMALSASNSC

SEQ ID NO: 12955 - protein, 10 aa, Artificial Sequence
  source: /note="Description of Artificial Sequence: Synthetic peptide"
LSASNSCFIR

SEQ ID NO: 12956 - protein, 10 aa, Artificial Sequence
  source: /note="Description of Artificial Sequence: Synthetic peptide"
MALSASNSCF

SEQ ID NO: 12957 - protein, 9 aa, Artificial Sequence
  source: /note="Description of Artificial Sequence: Synthetic peptide"
LLTSNSCFI

SEQ ID NO: 12958 - protein, 9 aa, Artificial Sequence
  source: /note="Description of Artificial Sequence: Synthetic peptide"
LTSNSCFIR

SEQ ID NO: 12959 - protein, 9 aa, Artificial Sequence
  source: /note="Description of Artificial Sequence: Synthetic peptide"
ALLTSNSCF

SEQ ID NO: 12960 - protein, 10 aa, Artificial Sequence
  source: /note="Description of Artificial Sequence: Synthetic peptide"
ALLTSNSCFI

SEQ ID NO: 12961 - protein, 10 aa, Artificial Sequence
  source: /note="Description of Artificial Sequence: Synthetic peptide"
FQNGKMALLT

SEQ ID NO: 12962 - protein, 10 aa, Artificial Sequence
  source: /note="Description of Artificial Sequence: Synthetic peptide"
KMALLTSNSC

SEQ ID NO: 12963 - protein, 10 aa, Artificial Sequence
  source: /note="Description of Artificial Sequence: Synthetic peptide"
LLTSNSCFIR

SEQ ID NO: 12964 - protein, 10 aa, Artificial Sequence
  source: /note="Description of Artificial Sequence: Synthetic peptide"
MALLTSNSCF

SEQ ID NO: 12965 - protein, 9 aa, Artificial Sequence
  source: /note="Description of Artificial Sequence: Synthetic peptide"
LLASDSCFI

SEQ ID NO: 12966 - protein, 9 aa, Artificial Sequence
  source: /note="Description of Artificial Sequence: Synthetic peptide"
LASDSCFIR

SEQ ID NO: 12967 - protein, 9 aa, Artificial Sequence
  source: /note="Description of Artificial Sequence: Synthetic peptide"
ALLASDSCF

SEQ ID NO: 12968 - protein, 10 aa, Artificial Sequence
  source: /note="Description of Artificial Sequence: Synthetic peptide"
ALLASDSCFI

SEQ ID NO: 12969 - protein, 10 aa, Artificial Sequence
  source: /note="Description of Artificial Sequence: Synthetic peptide"
LLASDSCFIR

SEQ ID NO: 12970 - protein, 10 aa, Artificial Sequence
  source: /note="Description of Artificial Sequence: Synthetic peptide"
MALLASDSCF

SEQ ID NO: 12971 - protein, 9 aa, Artificial Sequence
  source: /note="Description of Artificial Sequence: Synthetic peptide"
LLASNSCFV

SEQ ID NO: 12972 - protein, 9 aa, Artificial Sequence
  source: /note="Description of Artificial Sequence: Synthetic peptide"
LASNSCFVR

SEQ ID NO: 12973 - protein, 10 aa, Artificial Sequence
  source: /note="Description of Artificial Sequence: Synthetic peptide"
ALLASNSCFV

SEQ ID NO: 12974 - protein, 10 aa, Artificial Sequence
  source: /note="Description of Artificial Sequence: Synthetic peptide"
LLASNSCFVR

SEQ ID NO: 12975 - protein, 10 aa, Artificial Sequence
  source: /note="Description of Artificial Sequence: Synthetic peptide"
FIRCNEAEDI

SEQ ID NO: 12976 - protein, 9 aa, Artificial Sequence
  source: /note="Description of Artificial Sequence: Synthetic peptide"
LSDSRTALK

SEQ ID NO: 12977 - protein, 9 aa, Artificial Sequence
  source: /note="Description of Artificial Sequence: Synthetic peptide"
KLSDSRTAL

SEQ ID NO: 12978 - protein, 9 aa, Artificial Sequence
  source: /note="Description of Artificial Sequence: Synthetic peptide"
TALKSGYGK

SEQ ID NO: 12979 - protein, 9 aa, Artificial Sequence
  source: /note="Description of Artificial Sequence: Synthetic peptide"
RTALKSGYG

SEQ ID NO: 12980 - protein, 10 aa, Artificial Sequence
  source: /note="Description of Artificial Sequence: Synthetic peptide"
KLSDSRTALK

SEQ ID NO: 12981 - protein, 10 aa, Artificial Sequence
  source: /note="Description of Artificial Sequence: Synthetic peptide"
RTALKSGYGK

SEQ ID NO: 12982 - protein, 10 aa, Artificial Sequence
  source: /note="Description of Artificial Sequence: Synthetic peptide"
AVKLSDSRTA

SEQ ID NO: 12983 - protein, 10 aa, Artificial Sequence
  source: /note="Description of Artificial Sequence: Synthetic peptide"
TALKSGYGKY

SEQ ID NO: 12984 - protein, 10 aa, Artificial Sequence
  source: /note="Description of Artificial Sequence: Synthetic peptide"
VKLSDSRTAL

SEQ ID NO: 12985 - protein, 9 aa, Artificial Sequence
  source: /note="Description of Artificial Sequence: Synthetic peptide"
KLSDSRITL

SEQ ID NO: 12986 - protein, 9 aa, Artificial Sequence
  source: /note="Description of Artificial Sequence: Synthetic peptide"
ITLKSGYGK

SEQ ID NO: 12987 - protein, 9 aa, Artificial Sequence
  source: /note="Description of Artificial Sequence: Synthetic peptide"
LSDSRITLK

SEQ ID NO: 12988 - protein, 9 aa, Artificial Sequence
  source: /note="Description of Artificial Sequence: Synthetic peptide"
TLKSGYGKY

SEQ ID NO: 12989 - protein, 9 aa, Artificial Sequence
  source: /note="Description of Artificial Sequence: Synthetic peptide"
SRITLKSGY

SEQ ID NO: 12990 - protein, 10 aa, Artificial Sequence
  source: /note="Description of Artificial Sequence: Synthetic peptide"
TLKSGYGKYL

SEQ ID NO: 12991 - protein, 10 aa, Artificial Sequence
  source: /note="Description of Artificial Sequence: Synthetic peptide"
KLSDSRITLK

SEQ ID NO: 12992 - protein, 10 aa, Artificial Sequence
  source: /note="Description of Artificial Sequence: Synthetic peptide"
RITLKSGYGK

SEQ ID NO: 12993 - protein, 10 aa, Artificial Sequence
  source: /note="Description of Artificial Sequence: Synthetic peptide"
ITLKSGYGKY

SEQ ID NO: 12994 - protein, 10 aa, Artificial Sequence
  source: /note="Description of Artificial Sequence: Synthetic peptide"
VKLSDSRITL

SEQ ID NO: 12995 - protein, 9 aa, Artificial Sequence
  source: /note="Description of Artificial Sequence: Synthetic peptide"
IALNSGYGK

SEQ ID NO: 12996 - protein, 9 aa, Artificial Sequence
  source: /note="Description of Artificial Sequence: Synthetic peptide"
SRIALNSGY

SEQ ID NO: 12997 - protein, 9 aa, Artificial Sequence
  source: /note="Description of Artificial Sequence: Synthetic peptide"
ALNSGYGKY

SEQ ID NO: 12998 - protein, 10 aa, Artificial Sequence
  source: /note="Description of Artificial Sequence: Synthetic peptide"
ALNSGYGKYL

SEQ ID NO: 12999 - protein, 10 aa, Artificial Sequence
  source: /note="Description of Artificial Sequence: Synthetic peptide"
RIALNSGYGK

SEQ ID NO: 13000 - protein, 10 aa, Artificial Sequence
  source: /note="Description of Artificial Sequence: Synthetic peptide"
IALNSGYGKY

SEQ ID NO: 13001 - protein, 10 aa, Artificial Sequence
  source: /note="Description of Artificial Sequence: Synthetic peptide"
DSRIALNSGY

SEQ ID NO: 13002 - protein, 9 aa, Artificial Sequence
  source: /note="Description of Artificial Sequence: Synthetic peptide"
YPGINSDEL

SEQ ID NO: 13003 - protein, 10 aa, Artificial Sequence
  source: /note="Description of Artificial Sequence: Synthetic peptide"
KYPGINSDEL

SEQ ID NO: 13004 - protein, 10 aa, Artificial Sequence
  source: /note="Description of Artificial Sequence: Synthetic peptide"
KSGYGKYPGI

SEQ ID NO: 13005 - protein, 10 aa, Artificial Sequence
  source: /note="Description of Artificial Sequence: Synthetic peptide"
YPGINSDELV

SEQ ID NO: 13006 - protein, 9 aa, Artificial Sequence
  source: /note="Description of Artificial Sequence: Synthetic peptide"
ELVGHSVAI

SEQ ID NO: 13007 - protein, 9 aa, Artificial Sequence
  source: /note="Description of Artificial Sequence: Synthetic peptide"
VAIGPREQW

SEQ ID NO: 13008 - protein, 9 aa, Artificial Sequence
  source: /note="Description of Artificial Sequence: Synthetic peptide"
DELVGHSVA

SEQ ID NO: 13009 - protein, 10 aa, Artificial Sequence
  source: /note="Description of Artificial Sequence: Synthetic peptide"
NSDELVGHSV

SEQ ID NO: 13010 - protein, 10 aa, Artificial Sequence
  source: /note="Description of Artificial Sequence: Synthetic peptide"
DELVGHSVAI

SEQ ID NO: 13011 - protein, 9 aa, Artificial Sequence
  source: /note="Description of Artificial Sequence: Synthetic peptide"
NSEIQETCY

SEQ ID NO: 13012 - protein, 9 aa, Artificial Sequence
  source: /note="Description of Artificial Sequence: Synthetic peptide"
YAHHRGRSR

SEQ ID NO: 13013 - protein, 9 aa, Artificial Sequence
  source: /note="Description of Artificial Sequence: Synthetic peptide"
TCYAHHRGR

SEQ ID NO: 13014 - protein, 9 aa, Artificial Sequence
  source: /note="Description of Artificial Sequence: Synthetic peptide"
SEIQETCYA

SEQ ID NO: 13015 - protein, 9 aa, Artificial Sequence
  source: /note="Description of Artificial Sequence: Synthetic peptide"
IQETCYAHH

SEQ ID NO: 13016 - protein, 10 aa, Artificial Sequence
  source: /note="Description of Artificial Sequence: Synthetic peptide"
ETCYAHHRGR

SEQ ID NO: 13017 - protein, 10 aa, Artificial Sequence
  source: /note="Description of Artificial Sequence: Synthetic peptide"
CYAHHRGRSR

SEQ ID NO: 13018 - protein, 10 aa, Artificial Sequence
  source: /note="Description of Artificial Sequence: Synthetic peptide"
YAHHRGRSRA

SEQ ID NO: 13019 - protein, 10 aa, Artificial Sequence
  source: /note="Description of Artificial Sequence: Synthetic peptide"
SEIQETCYAH

SEQ ID NO: 13020 - protein, 9 aa, Artificial Sequence
  source: /note="Description of Artificial Sequence: Synthetic peptide"
SEIGATPQA

SEQ ID NO: 13021 - protein, 10 aa, Artificial Sequence
  source: /note="Description of Artificial Sequence: Synthetic peptide"
SEIGATPQAA

SEQ ID NO: 13022 - protein, 9 aa, Artificial Sequence
  source: /note="Description of Artificial Sequence: Synthetic peptide"
NPGQKIASI

SEQ ID NO: 13023 - protein, 9 aa, Artificial Sequence
  source: /note="Description of Artificial Sequence: Synthetic peptide"
GQKIASIPT

SEQ ID NO: 13024 - protein, 10 aa, Artificial Sequence
  source: /note="Description of Artificial Sequence: Synthetic peptide"
GQKIASIPTK

SEQ ID NO: 13025 - protein, 9 aa, Artificial Sequence
  source: /note="Description of Artificial Sequence: Synthetic peptide"
LTDTELISY

SEQ ID NO: 13026 - protein, 9 aa, Artificial Sequence
  source: /note="Description of Artificial Sequence: Synthetic peptide"
DTELISYTR

SEQ ID NO: 13027 - protein, 9 aa, Artificial Sequence
  source: /note="Description of Artificial Sequence: Synthetic peptide"
ELISYTRKR

SEQ ID NO: 13028 - protein, 10 aa, Artificial Sequence
  source: /note="Description of Artificial Sequence: Synthetic peptide"
ISYTRKRDSV

SEQ ID NO: 13029 - protein, 10 aa, Artificial Sequence
  source: /note="Description of Artificial Sequence: Synthetic peptide"
SYTRKRDSVK

SEQ ID NO: 13030 - protein, 10 aa, Artificial Sequence
  source: /note="Description of Artificial Sequence: Synthetic peptide"
ELTDTELISY

SEQ ID NO: 13031 - protein, 9 aa, Artificial Sequence
  source: /note="Description of Artificial Sequence: Synthetic peptide"
NTWCAGYCY

SEQ ID NO: 13032 - protein, 9 aa, Artificial Sequence
  source: /note="Description of Artificial Sequence: Synthetic peptide"
INNTWCAGY

SEQ ID NO: 13033 - protein, 9 aa, Artificial Sequence
  source: /note="Description of Artificial Sequence: Synthetic peptide"
FCISINNTW

SEQ ID NO: 13034 - protein, 10 aa, Artificial Sequence
  source: /note="Description of Artificial Sequence: Synthetic peptide"
RFCISINNTW

SEQ ID NO: 13035 - protein, 10 aa, Artificial Sequence
  source: /note="Description of Artificial Sequence: Synthetic peptide"
SINNTWCAGY

SEQ ID NO: 13036 - protein, 10 aa, Artificial Sequence
  source: /note="Description of Artificial Sequence: Synthetic peptide"
NTWCAGYCYT

SEQ ID NO: 13037 - protein, 9 aa, Artificial Sequence
  source: /note="Description of Artificial Sequence: Synthetic peptide"
CGTPQQIDY

SEQ ID NO: 13038 - protein, 10 aa, Artificial Sequence
  source: /note="Description of Artificial Sequence: Synthetic peptide"
FTICGTPQQI

SEQ ID NO: 13039 - protein, 9 aa, Artificial Sequence
  source: /note="Description of Artificial Sequence: Synthetic peptide"
VLSGLRELL

SEQ ID NO: 13040 - protein, 9 aa, Artificial Sequence
  source: /note="Description of Artificial Sequence: Synthetic peptide"
FLQGLLETA

SEQ ID NO: 13041 - protein, 9 aa, Artificial Sequence
  source: /note="Description of Artificial Sequence: Synthetic peptide"
GLLETAGGI

SEQ ID NO: 13042 - protein, 9 aa, Artificial Sequence
  source: /note="Description of Artificial Sequence: Synthetic peptide"
NLIFLGPHL

SEQ ID NO: 13043 - protein, 9 aa, Artificial Sequence
  source: /note="Description of Artificial Sequence: Synthetic peptide"
HLSGGLIYL

SEQ ID NO: 13044 - protein, 9 aa, Artificial Sequence
  source: /note="Description of Artificial Sequence: Synthetic peptide"
FSMESPKPL

SEQ ID NO: 13045 - protein, 9 aa, Artificial Sequence
  source: /note="Description of Artificial Sequence: Synthetic peptide"
VLPQRLRHL

SEQ ID NO: 13046 - protein, 9 aa, Artificial Sequence
  source: /note="Description of Artificial Sequence: Synthetic peptide"
ALRLAGAVV

SEQ ID NO: 13047 - protein, 9 aa, Artificial Sequence
  source: /note="Description of Artificial Sequence: Synthetic peptide"
GLGSVQLGA

SEQ ID NO: 13048 - protein, 9 aa, Artificial Sequence
  source: /note="Description of Artificial Sequence: Synthetic peptide"
PLPELLSLA

SEQ ID NO: 13049 - protein, 9 aa, Artificial Sequence
  source: /note="Description of Artificial Sequence: Synthetic peptide"
LLSLAGDAA

SEQ ID NO: 13050 - protein, 9 aa, Artificial Sequence
  source: /note="Description of Artificial Sequence: Synthetic peptide"
LLQLGTRFL

SEQ ID NO: 13051 - protein, 9 aa, Artificial Sequence
  source: /note="Description of Artificial Sequence: Synthetic peptide"
FLGPHLSGG

SEQ ID NO: 13052 - protein, 9 aa, Artificial Sequence
  source: /note="Description of Artificial Sequence: Synthetic peptide"
IWFSMESPK

SEQ ID NO: 13053 - protein, 9 aa, Artificial Sequence
  source: /note="Description of Artificial Sequence: Synthetic peptide"
RLRHLHALR

SEQ ID NO: 13054 - protein, 9 aa, Artificial Sequence
  source: /note="Description of Artificial Sequence: Synthetic peptide"
ASLLQLGTR

SEQ ID NO: 13055 - protein, 9 aa, Artificial Sequence
  source: /note="Description of Artificial Sequence: Synthetic peptide"
LSGGLIYLR

SEQ ID NO: 13056 - protein, 9 aa, Artificial Sequence
  source: /note="Description of Artificial Sequence: Synthetic peptide"
AWAARNLIF

SEQ ID NO: 13057 - protein, 9 aa, Artificial Sequence
  source: /note="Description of Artificial Sequence: Synthetic peptide"
RILQSHHVL

SEQ ID NO: 13058 - protein, 9 aa, Artificial Sequence
  source: /note="Description of Artificial Sequence: Synthetic peptide"
VVRPACPPT

SEQ ID NO: 13059 - protein, 9 aa, Artificial Sequence
  source: /note="Description of Artificial Sequence: Synthetic peptide"
KLRQGALLP

SEQ ID NO: 13060 - protein, 9 aa, Artificial Sequence
  source: /note="Description of Artificial Sequence: Synthetic peptide"
RVRTLPQAP

SEQ ID NO: 13061 - protein, 9 aa, Artificial Sequence
  source: /note="Description of Artificial Sequence: Synthetic peptide"
GLRELLAPR

SEQ ID NO: 13062 - protein, 9 aa, Artificial Sequence
  source: /note="Description of Artificial Sequence: Synthetic peptide"
RARGAGPQQ

SEQ ID NO: 13063 - protein, 9 aa, Artificial Sequence
  source: /note="Description of Artificial Sequence: Synthetic peptide"
ATRRLHPRG

SEQ ID NO: 13064 - protein, 9 aa, Artificial Sequence
  source: /note="Description of Artificial Sequence: Synthetic peptide"
RLHPRGRLP

SEQ ID NO: 13065 - protein, 9 aa, Artificial Sequence
  source: /note="Description of Artificial Sequence: Synthetic peptide"
GTRFLQGLL

SEQ ID NO: 13066 - protein, 9 aa, Artificial Sequence
  source: /note="Description of Artificial Sequence: Synthetic peptide"
AARNLIFLG

SEQ ID NO: 13067 - protein, 9 aa, Artificial Sequence
  source: /note="Description of Artificial Sequence: Synthetic peptide"
QSHHVLPQR

SEQ ID NO: 13068 - protein, 9 aa, Artificial Sequence
  source: /note="Description of Artificial Sequence: Synthetic peptide"
LLAPRLHHR

SEQ ID NO: 13069 - protein, 9 aa, Artificial Sequence
  source: /note="Description of Artificial Sequence: Synthetic peptide"
QLREVPATR

SEQ ID NO: 13070 - protein, 9 aa, Artificial Sequence
  source: /note="Description of Artificial Sequence: Synthetic peptide"
PATRRLHPR

SEQ ID NO: 13071 - protein, 9 aa, Artificial Sequence
  source: /note="Description of Artificial Sequence: Synthetic peptide"
GWCGAWAAR

SEQ ID NO: 13072 - protein, 9 aa, Artificial Sequence
  source: /note="Description of Artificial Sequence: Synthetic peptide"
ESPKPLLAA

SEQ ID NO: 13073 - protein, 9 aa, Artificial Sequence
  source: /note="Description of Artificial Sequence: Synthetic peptide"
DAAASLLQL

SEQ ID NO: 13074 - protein, 9 aa, Artificial Sequence
  source: /note="Description of Artificial Sequence: Synthetic peptide"
WAARNLIFL

SEQ ID NO: 13075 - protein, 9 aa, Artificial Sequence
  source: /note="Description of Artificial Sequence: Synthetic peptide"
RPACPPTAQ

SEQ ID NO: 13076 - protein, 9 aa, Artificial Sequence
  source: /note="Description of Artificial Sequence: Synthetic peptide"
VPVQVLSGL

SEQ ID NO: 13077 - protein, 9 aa, Artificial Sequence
  source: /note="Description of Artificial Sequence: Synthetic peptide"
APRLHHREA

SEQ ID NO: 13078 - protein, 9 aa, Artificial Sequence
  source: /note="Description of Artificial Sequence: Synthetic peptide"
HPRGRLPEP

SEQ ID NO: 13079 - protein, 9 aa, Artificial Sequence
  source: /note="Description of Artificial Sequence: Synthetic peptide"
GPRPLPELL

SEQ ID NO: 13080 - protein, 9 aa, Artificial Sequence
  source: /note="Description of Artificial Sequence: Synthetic peptide"
RPLPELLSL

SEQ ID NO: 13081 - protein, 9 aa, Artificial Sequence
  source: /note="Description of Artificial Sequence: Synthetic peptide"
VPDTRHSGL

SEQ ID NO: 13082 - protein, 9 aa, Artificial Sequence
  source: /note="Description of Artificial Sequence: Synthetic peptide"
GPHLSGGLI

SEQ ID NO: 13083 - protein, 9 aa, Artificial Sequence
  source: /note="Description of Artificial Sequence: Synthetic peptide"
QRLRHLHAL

SEQ ID NO: 13084 - protein, 9 aa, Artificial Sequence
  source: /note="Description of Artificial Sequence: Synthetic peptide"
GAKLRQGAL

SEQ ID NO: 13085 - protein, 9 aa, Artificial Sequence
  source: /note="Description of Artificial Sequence: Synthetic peptide"
SLLQLGTRF

SEQ ID NO: 13086 - protein, 9 aa, Artificial Sequence
  source: /note="Description of Artificial Sequence: Synthetic peptide"
HLRGWCGAW

SEQ ID NO: 13087 - protein, 9 aa, Artificial Sequence
  source: /note="Description of Artificial Sequence: Synthetic peptide"
SMESPKPLL

SEQ ID NO: 13088 - protein, 9 aa, Artificial Sequence
  source: /note="Description of Artificial Sequence: Synthetic peptide"
MESPKPLLA

SEQ ID NO: 13089 - protein, 9 aa, Artificial Sequence
  source: /note="Description of Artificial Sequence: Synthetic peptide"
LQSHHVLPQ

SEQ ID NO: 13090 - protein, 9 aa, Artificial Sequence
  source: /note="Description of Artificial Sequence: Synthetic peptide"
LRHLHALRL

SEQ ID NO: 13091 - protein, 9 aa, Artificial Sequence
  source: /note="Description of Artificial Sequence: Synthetic peptide"
RHLHALRLA

SEQ ID NO: 13092 - protein, 9 aa, Artificial Sequence
  source: /note="Description of Artificial Sequence: Synthetic peptide"
HLHALRLAG

SEQ ID NO: 13093 - protein, 9 aa, Artificial Sequence
  source: /note="Description of Artificial Sequence: Synthetic peptide"
AKLRQGALL

SEQ ID NO: 13094 - protein, 9 aa, Artificial Sequence
  source: /note="Description of Artificial Sequence: Synthetic peptide"
RQGALLPEP

SEQ ID NO: 13095 - protein, 9 aa, Artificial Sequence
  source: /note="Description of Artificial Sequence: Synthetic peptide"
SQGGRVRTL

SEQ ID NO: 13096 - protein, 9 aa, Artificial Sequence
  source: /note="Description of Artificial Sequence: Synthetic peptide"
KQLREVPAT

SEQ ID NO: 13097 - protein, 9 aa, Artificial Sequence
  source: /note="Description of Artificial Sequence: Synthetic peptide"
REVPATRRL

SEQ ID NO: 13098 - protein, 9 aa, Artificial Sequence
  source: /note="Description of Artificial Sequence: Synthetic peptide"
LSLAGDAAA

SEQ ID NO: 13099 - protein, 9 aa, Artificial Sequence
  source: /note="Description of Artificial Sequence: Synthetic peptide"
LAGDAAASL

SEQ ID NO: 13100 - protein, 9 aa, Artificial Sequence
  source: /note="Description of Artificial Sequence: Synthetic peptide"
LETAGGIQV

SEQ ID NO: 13101 - protein, 9 aa, Artificial Sequence
  source: /note="Description of Artificial Sequence: Synthetic peptide"
TRHSGLVHL

SEQ ID NO: 13102 - protein, 9 aa, Artificial Sequence
  source: /note="Description of Artificial Sequence: Synthetic peptide"
RGWCGAWAA

SEQ ID NO: 13103 - protein, 9 aa, Artificial Sequence
  source: /note="Description of Artificial Sequence: Synthetic peptide"
GAWAARNLI

SEQ ID NO: 13104 - protein, 10 aa, Artificial Sequence
  source: /note="Description of Artificial Sequence: Synthetic peptide"
FSMESPKPLL

SEQ ID NO: 13105 - protein, 10 aa, Artificial Sequence
  source: /note="Description of Artificial Sequence: Synthetic peptide"
LLAAESHGRI

SEQ ID NO: 13106 - protein, 10 aa, Artificial Sequence
  source: /note="Description of Artificial Sequence: Synthetic peptide"
RLAGAVVRPA

SEQ ID NO: 13107 - protein, 10 aa, Artificial Sequence
  source: /note="Description of Artificial Sequence: Synthetic peptide"
GLRELLAPRL

SEQ ID NO: 13108 - protein, 10 aa, Artificial Sequence
  source: /note="Description of Artificial Sequence: Synthetic peptide"
SLAGDAAASL

SEQ ID NO: 13109 - protein, 10 aa, Artificial Sequence
  source: /note="Description of Artificial Sequence: Synthetic peptide"
SLLQLGTRFL

SEQ ID NO: 13110 - protein, 10 aa, Artificial Sequence
  source: /note="Description of Artificial Sequence: Synthetic peptide"
FLGPHLSGGL

SEQ ID NO: 13111 - protein, 10 aa, Artificial Sequence
  source: /note="Description of Artificial Sequence: Synthetic peptide"
RLRHLHALRL

SEQ ID NO: 13112 - protein, 10 aa, Artificial Sequence
  source: /note="Description of Artificial Sequence: Synthetic peptide"
HLHALRLAGA

SEQ ID NO: 13113 - protein, 10 aa, Artificial Sequence
  source: /note="Description of Artificial Sequence: Synthetic peptide"
VLSGLRELLA

SEQ ID NO: 13114 - protein, 10 aa, Artificial Sequence
  source: /note="Description of Artificial Sequence: Synthetic peptide"
LLSLAGDAAA

SEQ ID NO: 13115 - protein, 10 aa, Artificial Sequence
  source: /note="Description of Artificial Sequence: Synthetic peptide"
QLGTRFLQGL

SEQ ID NO: 13116 - protein, 10 aa, Artificial Sequence
  source: /note="Description of Artificial Sequence: Synthetic peptide"
LLETAGGIQV

SEQ ID NO: 13117 - protein, 10 aa, Artificial Sequence
  source: /note="Description of Artificial Sequence: Synthetic peptide"
HLRGWCGAWA

SEQ ID NO: 13118 - protein, 10 aa, Artificial Sequence
  source: /note="Description of Artificial Sequence: Synthetic peptide"
WIWFSMESPK

SEQ ID NO: 13119 - protein, 10 aa, Artificial Sequence
  source: /note="Description of Artificial Sequence: Synthetic peptide"
GLGSVQLGAK

SEQ ID NO: 13120 - protein, 10 aa, Artificial Sequence
  source: /note="Description of Artificial Sequence: Synthetic peptide"
HLSGGLIYLR

SEQ ID NO: 13121 - protein, 10 aa, Artificial Sequence
  source: /note="Description of Artificial Sequence: Synthetic peptide"
GAWAARNLIF

SEQ ID NO: 13122 - protein, 10 aa, Artificial Sequence
  source: /note="Description of Artificial Sequence: Synthetic peptide"
AWAARNLIFL

SEQ ID NO: 13123 - protein, 10 aa, Artificial Sequence
  source: /note="Description of Artificial Sequence: Synthetic peptide"
HGRILQSHHV

SEQ ID NO: 13124 - protein, 10 aa, Artificial Sequence
  source: /note="Description of Artificial Sequence: Synthetic peptide"
HVLPQRLRHL

SEQ ID NO: 13125 - protein, 10 aa, Artificial Sequence
  source: /note="Description of Artificial Sequence: Synthetic peptide"
ALRLAGAVVR

SEQ ID NO: 13126 - protein, 10 aa, Artificial Sequence
  source: /note="Description of Artificial Sequence: Synthetic peptide"
VVRPACPPTA

SEQ ID NO: 13127 - protein, 10 aa, Artificial Sequence
  source: /note="Description of Artificial Sequence: Synthetic peptide"
KLRQGALLPE

SEQ ID NO: 13128 - protein, 10 aa, Artificial Sequence
  source: /note="Description of Artificial Sequence: Synthetic peptide"
GGRVRTLPQA

SEQ ID NO: 13129 - protein, 10 aa, Artificial Sequence
  source: /note="Description of Artificial Sequence: Synthetic peptide"
RVRTLPQAPA

SEQ ID NO: 13130 - protein, 10 aa, Artificial Sequence
  source: /note="Description of Artificial Sequence: Synthetic peptide"
RTLPQAPAPG

SEQ ID NO: 13131 - protein, 10 aa, Artificial Sequence
  source: /note="Description of Artificial Sequence: Synthetic peptide"
RARGAGPQQK

SEQ ID NO: 13132 - protein, 10 aa, Artificial Sequence
  source: /note="Description of Artificial Sequence: Synthetic peptide"
ATRRLHPRGR

SEQ ID NO: 13133 - protein, 10 aa, Artificial Sequence
  source: /note="Description of Artificial Sequence: Synthetic peptide"
RLHPRGRLPE

SEQ ID NO: 13134 - protein, 10 aa, Artificial Sequence
  source: /note="Description of Artificial Sequence: Synthetic peptide"
RGWCGAWAAR

SEQ ID NO: 13135 - protein, 10 aa, Artificial Sequence
  source: /note="Description of Artificial Sequence: Synthetic peptide"
ELLAPRLHHR

SEQ ID NO: 13136 - protein, 10 aa, Artificial Sequence
  source: /note="Description of Artificial Sequence: Synthetic peptide"
QLREVPATRR

SEQ ID NO: 13137 - protein, 10 aa, Artificial Sequence
  source: /note="Description of Artificial Sequence: Synthetic peptide"
VPATRRLHPR

SEQ ID NO: 13138 - protein, 10 aa, Artificial Sequence
  source: /note="Description of Artificial Sequence: Synthetic peptide"
EAVEERPGGL

SEQ ID NO: 13139 - protein, 10 aa, Artificial Sequence
  source: /note="Description of Artificial Sequence: Synthetic peptide"
QVPDTRHSGL

SEQ ID NO: 13140 - protein, 10 aa, Artificial Sequence
  source: /note="Description of Artificial Sequence: Synthetic peptide"
LPQRLRHLHA

SEQ ID NO: 13141 - protein, 10 aa, Artificial Sequence
  source: /note="Description of Artificial Sequence: Synthetic peptide"
APGNHDGDAV

SEQ ID NO: 13142 - protein, 10 aa, Artificial Sequence
  source: /note="Description of Artificial Sequence: Synthetic peptide"
APRLHHREAV

SEQ ID NO: 13143 - protein, 10 aa, Artificial Sequence
  source: /note="Description of Artificial Sequence: Synthetic peptide"
GPQQKQLREV

SEQ ID NO: 13144 - protein, 10 aa, Artificial Sequence
  source: /note="Description of Artificial Sequence: Synthetic peptide"
LPEPQGPGPV

SEQ ID NO: 13145 - protein, 10 aa, Artificial Sequence
  source: /note="Description of Artificial Sequence: Synthetic peptide"
PQRLRHLHAL

SEQ ID NO: 13146 - protein, 10 aa, Artificial Sequence
  source: /note="Description of Artificial Sequence: Synthetic peptide"
GPHLSGGLIY

SEQ ID NO: 13147 - protein, 10 aa, Artificial Sequence
  source: /note="Description of Artificial Sequence: Synthetic peptide"
MESPKPLLAA

SEQ ID NO: 13148 - protein, 10 aa, Artificial Sequence
  source: /note="Description of Artificial Sequence: Synthetic peptide"
LAAESHGRIL

SEQ ID NO: 13149 - protein, 10 aa, Artificial Sequence
  source: /note="Description of Artificial Sequence: Synthetic peptide"
GRILQSHHVL

SEQ ID NO: 13150 - protein, 10 aa, Artificial Sequence
  source: /note="Description of Artificial Sequence: Synthetic peptide"
HALRLAGAVV

SEQ ID NO: 13151 - protein, 10 aa, Artificial Sequence
  source: /note="Description of Artificial Sequence: Synthetic peptide"
RAGGLGSVQL

SEQ ID NO: 13152 - protein, 10 aa, Artificial Sequence
  source: /note="Description of Artificial Sequence: Synthetic peptide"
RQGALLPEPA

SEQ ID NO: 13153 - protein, 10 aa, Artificial Sequence
  source: /note="Description of Artificial Sequence: Synthetic peptide"
VQVLSGLREL

SEQ ID NO: 13154 - protein, 10 aa, Artificial Sequence
  source: /note="Description of Artificial Sequence: Synthetic peptide"
RELLAPRLHH

SEQ ID NO: 13155 - protein, 10 aa, Artificial Sequence
  source: /note="Description of Artificial Sequence: Synthetic peptide"
QQKQLREVPA

SEQ ID NO: 13156 - protein, 10 aa, Artificial Sequence
  source: /note="Description of Artificial Sequence: Synthetic peptide"
REVPATRRLH

SEQ ID NO: 13157 - protein, 10 aa, Artificial Sequence
  source: /note="Description of Artificial Sequence: Synthetic peptide"
GQGPRPLPEL

SEQ ID NO: 13158 - protein, 10 aa, Artificial Sequence
  source: /note="Description of Artificial Sequence: Synthetic peptide"
GDAAASLLQL

SEQ ID NO: 13159 - protein, 10 aa, Artificial Sequence
  source: /note="Description of Artificial Sequence: Synthetic peptide"
ASLLQLGTRF

SEQ ID NO: 13160 - protein, 10 aa, Artificial Sequence
  source: /note="Description of Artificial Sequence: Synthetic peptide"
LQLGTRFLQG

SEQ ID NO: 13161 - protein, 10 aa, Artificial Sequence
  source: /note="Description of Artificial Sequence: Synthetic peptide"
RFLQGLLETA

SEQ ID NO: 13162 - protein, 10 aa, Artificial Sequence
  source: /note="Description of Artificial Sequence: Synthetic peptide"
IQVPDTRHSG

SEQ ID NO: 13163 - protein, 10 aa, Artificial Sequence
  source: /note="Description of Artificial Sequence: Synthetic peptide"
VHLRGWCGAW

SEQ ID NO: 13164 - protein, 10 aa, Artificial Sequence
  source: /note="Description of Artificial Sequence: Synthetic peptide"
RNLIFLGPHL

SEQ ID NO: 13165 - protein, 10 aa, Artificial Sequence
  source: /note="Description of Artificial Sequence: Synthetic peptide"
AESHGRILQS

SEQ ID NO: 13166 - protein, 10 aa, Artificial Sequence
  source: /note="Description of Artificial Sequence: Synthetic peptide"
PELLSLAGDA

SEQ ID NO: 13167 - protein, 10 aa, Artificial Sequence
  source: /note="Description of Artificial Sequence: Synthetic peptide"
VPDTRHSGLV

SEQ ID NO: 13168 - protein, 9 aa, Artificial Sequence
  source: /note="Description of Artificial Sequence: Synthetic peptide"
LTVGGHGAK

SEQ ID NO: 13169 - protein, 9 aa, Artificial Sequence
  source: /note="Description of Artificial Sequence: Synthetic peptide"
GGHGAKVRK

SEQ ID NO: 13170 - protein, 9 aa, Artificial Sequence
  source: /note="Description of Artificial Sequence: Synthetic peptide"
HGAKVRKRK

SEQ ID NO: 13171 - protein, 9 aa, Artificial Sequence
  source: /note="Description of Artificial Sequence: Synthetic peptide"
KVRKRKRET

SEQ ID NO: 13172 - protein, 9 aa, Artificial Sequence
  source: /note="Description of Artificial Sequence: Synthetic peptide"
RIQPPRNRS

SEQ ID NO: 13173 - protein, 9 aa, Artificial Sequence
  source: /note="Description of Artificial Sequence: Synthetic peptide"
RNRSHCLPC

SEQ ID NO: 13174 - protein, 9 aa, Artificial Sequence
  source: /note="Description of Artificial Sequence: Synthetic peptide"
TVGGHGAKV

SEQ ID NO: 13175 - protein, 9 aa, Artificial Sequence
  source: /note="Description of Artificial Sequence: Synthetic peptide"
PPRNRSHCL

SEQ ID NO: 13176 - protein, 9 aa, Artificial Sequence
  source: /note="Description of Artificial Sequence: Synthetic peptide"
HQNPTDHQM

SEQ ID NO: 13177 - protein, 9 aa, Artificial Sequence
  source: /note="Description of Artificial Sequence: Synthetic peptide"
IQPPRNRSH

SEQ ID NO: 13178 - protein, 9 aa, Artificial Sequence
  source: /note="Description of Artificial Sequence: Synthetic peptide"
SHCLPCLPW

SEQ ID NO: 13179 - protein, 9 aa, Artificial Sequence
  source: /note="Description of Artificial Sequence: Synthetic peptide"
LPCLPWVHL

SEQ ID NO: 13180 - protein, 9 aa, Artificial Sequence
  source: /note="Description of Artificial Sequence: Synthetic peptide"
LPWVHLHQN

SEQ ID NO: 13181 - protein, 10 aa, Artificial Sequence
  source: /note="Description of Artificial Sequence: Synthetic peptide"
CLPCLPWVHL

SEQ ID NO: 13182 - protein, 10 aa, Artificial Sequence
  source: /note="Description of Artificial Sequence: Synthetic peptide"
KLTVGGHGAK

SEQ ID NO: 13183 - protein, 10 aa, Artificial Sequence
  source: /note="Description of Artificial Sequence: Synthetic peptide"
KVRKRKRETR

SEQ ID NO: 13184 - protein, 10 aa, Artificial Sequence
  source: /note="Description of Artificial Sequence: Synthetic peptide"
RIQPPRNRSH

SEQ ID NO: 13185 - protein, 10 aa, Artificial Sequence
  source: /note="Description of Artificial Sequence: Synthetic peptide"
RNRSHCLPCL

SEQ ID NO: 13186 - protein, 10 aa, Artificial Sequence
  source: /note="Description of Artificial Sequence: Synthetic peptide"
ETRIQPPRNR

SEQ ID NO: 13187 - protein, 10 aa, Artificial Sequence
  source: /note="Description of Artificial Sequence: Synthetic peptide"
LTVGGHGAKV

SEQ ID NO: 13188 - protein, 10 aa, Artificial Sequence
  source: /note="Description of Artificial Sequence: Synthetic peptide"
QPPRNRSHCL

SEQ ID NO: 13189 - protein, 10 aa, Artificial Sequence
  source: /note="Description of Artificial Sequence: Synthetic peptide"
RSHCLPCLPW

SEQ ID NO: 13190 - protein, 10 aa, Artificial Sequence
  source: /note="Description of Artificial Sequence: Synthetic peptide"
LHQNPTDHQM

SEQ ID NO: 13191 - protein, 10 aa, Artificial Sequence
  source: /note="Description of Artificial Sequence: Synthetic peptide"
HQNPTDHQML

SEQ ID NO: 13192 - protein, 10 aa, Artificial Sequence
  source: /note="Description of Artificial Sequence: Synthetic peptide"
LPWVHLHQNP

SEQ ID NO: 13193 - protein, 9 aa, Artificial Sequence
  source: /note="Description of Artificial Sequence: Synthetic peptide"
NVDALRYFV

SEQ ID NO: 13194 - protein, 9 aa, Artificial Sequence
  source: /note="Description of Artificial Sequence: Synthetic peptide"
GLYNVDALR

SEQ ID NO: 13195 - protein, 9 aa, Artificial Sequence
  source: /note="Description of Artificial Sequence: Synthetic peptide"
LYNVDALRY

SEQ ID NO: 13196 - protein, 9 aa, Artificial Sequence
  source: /note="Description of Artificial Sequence: Synthetic peptide"
YNVDALRYF

SEQ ID NO: 13197 - protein, 10 aa, Artificial Sequence
  source: /note="Description of Artificial Sequence: Synthetic peptide"
GVCFVGLYNV

SEQ ID NO: 13198 - protein, 10 aa, Artificial Sequence
  source: /note="Description of Artificial Sequence: Synthetic peptide"
GLYNVDALRY

SEQ ID NO: 13199 - protein, 10 aa, Artificial Sequence
  source: /note="Description of Artificial Sequence: Synthetic peptide"
LYNVDALRYF

SEQ ID NO: 13200 - protein, 10 aa, Artificial Sequence
  source: /note="Description of Artificial Sequence: Synthetic peptide"
YNVDALRYFV

SEQ ID NO: 13201 - protein, 9 aa, Artificial Sequence
  source: /note="Description of Artificial Sequence: Synthetic peptide"
KLKKFMIQI

SEQ ID NO: 13202 - protein, 9 aa, Artificial Sequence
  source: /note="Description of Artificial Sequence: Synthetic peptide"
IQIGVFSGL

SEQ ID NO: 13203 - protein, 9 aa, Artificial Sequence
  source: /note="Description of Artificial Sequence: Synthetic peptide"
KFMIQIGVF

SEQ ID NO: 13204 - protein, 9 aa, Artificial Sequence
  source: /note="Description of Artificial Sequence: Synthetic peptide"
QIGVFSGLY

SEQ ID NO: 13205 - protein, 9 aa, Artificial Sequence
  source: /note="Description of Artificial Sequence: Synthetic peptide"
KKFMIQIGV

SEQ ID NO: 13206 - protein, 10 aa, Artificial Sequence
  source: /note="Description of Artificial Sequence: Synthetic peptide"
FMIQIGVFSG

SEQ ID NO: 13207 - protein, 10 aa, Artificial Sequence
  source: /note="Description of Artificial Sequence: Synthetic peptide"
MIQIGVFSGL

SEQ ID NO: 13208 - protein, 10 aa, Artificial Sequence
  source: /note="Description of Artificial Sequence: Synthetic peptide"
KLKKFMIQIG

SEQ ID NO: 13209 - protein, 10 aa, Artificial Sequence
  source: /note="Description of Artificial Sequence: Synthetic peptide"
IQIGVFSGLY

SEQ ID NO: 13210 - protein, 10 aa, Artificial Sequence
  source: /note="Description of Artificial Sequence: Synthetic peptide"
KKFMIQIGVF

SEQ ID NO: 13211 - protein, 9 aa, Artificial Sequence
  source: /note="Description of Artificial Sequence: Synthetic peptide"
ILDHLLDGY

SEQ ID NO: 13212 - protein, 9 aa, Artificial Sequence
  source: /note="Description of Artificial Sequence: Synthetic peptide"
IFTRILDHL

SEQ ID NO: 13213 - protein, 9 aa, Artificial Sequence
  source: /note="Description of Artificial Sequence: Synthetic peptide"
HLLDGYDNR

SEQ ID NO: 13214 - protein, 9 aa, Artificial Sequence
  source: /note="Description of Artificial Sequence: Synthetic peptide"
FTRILDHLL

SEQ ID NO: 13215 - protein, 10 aa, Artificial Sequence
  source: /note="Description of Artificial Sequence: Synthetic peptide"
HLLDGYDNRL

SEQ ID NO: 13216 - protein, 10 aa, Artificial Sequence
  source: /note="Description of Artificial Sequence: Synthetic peptide"
TIFTRILDHL

SEQ ID NO: 13217 - protein, 10 aa, Artificial Sequence
  source: /note="Description of Artificial Sequence: Synthetic peptide"
IFTRILDHLL

SEQ ID NO: 13218 - protein, 10 aa, Artificial Sequence
  source: /note="Description of Artificial Sequence: Synthetic peptide"
RILDHLLDGY

SEQ ID NO: 13219 - protein, 9 aa, Artificial Sequence
  source: /note="Description of Artificial Sequence: Synthetic peptide"
SIQTGYMPR

SEQ ID NO: 13220 - protein, 9 aa, Artificial Sequence
  source: /note="Description of Artificial Sequence: Synthetic peptide"
IQTGYMPRK

SEQ ID NO: 13221 - protein, 9 aa, Artificial Sequence
  source: /note="Description of Artificial Sequence: Synthetic peptide"
SPTSIQTGY

SEQ ID NO: 13222 - protein, 10 aa, Artificial Sequence
  source: /note="Description of Artificial Sequence: Synthetic peptide"
SIQTGYMPRK

SEQ ID NO: 13223 - protein, 10 aa, Artificial Sequence
  source: /note="Description of Artificial Sequence: Synthetic peptide"
TSIQTGYMPR

SEQ ID NO: 13224 - protein, 10 aa, Artificial Sequence
  source: /note="Description of Artificial Sequence: Synthetic peptide"
ASPTSIQTGY

SEQ ID NO: 13225 - protein, 10 aa, Artificial Sequence
  source: /note="Description of Artificial Sequence: Synthetic peptide"
SPTSIQTGYM

SEQ ID NO: 13226 - protein, 10 aa, Artificial Sequence
  source: /note="Description of Artificial Sequence: Synthetic peptide"
IQTGYMPRKA

SEQ ID NO: 13227 - protein, 9 aa, Artificial Sequence
  source: /note="Description of Artificial Sequence: Synthetic peptide"
NKIWTPDTF

SEQ ID NO: 13228 - protein, 10 aa, Artificial Sequence
  source: /note="Description of Artificial Sequence: Synthetic peptide"
ANKIWTPDTF

SEQ ID NO: 13229 - protein, 10 aa, Artificial Sequence
  source: /note="Description of Artificial Sequence: Synthetic peptide"
NKIWTPDTFF

SEQ ID NO: 13230 - protein, 9 aa, Artificial Sequence
  source: /note="Description of Artificial Sequence: Synthetic peptide"
KYHLMGQTV

SEQ ID NO: 13231 - protein, 9 aa, Artificial Sequence
  source: /note="Description of Artificial Sequence: Synthetic peptide"
GSRLNKYHL

SEQ ID NO: 13232 - protein, 9 aa, Artificial Sequence
  source: /note="Description of Artificial Sequence: Synthetic peptide"
SRLNKYHLM

SEQ ID NO: 13233 - protein, 10 aa, Artificial Sequence
  source: /note="Description of Artificial Sequence: Synthetic peptide"
GSRLNKYHLM

SEQ ID NO: 13234 - protein, 10 aa, Artificial Sequence
  source: /note="Description of Artificial Sequence: Synthetic peptide"
AEDGSRLNKY

SEQ ID NO: 13235 - protein, 10 aa, Artificial Sequence
  source: /note="Description of Artificial Sequence: Synthetic peptide"
NKYHLMGQTV

SEQ ID NO: 13236 - protein, 9 aa, Artificial Sequence
  source: /note="Description of Artificial Sequence: Synthetic peptide"
FIAVCFAFI

SEQ ID NO: 13237 - protein, 9 aa, Artificial Sequence
  source: /note="Description of Artificial Sequence: Synthetic peptide"
FAFIFSALI

SEQ ID NO: 13238 - protein, 9 aa, Artificial Sequence
  source: /note="Description of Artificial Sequence: Synthetic peptide"
FIFSALIEF

SEQ ID NO: 13239 - protein, 9 aa, Artificial Sequence
  source: /note="Description of Artificial Sequence: Synthetic peptide"
IAVCFAFIF

SEQ ID NO: 13240 - protein, 9 aa, Artificial Sequence
  source: /note="Description of Artificial Sequence: Synthetic peptide"
CFAFIFSAL

SEQ ID NO: 13241 - protein, 10 aa, Artificial Sequence
  source: /note="Description of Artificial Sequence: Synthetic peptide"
FIFSALIEFA

SEQ ID NO: 13242 - protein, 10 aa, Artificial Sequence
  source: /note="Description of Artificial Sequence: Synthetic peptide"
WFIAVCFAFI

SEQ ID NO: 13243 - protein, 10 aa, Artificial Sequence
  source: /note="Description of Artificial Sequence: Synthetic peptide"
CFAFIFSALI

SEQ ID NO: 13244 - protein, 10 aa, Artificial Sequence
  source: /note="Description of Artificial Sequence: Synthetic peptide"
AFIFSALIEF

SEQ ID NO: 13245 - protein, 10 aa, Artificial Sequence
  source: /note="Description of Artificial Sequence: Synthetic peptide"
FIAVCFAFIF

SEQ ID NO: 13246 - protein, 10 aa, Artificial Sequence
  source: /note="Description of Artificial Sequence: Synthetic peptide"
VCFAFIFSAL

SEQ ID NO: 13247 - protein, 9 aa, Artificial Sequence
  source: /note="Description of Artificial Sequence: Synthetic peptide"
SSREAYGCA

SEQ ID NO: 13248 - protein, 9 aa, Artificial Sequence
  source: /note="Description of Artificial Sequence: Synthetic peptide"
EAYGCALDR

SEQ ID NO: 13249 - protein, 9 aa, Artificial Sequence
  source: /note="Description of Artificial Sequence: Synthetic peptide"
SREAYGCAL

SEQ ID NO: 13250 - protein, 10 aa, Artificial Sequence
  source: /note="Description of Artificial Sequence: Synthetic peptide"
SSREAYGCAL

SEQ ID NO: 13251 - protein, 9 aa, Artificial Sequence
  source: /note="Description of Artificial Sequence: Synthetic peptide"
LTNVNAIDR

SEQ ID NO: 13252 - protein, 9 aa, Artificial Sequence
  source: /note="Description of Artificial Sequence: Synthetic peptide"
IKIPDLTNV

SEQ ID NO: 13253 - protein, 10 aa, Artificial Sequence
  source: /note="Description of Artificial Sequence: Synthetic peptide"
KIKIPDLTNV

SEQ ID NO: 13254 - protein, 10 aa, Artificial Sequence
  source: /note="Description of Artificial Sequence: Synthetic peptide"
KIPDLTNVNA

SEQ ID NO: 13255 - protein, 10 aa, Artificial Sequence
  source: /note="Description of Artificial Sequence: Synthetic peptide"
DLTNVNAIDR

SEQ ID NO: 13256 - protein, 10 aa, Artificial Sequence
  source: /note="Description of Artificial Sequence: Synthetic peptide"
NVNAIDRWSR

SEQ ID NO: 13257 - protein, 10 aa, Artificial Sequence
  source: /note="Description of Artificial Sequence: Synthetic peptide"
IPDLTNVNAI

SEQ ID NO: 13258 - protein, 9 aa, Artificial Sequence
  source: /note="Description of Artificial Sequence: Synthetic peptide"
FLGERALGL

SEQ ID NO: 13259 - protein, 9 aa, Artificial Sequence
  source: /note="Description of Artificial Sequence: Synthetic peptide"
RLRPSMSST

SEQ ID NO: 13260 - protein, 9 aa, Artificial Sequence
  source: /note="Description of Artificial Sequence: Synthetic peptide"
ATLACPGAR

SEQ ID NO: 13261 - protein, 9 aa, Artificial Sequence
  source: /note="Description of Artificial Sequence: Synthetic peptide"
ALGLPSPLR

SEQ ID NO: 13262 - protein, 9 aa, Artificial Sequence
  source: /note="Description of Artificial Sequence: Synthetic peptide"
RVSKWDDSR

SEQ ID NO: 13263 - protein, 9 aa, Artificial Sequence
  source: /note="Description of Artificial Sequence: Synthetic peptide"
TFTPALCSL

SEQ ID NO: 13264 - protein, 9 aa, Artificial Sequence
  source: /note="Description of Artificial Sequence: Synthetic peptide"
AARSGGQGA

SEQ ID NO: 13265 - protein, 9 aa, Artificial Sequence
  source: /note="Description of Artificial Sequence: Synthetic peptide"
RSGGQGASV

SEQ ID NO: 13266 - protein, 9 aa, Artificial Sequence
  source: /note="Description of Artificial Sequence: Synthetic peptide"
SLRRLRPSM

SEQ ID NO: 13267 - protein, 9 aa, Artificial Sequence
  source: /note="Description of Artificial Sequence: Synthetic peptide"
RQLPRNFLG

SEQ ID NO: 13268 - protein, 9 aa, Artificial Sequence
  source: /note="Description of Artificial Sequence: Synthetic peptide"
RALGLPSPL

SEQ ID NO: 13269 - protein, 9 aa, Artificial Sequence
  source: /note="Description of Artificial Sequence: Synthetic peptide"
KWDDSRPRK

SEQ ID NO: 13270 - protein, 9 aa, Artificial Sequence
  source: /note="Description of Artificial Sequence: Synthetic peptide"
KTRGSLGLP

SEQ ID NO: 13271 - protein, 9 aa, Artificial Sequence
  source: /note="Description of Artificial Sequence: Synthetic peptide"
FTPALCSLR

SEQ ID NO: 13272 - protein, 9 aa, Artificial Sequence
  source: /note="Description of Artificial Sequence: Synthetic peptide"
ALCSLRRLR

SEQ ID NO: 13273 - protein, 9 aa, Artificial Sequence
  source: /note="Description of Artificial Sequence: Synthetic peptide"
TLACPGARR

SEQ ID NO: 13274 - protein, 9 aa, Artificial Sequence
  source: /note="Description of Artificial Sequence: Synthetic peptide"
QTPLTFTPA

SEQ ID NO: 13275 - protein, 9 aa, Artificial Sequence
  source: /note="Description of Artificial Sequence: Synthetic peptide"
TPLTFTPAL

SEQ ID NO: 13276 - protein, 9 aa, Artificial Sequence
  source: /note="Description of Artificial Sequence: Synthetic peptide"
RPRKTRGSL

SEQ ID NO: 13277 - protein, 9 aa, Artificial Sequence
  source: /note="Description of Artificial Sequence: Synthetic peptide"
PSTQTPLTF

SEQ ID NO: 13278 - protein, 9 aa, Artificial Sequence
  source: /note="Description of Artificial Sequence: Synthetic peptide"
CEHRTQATL

SEQ ID NO: 13279 - protein, 9 aa, Artificial Sequence
  source: /note="Description of Artificial Sequence: Synthetic peptide"
TQATLACPG

SEQ ID NO: 13280 - protein, 9 aa, Artificial Sequence
  source: /note="Description of Artificial Sequence: Synthetic peptide"
ARRQLPRNF

SEQ ID NO: 13281 - protein, 9 aa, Artificial Sequence
  source: /note="Description of Artificial Sequence: Synthetic peptide"
RRQLPRNFL

SEQ ID NO: 13282 - protein, 9 aa, Artificial Sequence
  source: /note="Description of Artificial Sequence: Synthetic peptide"
RNFLGERAL

SEQ ID NO: 13283 - protein, 9 aa, Artificial Sequence
  source: /note="Description of Artificial Sequence: Synthetic peptide"
GERALGLPS

SEQ ID NO: 13284 - protein, 9 aa, Artificial Sequence
  source: /note="Description of Artificial Sequence: Synthetic peptide"
RKTRGSLGL

SEQ ID NO: 13285 - protein, 9 aa, Artificial Sequence
  source: /note="Description of Artificial Sequence: Synthetic peptide"
RGSLGLPEL

SEQ ID NO: 13286 - protein, 10 aa, Artificial Sequence
  source: /note="Description of Artificial Sequence: Synthetic peptide"
ALGLPSPLRV

SEQ ID NO: 13287 - protein, 10 aa, Artificial Sequence
  source: /note="Description of Artificial Sequence: Synthetic peptide"
ATLACPGARR

SEQ ID NO: 13288 - protein, 10 aa, Artificial Sequence
  source: /note="Description of Artificial Sequence: Synthetic peptide"
RALGLPSPLR

SEQ ID NO: 13289 - protein, 10 aa, Artificial Sequence
  source: /note="Description of Artificial Sequence: Synthetic peptide"
CSLRRLRPSM

SEQ ID NO: 13290 - protein, 10 aa, Artificial Sequence
  source: /note="Description of Artificial Sequence: Synthetic peptide"
SLRRLRPSMS

SEQ ID NO: 13291 - protein, 10 aa, Artificial Sequence
  source: /note="Description of Artificial Sequence: Synthetic peptide"
RLRPSMSSTG

SEQ ID NO: 13292 - protein, 10 aa, Artificial Sequence
  source: /note="Description of Artificial Sequence: Synthetic peptide"
RTQATLACPG

SEQ ID NO: 13293 - protein, 10 aa, Artificial Sequence
  source: /note="Description of Artificial Sequence: Synthetic peptide"
KTRGSLGLPE

SEQ ID NO: 13294 - protein, 10 aa, Artificial Sequence
  source: /note="Description of Artificial Sequence: Synthetic peptide"
TFTPALCSLR

SEQ ID NO: 13295 - protein, 10 aa, Artificial Sequence
  source: /note="Description of Artificial Sequence: Synthetic peptide"
QTPLTFTPAL

SEQ ID NO: 13296 - protein, 10 aa, Artificial Sequence
  source: /note="Description of Artificial Sequence: Synthetic peptide"
LTFTPALCSL

SEQ ID NO: 13297 - protein, 10 aa, Artificial Sequence
  source: /note="Description of Artificial Sequence: Synthetic peptide"
TPALCSLRRL

SEQ ID NO: 13298 - protein, 10 aa, Artificial Sequence
  source: /note="Description of Artificial Sequence: Synthetic peptide"
LPRNFLGERA

SEQ ID NO: 13299 - protein, 10 aa, Artificial Sequence
  source: /note="Description of Artificial Sequence: Synthetic peptide"
RPRKTRGSLG

SEQ ID NO: 13300 - protein, 10 aa, Artificial Sequence
  source: /note="Description of Artificial Sequence: Synthetic peptide"
GSGPSTQTPL

SEQ ID NO: 13301 - protein, 10 aa, Artificial Sequence
  source: /note="Description of Artificial Sequence: Synthetic peptide"
GPSTQTPLTF

SEQ ID NO: 13302 - protein, 10 aa, Artificial Sequence
  source: /note="Description of Artificial Sequence: Synthetic peptide"
TQTPLTFTPA

SEQ ID NO: 13303 - protein, 10 aa, Artificial Sequence
  source: /note="Description of Artificial Sequence: Synthetic peptide"
TQATLACPGA

SEQ ID NO: 13304 - protein, 10 aa, Artificial Sequence
  source: /note="Description of Artificial Sequence: Synthetic peptide"
LACPGARRQL

SEQ ID NO: 13305 - protein, 10 aa, Artificial Sequence
  source: /note="Description of Artificial Sequence: Synthetic peptide"
GARRQLPRNF

SEQ ID NO: 13306 - protein, 10 aa, Artificial Sequence
  source: /note="Description of Artificial Sequence: Synthetic peptide"
RQLPRNFLGE

SEQ ID NO: 13307 - protein, 10 aa, Artificial Sequence
  source: /note="Description of Artificial Sequence: Synthetic peptide"
ERALGLPSPL

SEQ ID NO: 13308 - protein, 10 aa, Artificial Sequence
  source: /note="Description of Artificial Sequence: Synthetic peptide"
TRGSLGLPEL

SEQ ID NO: 13309 - protein, 10 aa, Artificial Sequence
  source: /note="Description of Artificial Sequence: Synthetic peptide"
LPSPLRVSKW

SEQ ID NO: 13310 - protein, 10 aa, Artificial Sequence
  source: /note="Description of Artificial Sequence: Synthetic peptide"
CEHRTQATLA

SEQ ID NO: 13311 - protein, 10 aa, Artificial Sequence
  source: /note="Description of Artificial Sequence: Synthetic peptide"
GERALGLPSP

SEQ ID NO: 13312 - protein, 9 aa, Artificial Sequence
  source: /note="Description of Artificial Sequence: Synthetic peptide"
KFSSYGYPK

SEQ ID NO: 13313 - protein, 9 aa, Artificial Sequence
  source: /note="Description of Artificial Sequence: Synthetic peptide"
PLKFSSYGY

SEQ ID NO: 13314 - protein, 9 aa, Artificial Sequence
  source: /note="Description of Artificial Sequence: Synthetic peptide"
DEHSCPLKF

SEQ ID NO: 13315 - protein, 10 aa, Artificial Sequence
  source: /note="Description of Artificial Sequence: Synthetic peptide"
HSCPLKFSSY

SEQ ID NO: 13316 - protein, 10 aa, Artificial Sequence
  source: /note="Description of Artificial Sequence: Synthetic peptide"
CPLKFSSYGY

SEQ ID NO: 13317 - protein, 10 aa, Artificial Sequence
  source: /note="Description of Artificial Sequence: Synthetic peptide"
MDEHSCPLKF

SEQ ID NO: 13318 - protein, 9 aa, Artificial Sequence
  source: /note="Description of Artificial Sequence: Synthetic peptide"
VFLSVLEYV

SEQ ID NO: 13319 - protein, 9 aa, Artificial Sequence
  source: /note="Description of Artificial Sequence: Synthetic peptide"
FLSVLEYVA

SEQ ID NO: 13320 - protein, 9 aa, Artificial Sequence
  source: /note="Description of Artificial Sequence: Synthetic peptide"
VAVNYLTTV

SEQ ID NO: 13321 - protein, 9 aa, Artificial Sequence
  source: /note="Description of Artificial Sequence: Synthetic peptide"
VLEYVAVNY

SEQ ID NO: 13322 - protein, 9 aa, Artificial Sequence
  source: /note="Description of Artificial Sequence: Synthetic peptide"
LEYVAVNYL

SEQ ID NO: 13323 - protein, 10 aa, Artificial Sequence
  source: /note="Description of Artificial Sequence: Synthetic peptide"
FVFLSVLEYV

SEQ ID NO: 13324 - protein, 10 aa, Artificial Sequence
  source: /note="Description of Artificial Sequence: Synthetic peptide"
FLSVLEYVAV

SEQ ID NO: 13325 - protein, 10 aa, Artificial Sequence
  source: /note="Description of Artificial Sequence: Synthetic peptide"
VLEYVAVNYL

SEQ ID NO: 13326 - protein, 10 aa, Artificial Sequence
  source: /note="Description of Artificial Sequence: Synthetic peptide"
YVAVNYLTTV

SEQ ID NO: 13327 - protein, 10 aa, Artificial Sequence
  source: /note="Description of Artificial Sequence: Synthetic peptide"
SVLEYVAVNY

SEQ ID NO: 13328 - protein, 10 aa, Artificial Sequence
  source: /note="Description of Artificial Sequence: Synthetic peptide"
LEYVAVNYLT

SEQ ID NO: 13329 - protein, 9 aa, Artificial Sequence
  source: /note="Description of Artificial Sequence: Synthetic peptide"
KSDILKKCY

SEQ ID NO: 13330 - protein, 9 aa, Artificial Sequence
  source: /note="Description of Artificial Sequence: Synthetic peptide"
ILKKCYSAK

SEQ ID NO: 13331 - protein, 10 aa, Artificial Sequence
  source: /note="Description of Artificial Sequence: Synthetic peptide"
ILKKCYSAKA

SEQ ID NO: 13332 - protein, 10 aa, Artificial Sequence
  source: /note="Description of Artificial Sequence: Synthetic peptide"
LVKDKSDILK

SEQ ID NO: 13333 - protein, 10 aa, Artificial Sequence
  source: /note="Description of Artificial Sequence: Synthetic peptide"
DILKKCYSAK

SEQ ID NO: 13334 - protein, 9 aa, Artificial Sequence
  source: /note="Description of Artificial Sequence: Synthetic peptide"
SASSRLAAI

SEQ ID NO: 13335 - protein, 9 aa, Artificial Sequence
  source: /note="Description of Artificial Sequence: Synthetic peptide"
KLNARSASS

SEQ ID NO: 13336 - protein, 9 aa, Artificial Sequence
  source: /note="Description of Artificial Sequence: Synthetic peptide"
RSASSRLAA

SEQ ID NO: 13337 - protein, 9 aa, Artificial Sequence
  source: /note="Description of Artificial Sequence: Synthetic peptide"
NARSASSRL

SEQ ID NO: 13338 - protein, 9 aa, Artificial Sequence
  source: /note="Description of Artificial Sequence: Synthetic peptide"
YAKLNARSA

SEQ ID NO: 13339 - protein, 10 aa, Artificial Sequence
  source: /note="Description of Artificial Sequence: Synthetic peptide"
VLYAKLNARS

SEQ ID NO: 13340 - protein, 10 aa, Artificial Sequence
  source: /note="Description of Artificial Sequence: Synthetic peptide"
KLNARSASSR

SEQ ID NO: 13341 - protein, 10 aa, Artificial Sequence
  source: /note="Description of Artificial Sequence: Synthetic peptide"
NARSASSRLA

SEQ ID NO: 13342 - protein, 10 aa, Artificial Sequence
  source: /note="Description of Artificial Sequence: Synthetic peptide"
RSASSRLAAI

SEQ ID NO: 13343 - protein, 10 aa, Artificial Sequence
  source: /note="Description of Artificial Sequence: Synthetic peptide"
LNARSASSRL

SEQ ID NO: 13344 - protein, 10 aa, Artificial Sequence
  source: /note="Description of Artificial Sequence: Synthetic peptide"
ARSASSRLAA

SEQ ID NO: 13345 - protein, 9 aa, Artificial Sequence
  source: /note="Description of Artificial Sequence: Synthetic peptide"
GGTCHVINK

SEQ ID NO: 13346 - protein, 9 aa, Artificial Sequence
  source: /note="Description of Artificial Sequence: Synthetic peptide"
YTFPGGTCH

SEQ ID NO: 13347 - protein, 9 aa, Artificial Sequence
  source: /note="Description of Artificial Sequence: Synthetic peptide"
FPGGTCHVI

SEQ ID NO: 13348 - protein, 10 aa, Artificial Sequence
  source: /note="Description of Artificial Sequence: Synthetic peptide"
YTFPGGTCHV

SEQ ID NO: 13349 - protein, 10 aa, Artificial Sequence
  source: /note="Description of Artificial Sequence: Synthetic peptide"
TFPGGTCHVI

SEQ ID NO: 13350 - protein, 9 aa, Artificial Sequence
  source: /note="Description of Artificial Sequence: Synthetic peptide"
RVVCPVIEI

SEQ ID NO: 13351 - protein, 9 aa, Artificial Sequence
  source: /note="Description of Artificial Sequence: Synthetic peptide"
IEIINLDTF

SEQ ID NO: 13352 - protein, 9 aa, Artificial Sequence
  source: /note="Description of Artificial Sequence: Synthetic peptide"
CPVIEIINL

SEQ ID NO: 13353 - protein, 10 aa, Artificial Sequence
  source: /note="Description of Artificial Sequence: Synthetic peptide"
EIINLDTFTY

SEQ ID NO: 13354 - protein, 10 aa, Artificial Sequence
  source: /note="Description of Artificial Sequence: Synthetic peptide"
RVVCPVIEII

SEQ ID NO: 13355 - protein, 9 aa, Artificial Sequence
  source: /note="Description of Artificial Sequence: Synthetic peptide"
AQMDIWGGR

SEQ ID NO: 13356 - protein, 9 aa, Artificial Sequence
  source: /note="Description of Artificial Sequence: Synthetic peptide"
MDIWGGREF

SEQ ID NO: 13357 - protein, 10 aa, Artificial Sequence
  source: /note="Description of Artificial Sequence: Synthetic peptide"
DAQMDIWGGR

SEQ ID NO: 13358 - protein, 10 aa, Artificial Sequence
  source: /note="Description of Artificial Sequence: Synthetic peptide"
QMDIWGGREF

SEQ ID NO: 13359 - protein, 9 aa, Artificial Sequence
  source: /note="Description of Artificial Sequence: Synthetic peptide"
SLRGGENLK

SEQ ID NO: 13360 - protein, 9 aa, Artificial Sequence
  source: /note="Description of Artificial Sequence: Synthetic peptide"
GGENLKLSF

SEQ ID NO: 13361 - protein, 9 aa, Artificial Sequence
  source: /note="Description of Artificial Sequence: Synthetic peptide"
NLKLSFKAW

SEQ ID NO: 13362 - protein, 9 aa, Artificial Sequence
  source: /note="Description of Artificial Sequence: Synthetic peptide"
LKLSFKAWL

SEQ ID NO: 13363 - protein, 10 aa, Artificial Sequence
  source: /note="Description of Artificial Sequence: Synthetic peptide"
SLRGGENLKL

SEQ ID NO: 13364 - protein, 10 aa, Artificial Sequence
  source: /note="Description of Artificial Sequence: Synthetic peptide"
MSLRGGENLK

SEQ ID NO: 13365 - protein, 10 aa, Artificial Sequence
  source: /note="Description of Artificial Sequence: Synthetic peptide"
NLKLSFKAWL

SEQ ID NO: 13366 - protein, 10 aa, Artificial Sequence
  source: /note="Description of Artificial Sequence: Synthetic peptide"
RGGENLKLSF

SEQ ID NO: 13367 - protein, 10 aa, Artificial Sequence
  source: /note="Description of Artificial Sequence: Synthetic peptide"
GENLKLSFKA

SEQ ID NO: 13368 - protein, 9 aa, Artificial Sequence
  source: /note="Description of Artificial Sequence: Synthetic peptide"
LSTWSPGKK

SEQ ID NO: 13369 - protein, 9 aa, Artificial Sequence
  source: /note="Description of Artificial Sequence: Synthetic peptide"
KSQEPLSTW

SEQ ID NO: 13370 - protein, 10 aa, Artificial Sequence
  source: /note="Description of Artificial Sequence: Synthetic peptide"
KKSQEPLSTW

SEQ ID NO: 13371 - protein, 9 aa, Artificial Sequence
  source: /note="Description of Artificial Sequence: Synthetic peptide"
VIDDITLEY

SEQ ID NO: 13372 - protein, 9 aa, Artificial Sequence
  source: /note="Description of Artificial Sequence: Synthetic peptide"
PLIDVIDDI

SEQ ID NO: 13373 - protein, 10 aa, Artificial Sequence
  source: /note="Description of Artificial Sequence: Synthetic peptide"
VIDDITLEYK

SEQ ID NO: 13374 - protein, 10 aa, Artificial Sequence
  source: /note="Description of Artificial Sequence: Synthetic peptide"
DVIDDITLEY

SEQ ID NO: 13375 - protein, 10 aa, Artificial Sequence
  source: /note="Description of Artificial Sequence: Synthetic peptide"
ITLEYKPSPL

SEQ ID NO: 13376 - protein, 10 aa, Artificial Sequence
  source: /note="Description of Artificial Sequence: Synthetic peptide"
CPLIDVIDDI

SEQ ID NO: 13377 - protein, 9 aa, Artificial Sequence
  source: /note="Description of Artificial Sequence: Synthetic peptide"
NPAEKIFMA

SEQ ID NO: 13378 - protein, 10 aa, Artificial Sequence
  source: /note="Description of Artificial Sequence: Synthetic peptide"
CMDCNPAEKI

SEQ ID NO: 13379 - protein, 10 aa, Artificial Sequence
  source: /note="Description of Artificial Sequence: Synthetic peptide"
NPAEKIFMAR

SEQ ID NO: 13380 - protein, 10 aa, Artificial Sequence
  source: /note="Description of Artificial Sequence: Synthetic peptide"
MDCNPAEKIF

SEQ ID NO: 13381 - protein, 9 aa, Artificial Sequence
  source: /note="Description of Artificial Sequence: Synthetic peptide"
RSLSAASCA

SEQ ID NO: 13382 - protein, 9 aa, Artificial Sequence
  source: /note="Description of Artificial Sequence: Synthetic peptide"
LSAASCAPI

SEQ ID NO: 13383 - protein, 9 aa, Artificial Sequence
  source: /note="Description of Artificial Sequence: Synthetic peptide"
APISLPAAA

SEQ ID NO: 13384 - protein, 9 aa, Artificial Sequence
  source: /note="Description of Artificial Sequence: Synthetic peptide"
AASCAPISL

SEQ ID NO: 13385 - protein, 10 aa, Artificial Sequence
  source: /note="Description of Artificial Sequence: Synthetic peptide"
SLSAASCAPI

SEQ ID NO: 13386 - protein, 10 aa, Artificial Sequence
  source: /note="Description of Artificial Sequence: Synthetic peptide"
SAASCAPISL

SEQ ID NO: 13387 - protein, 9 aa, Artificial Sequence
  source: /note="Description of Artificial Sequence: Synthetic peptide"
FEKKRPEWL

SEQ ID NO: 13388 - protein, 10 aa, Artificial Sequence
  source: /note="Description of Artificial Sequence: Synthetic peptide"
FSFEKKRPEW

SEQ ID NO: 13389 - protein, 9 aa, Artificial Sequence
  source: /note="Description of Artificial Sequence: Synthetic peptide"
RELALPPPA

SEQ ID NO: 13390 - protein, 10 aa, Artificial Sequence
  source: /note="Description of Artificial Sequence: Synthetic peptide"
LPPPAPSPPA

SEQ ID NO: 13391 - protein, 10 aa, Artificial Sequence
  source: /note="Description of Artificial Sequence: Synthetic peptide"
RELALPPPAP

SEQ ID NO: 13392 - protein, 9 aa, Artificial Sequence
  source: /note="Description of Artificial Sequence: Synthetic peptide"
TTSRVASTV

SEQ ID NO: 13393 - protein, 9 aa, Artificial Sequence
  source: /note="Description of Artificial Sequence: Synthetic peptide"
ATAASSSPL

SEQ ID NO: 13394 - protein, 9 aa, Artificial Sequence
  source: /note="Description of Artificial Sequence: Synthetic peptide"
KMSTNAARR

SEQ ID NO: 13395 - protein, 9 aa, Artificial Sequence
  source: /note="Description of Artificial Sequence: Synthetic peptide"
GWGAGSATK

SEQ ID NO: 13396 - protein, 9 aa, Artificial Sequence
  source: /note="Description of Artificial Sequence: Synthetic peptide"
ATKMSTNAA

SEQ ID NO: 13397 - protein, 9 aa, Artificial Sequence
  source: /note="Description of Artificial Sequence: Synthetic peptide"
ARRTGAASR

SEQ ID NO: 13398 - protein, 9 aa, Artificial Sequence
  source: /note="Description of Artificial Sequence: Synthetic peptide"
RTGAASRSA

SEQ ID NO: 13399 - protein, 9 aa, Artificial Sequence
  source: /note="Description of Artificial Sequence: Synthetic peptide"
ASRSATTSR

SEQ ID NO: 13400 - protein, 9 aa, Artificial Sequence
  source: /note="Description of Artificial Sequence: Synthetic peptide"
RSATTSRVA

SEQ ID NO: 13401 - protein, 9 aa, Artificial Sequence
  source: /note="Description of Artificial Sequence: Synthetic peptide"
STVPATAAS

SEQ ID NO: 13402 - protein, 9 aa, Artificial Sequence
  source: /note="Description of Artificial Sequence: Synthetic peptide"
NAARRTGAA

SEQ ID NO: 13403 - protein, 9 aa, Artificial Sequence
  source: /note="Description of Artificial Sequence: Synthetic peptide"
WGAGSATKM

SEQ ID NO: 13404 - protein, 9 aa, Artificial Sequence
  source: /note="Description of Artificial Sequence: Synthetic peptide"
SRVASTVPA

SEQ ID NO: 13405 - protein, 9 aa, Artificial Sequence
  source: /note="Description of Artificial Sequence: Synthetic peptide"
TAASSSPLM

SEQ ID NO: 13406 - protein, 10 aa, Artificial Sequence
  source: /note="Description of Artificial Sequence: Synthetic peptide"
ATTSRVASTV

SEQ ID NO: 13407 - protein, 10 aa, Artificial Sequence
  source: /note="Description of Artificial Sequence: Synthetic peptide"
RVASTVPATA

SEQ ID NO: 13408 - protein, 10 aa, Artificial Sequence
  source: /note="Description of Artificial Sequence: Synthetic peptide"
ATKMSTNAAR

SEQ ID NO: 13409 - protein, 10 aa, Artificial Sequence
  source: /note="Description of Artificial Sequence: Synthetic peptide"
AASRSATTSR

SEQ ID NO: 13410 - protein, 10 aa, Artificial Sequence
  source: /note="Description of Artificial Sequence: Synthetic peptide"
SSPLMAGPAK

SEQ ID NO: 13411 - protein, 10 aa, Artificial Sequence
  source: /note="Description of Artificial Sequence: Synthetic peptide"
AGWGAGSATK

SEQ ID NO: 13412 - protein, 10 aa, Artificial Sequence
  source: /note="Description of Artificial Sequence: Synthetic peptide"
STNAARRTGA

SEQ ID NO: 13413 - protein, 10 aa, Artificial Sequence
  source: /note="Description of Artificial Sequence: Synthetic peptide"
AARRTGAASR

SEQ ID NO: 13414 - protein, 10 aa, Artificial Sequence
  source: /note="Description of Artificial Sequence: Synthetic peptide"
RTGAASRSAT

SEQ ID NO: 13415 - protein, 10 aa, Artificial Sequence
  source: /note="Description of Artificial Sequence: Synthetic peptide"
ASRSATTSRV

SEQ ID NO: 13416 - protein, 10 aa, Artificial Sequence
  source: /note="Description of Artificial Sequence: Synthetic peptide"
TSRVASTVPA

SEQ ID NO: 13417 - protein, 10 aa, Artificial Sequence
  source: /note="Description of Artificial Sequence: Synthetic peptide"
ATAASSSPLM

SEQ ID NO: 13418 - protein, 10 aa, Artificial Sequence
  source: /note="Description of Artificial Sequence: Synthetic peptide"
SRVASTVPAT

SEQ ID NO: 13419 - protein, 9 aa, Artificial Sequence
  source: /note="Description of Artificial Sequence: Synthetic peptide"
ILLCTKASL

SEQ ID NO: 13420 - protein, 9 aa, Artificial Sequence
  source: /note="Description of Artificial Sequence: Synthetic peptide"
LLCTKASLK

SEQ ID NO: 13421 - protein, 9 aa, Artificial Sequence
  source: /note="Description of Artificial Sequence: Synthetic peptide"
KASLKVREK

SEQ ID NO: 13422 - protein, 9 aa, Artificial Sequence
  source: /note="Description of Artificial Sequence: Synthetic peptide"
CTKASLKVR

SEQ ID NO: 13423 - protein, 9 aa, Artificial Sequence
  source: /note="Description of Artificial Sequence: Synthetic peptide"
SLKVREKEL

SEQ ID NO: 13424 - protein, 10 aa, Artificial Sequence
  source: /note="Description of Artificial Sequence: Synthetic peptide"
LLCTKASLKV

SEQ ID NO: 13425 - protein, 10 aa, Artificial Sequence
  source: /note="Description of Artificial Sequence: Synthetic peptide"
ILLCTKASLK

SEQ ID NO: 13426 - protein, 10 aa, Artificial Sequence
  source: /note="Description of Artificial Sequence: Synthetic peptide"
SLKVREKELK

SEQ ID NO: 13427 - protein, 10 aa, Artificial Sequence
  source: /note="Description of Artificial Sequence: Synthetic peptide"
KQILLCTKAS

SEQ ID NO: 13428 - protein, 9 aa, Artificial Sequence
  source: /note="Description of Artificial Sequence: Synthetic peptide"
CLQCLWALL

SEQ ID NO: 13429 - protein, 9 aa, Artificial Sequence
  source: /note="Description of Artificial Sequence: Synthetic peptide"
WALLQASQY

SEQ ID NO: 13430 - protein, 9 aa, Artificial Sequence
  source: /note="Description of Artificial Sequence: Synthetic peptide"
RNANGGPCL

SEQ ID NO: 13431 - protein, 10 aa, Artificial Sequence
  source: /note="Description of Artificial Sequence: Synthetic peptide"
LWALLQASQY

SEQ ID NO: 13432 - protein, 10 aa, Artificial Sequence
  source: /note="Description of Artificial Sequence: Synthetic peptide"
RRNANGGPCL

SEQ ID NO: 13433 - protein, 10 aa, Artificial Sequence
  source: /note="Description of Artificial Sequence: Synthetic peptide"
LQCLWALLQA

SEQ ID NO: 13434 - protein, 9 aa, Artificial Sequence
  source: /note="Description of Artificial Sequence: Synthetic peptide"
VLPEPHLAL

SEQ ID NO: 13435 - protein, 9 aa, Artificial Sequence
  source: /note="Description of Artificial Sequence: Synthetic peptide"
ALQPLQPHA

SEQ ID NO: 13436 - protein, 9 aa, Artificial Sequence
  source: /note="Description of Artificial Sequence: Synthetic peptide"
AIQPVLWTT

SEQ ID NO: 13437 - protein, 9 aa, Artificial Sequence
  source: /note="Description of Artificial Sequence: Synthetic peptide"
MLTGPPARV

SEQ ID NO: 13438 - protein, 9 aa, Artificial Sequence
  source: /note="Description of Artificial Sequence: Synthetic peptide"
FLKAESKIM

SEQ ID NO: 13439 - protein, 9 aa, Artificial Sequence
  source: /note="Description of Artificial Sequence: Synthetic peptide"
IMFATLQRS

SEQ ID NO: 13440 - protein, 9 aa, Artificial Sequence
  source: /note="Description of Artificial Sequence: Synthetic peptide"
YMFLKAESK

SEQ ID NO: 13441 - protein, 9 aa, Artificial Sequence
  source: /note="Description of Artificial Sequence: Synthetic peptide"
KIMFATLQR

SEQ ID NO: 13442 - protein, 9 aa, Artificial Sequence
  source: /note="Description of Artificial Sequence: Synthetic peptide"
SMLTGPPAR

SEQ ID NO: 13443 - protein, 9 aa, Artificial Sequence
  source: /note="Description of Artificial Sequence: Synthetic peptide"
HFCRSSIMK

SEQ ID NO: 13444 - protein, 9 aa, Artificial Sequence
  source: /note="Description of Artificial Sequence: Synthetic peptide"
MFLKAESKI

SEQ ID NO: 13445 - protein, 9 aa, Artificial Sequence
  source: /note="Description of Artificial Sequence: Synthetic peptide"
CSMLTGPPA

SEQ ID NO: 13446 - protein, 9 aa, Artificial Sequence
  source: /note="Description of Artificial Sequence: Synthetic peptide"
RSSIMKPKR

SEQ ID NO: 13447 - protein, 9 aa, Artificial Sequence
  source: /note="Description of Artificial Sequence: Synthetic peptide"
IMKPKRDGY

SEQ ID NO: 13448 - protein, 9 aa, Artificial Sequence
  source: /note="Description of Artificial Sequence: Synthetic peptide"
KAESKIMFA

SEQ ID NO: 13449 - protein, 9 aa, Artificial Sequence
  source: /note="Description of Artificial Sequence: Synthetic peptide"
VPFDLHFCR

SEQ ID NO: 13450 - protein, 9 aa, Artificial Sequence
  source: /note="Description of Artificial Sequence: Synthetic peptide"
AALSRHNVL

SEQ ID NO: 13451 - protein, 9 aa, Artificial Sequence
  source: /note="Description of Artificial Sequence: Synthetic peptide"
EPHLALQPL

SEQ ID NO: 13452 - protein, 9 aa, Artificial Sequence
  source: /note="Description of Artificial Sequence: Synthetic peptide"
GPPARVPAV

SEQ ID NO: 13453 - protein, 9 aa, Artificial Sequence
  source: /note="Description of Artificial Sequence: Synthetic peptide"
KPKRDGYMF

SEQ ID NO: 13454 - protein, 9 aa, Artificial Sequence
  source: /note="Description of Artificial Sequence: Synthetic peptide"
FATLQRSSL

SEQ ID NO: 13455 - protein, 9 aa, Artificial Sequence
  source: /note="Description of Artificial Sequence: Synthetic peptide"
DLHFCRSSI

SEQ ID NO: 13456 - protein, 9 aa, Artificial Sequence
  source: /note="Description of Artificial Sequence: Synthetic peptide"
LHFCRSSIM

SEQ ID NO: 13457 - protein, 9 aa, Artificial Sequence
  source: /note="Description of Artificial Sequence: Synthetic peptide"
ESKIMFATL

SEQ ID NO: 13458 - protein, 9 aa, Artificial Sequence
  source: /note="Description of Artificial Sequence: Synthetic peptide"
LALQPLQPH

SEQ ID NO: 13459 - protein, 9 aa, Artificial Sequence
  source: /note="Description of Artificial Sequence: Synthetic peptide"
LQPHADHAH

SEQ ID NO: 13460 - protein, 9 aa, Artificial Sequence
  source: /note="Description of Artificial Sequence: Synthetic peptide"
HAHADAPAI

SEQ ID NO: 13461 - protein, 9 aa, Artificial Sequence
  source: /note="Description of Artificial Sequence: Synthetic peptide"
LQHGHRHGL

SEQ ID NO: 13462 - protein, 9 aa, Artificial Sequence
  source: /note="Description of Artificial Sequence: Synthetic peptide"
RHGLEPCSM

SEQ ID NO: 13463 - protein, 9 aa, Artificial Sequence
  source: /note="Description of Artificial Sequence: Synthetic peptide"
PARVPAVPF

SEQ ID NO: 13464 - protein, 9 aa, Artificial Sequence
  source: /note="Description of Artificial Sequence: Synthetic peptide"
PAVPFDLHF

SEQ ID NO: 13465 - protein, 9 aa, Artificial Sequence
  source: /note="Description of Artificial Sequence: Synthetic peptide"
LKAESKIMF

SEQ ID NO: 13466 - protein, 9 aa, Artificial Sequence
  source: /note="Description of Artificial Sequence: Synthetic peptide"
ATLQRSSLW

SEQ ID NO: 13467 - protein, 9 aa, Artificial Sequence
  source: /note="Description of Artificial Sequence: Synthetic peptide"
LQRSSLWCL

SEQ ID NO: 13468 - protein, 9 aa, Artificial Sequence
  source: /note="Description of Artificial Sequence: Synthetic peptide"
AESKIMFAT

SEQ ID NO: 13469 - protein, 9 aa, Artificial Sequence
  source: /note="Description of Artificial Sequence: Synthetic peptide"
ADAPAIQPV

SEQ ID NO: 13470 - protein, 9 aa, Artificial Sequence
  source: /note="Description of Artificial Sequence: Synthetic peptide"
APAIQPVLW

SEQ ID NO: 13471 - protein, 10 aa, Artificial Sequence
  source: /note="Description of Artificial Sequence: Synthetic peptide"
SMLTGPPARV

SEQ ID NO: 13472 - protein, 10 aa, Artificial Sequence
  source: /note="Description of Artificial Sequence: Synthetic peptide"
YMFLKAESKI

SEQ ID NO: 13473 - protein, 10 aa, Artificial Sequence
  source: /note="Description of Artificial Sequence: Synthetic peptide"
TLQRSSLWCL

SEQ ID NO: 13474 - protein, 10 aa, Artificial Sequence
  source: /note="Description of Artificial Sequence: Synthetic peptide"
CSMLTGPPAR

SEQ ID NO: 13475 - protein, 10 aa, Artificial Sequence
  source: /note="Description of Artificial Sequence: Synthetic peptide"
LHFCRSSIMK

SEQ ID NO: 13476 - protein, 10 aa, Artificial Sequence
  source: /note="Description of Artificial Sequence: Synthetic peptide"
FCRSSIMKPK

SEQ ID NO: 13477 - protein, 10 aa, Artificial Sequence
  source: /note="Description of Artificial Sequence: Synthetic peptide"
IMKPKRDGYM

SEQ ID NO: 13478 - protein, 10 aa, Artificial Sequence
  source: /note="Description of Artificial Sequence: Synthetic peptide"
GYMFLKAESK

SEQ ID NO: 13479 - protein, 10 aa, Artificial Sequence
  source: /note="Description of Artificial Sequence: Synthetic peptide"
SIMKPKRDGY

SEQ ID NO: 13480 - protein, 10 aa, Artificial Sequence
  source: /note="Description of Artificial Sequence: Synthetic peptide"
TTPPLQHGHR

SEQ ID NO: 13481 - protein, 10 aa, Artificial Sequence
  source: /note="Description of Artificial Sequence: Synthetic peptide"
AVPFDLHFCR

SEQ ID NO: 13482 - protein, 10 aa, Artificial Sequence
  source: /note="Description of Artificial Sequence: Synthetic peptide"
HADAPAIQPV

SEQ ID NO: 13483 - protein, 10 aa, Artificial Sequence
  source: /note="Description of Artificial Sequence: Synthetic peptide"
NPAALSRHNV

SEQ ID NO: 13484 - protein, 10 aa, Artificial Sequence
  source: /note="Description of Artificial Sequence: Synthetic peptide"
QPVLWTTPPL

SEQ ID NO: 13485 - protein, 10 aa, Artificial Sequence
  source: /note="Description of Artificial Sequence: Synthetic peptide"
KPKRDGYMFL

SEQ ID NO: 13486 - protein, 10 aa, Artificial Sequence
  source: /note="Description of Artificial Sequence: Synthetic peptide"
DLHFCRSSIM

SEQ ID NO: 13487 - protein, 10 aa, Artificial Sequence
  source: /note="Description of Artificial Sequence: Synthetic peptide"
MFATLQRSSL

SEQ ID NO: 13488 - protein, 10 aa, Artificial Sequence
  source: /note="Description of Artificial Sequence: Synthetic peptide"
FLKAESKIMF

SEQ ID NO: 13489 - protein, 10 aa, Artificial Sequence
  source: /note="Description of Artificial Sequence: Synthetic peptide"
RHNVLPEPHL

SEQ ID NO: 13490 - protein, 10 aa, Artificial Sequence
  source: /note="Description of Artificial Sequence: Synthetic peptide"
HLALQPLQPH

SEQ ID NO: 13491 - protein, 10 aa, Artificial Sequence
  source: /note="Description of Artificial Sequence: Synthetic peptide"
ADAPAIQPVL

SEQ ID NO: 13492 - protein, 10 aa, Artificial Sequence
  source: /note="Description of Artificial Sequence: Synthetic peptide"
HRHGLEPCSM

SEQ ID NO: 13493 - protein, 10 aa, Artificial Sequence
  source: /note="Description of Artificial Sequence: Synthetic peptide"
ARVPAVPFDL

SEQ ID NO: 13494 - protein, 10 aa, Artificial Sequence
  source: /note="Description of Artificial Sequence: Synthetic peptide"
VPAVPFDLHF

SEQ ID NO: 13495 - protein, 10 aa, Artificial Sequence
  source: /note="Description of Artificial Sequence: Synthetic peptide"
FDLHFCRSSI

SEQ ID NO: 13496 - protein, 10 aa, Artificial Sequence
  source: /note="Description of Artificial Sequence: Synthetic peptide"
MKPKRDGYMF

SEQ ID NO: 13497 - protein, 10 aa, Artificial Sequence
  source: /note="Description of Artificial Sequence: Synthetic peptide"
MFLKAESKIM

SEQ ID NO: 13498 - protein, 10 aa, Artificial Sequence
  source: /note="Description of Artificial Sequence: Synthetic peptide"
AESKIMFATL

SEQ ID NO: 13499 - protein, 10 aa, Artificial Sequence
  source: /note="Description of Artificial Sequence: Synthetic peptide"
IMFATLQRSS

SEQ ID NO: 13500 - protein, 10 aa, Artificial Sequence
  source: /note="Description of Artificial Sequence: Synthetic peptide"
FATLQRSSLW

SEQ ID NO: 13501 - protein, 10 aa, Artificial Sequence
  source: /note="Description of Artificial Sequence: Synthetic peptide"
LQRSSLWCLC

SEQ ID NO: 13502 - protein, 10 aa, Artificial Sequence
  source: /note="Description of Artificial Sequence: Synthetic peptide"
PPARVPAVPF

SEQ ID NO: 13503 - protein, 10 aa, Artificial Sequence
  source: /note="Description of Artificial Sequence: Synthetic peptide"
PEPHLALQPL

SEQ ID NO: 13504 - protein, 9 aa, Artificial Sequence
  source: /note="Description of Artificial Sequence: Synthetic peptide"
ALQPLQPHA

SEQ ID NO: 13505 - protein, 9 aa, Artificial Sequence
  source: /note="Description of Artificial Sequence: Synthetic peptide"
AIQPVLWTT

SEQ ID NO: 13506 - protein, 9 aa, Artificial Sequence
  source: /note="Description of Artificial Sequence: Synthetic peptide"
MLTGPPARV

SEQ ID NO: 13507 - protein, 9 aa, Artificial Sequence
  source: /note="Description of Artificial Sequence: Synthetic peptide"
FLKAESKIM

SEQ ID NO: 13508 - protein, 9 aa, Artificial Sequence
  source: /note="Description of Artificial Sequence: Synthetic peptide"
IMFATLQRS

SEQ ID NO: 13509 - protein, 9 aa, Artificial Sequence
  source: /note="Description of Artificial Sequence: Synthetic peptide"
YMFLKAESK

SEQ ID NO: 13510 - protein, 9 aa, Artificial Sequence
  source: /note="Description of Artificial Sequence: Synthetic peptide"
KIMFATLQR

SEQ ID NO: 13511 - protein, 9 aa, Artificial Sequence
  source: /note="Description of Artificial Sequence: Synthetic peptide"
SMLTGPPAR

SEQ ID NO: 13512 - protein, 9 aa, Artificial Sequence
  source: /note="Description of Artificial Sequence: Synthetic peptide"
HFCRSSIMK

SEQ ID NO: 13513 - protein, 9 aa, Artificial Sequence
  source: /note="Description of Artificial Sequence: Synthetic peptide"
MFLKAESKI

SEQ ID NO: 13514 - protein, 9 aa, Artificial Sequence
  source: /note="Description of Artificial Sequence: Synthetic peptide"
MSSLSHISA

SEQ ID NO: 13515 - protein, 9 aa, Artificial Sequence
  source: /note="Description of Artificial Sequence: Synthetic peptide"
SSLSHISAL

SEQ ID NO: 13516 - protein, 9 aa, Artificial Sequence
  source: /note="Description of Artificial Sequence: Synthetic peptide"
CSMLTGPPA

SEQ ID NO: 13517 - protein, 9 aa, Artificial Sequence
  source: /note="Description of Artificial Sequence: Synthetic peptide"
RSSIMKPKR

SEQ ID NO: 13518 - protein, 9 aa, Artificial Sequence
  source: /note="Description of Artificial Sequence: Synthetic peptide"
IMKPKRDGY

SEQ ID NO: 13519 - protein, 9 aa, Artificial Sequence
  source: /note="Description of Artificial Sequence: Synthetic peptide"
KAESKIMFA

SEQ ID NO: 13520 - protein, 9 aa, Artificial Sequence
  source: /note="Description of Artificial Sequence: Synthetic peptide"
VPFDLHFCR

SEQ ID NO: 13521 - protein, 9 aa, Artificial Sequence
  source: /note="Description of Artificial Sequence: Synthetic peptide"
GPPARVPAV

SEQ ID NO: 13522 - protein, 9 aa, Artificial Sequence
  source: /note="Description of Artificial Sequence: Synthetic peptide"
KPKRDGYMF

SEQ ID NO: 13523 - protein, 9 aa, Artificial Sequence
  source: /note="Description of Artificial Sequence: Synthetic peptide"
FATLQRSSL

SEQ ID NO: 13524 - protein, 9 aa, Artificial Sequence
  source: /note="Description of Artificial Sequence: Synthetic peptide"
DLHFCRSSI

SEQ ID NO: 13525 - protein, 9 aa, Artificial Sequence
  source: /note="Description of Artificial Sequence: Synthetic peptide"
LHFCRSSIM

SEQ ID NO: 13526 - protein, 9 aa, Artificial Sequence
  source: /note="Description of Artificial Sequence: Synthetic peptide"
ESKIMFATL

SEQ ID NO: 13527 - protein, 9 aa, Artificial Sequence
  source: /note="Description of Artificial Sequence: Synthetic peptide"
SHISALQPL

SEQ ID NO: 13528 - protein, 9 aa, Artificial Sequence
  source: /note="Description of Artificial Sequence: Synthetic peptide"
SALQPLQPH

SEQ ID NO: 13529 - protein, 9 aa, Artificial Sequence
  source: /note="Description of Artificial Sequence: Synthetic peptide"
LQPHADHAH

SEQ ID NO: 13530 - protein, 9 aa, Artificial Sequence
  source: /note="Description of Artificial Sequence: Synthetic peptide"
HAHADAPAI

SEQ ID NO: 13531 - protein, 9 aa, Artificial Sequence
  source: /note="Description of Artificial Sequence: Synthetic peptide"
LQHGHRHGL

SEQ ID NO: 13532 - protein, 9 aa, Artificial Sequence
  source: /note="Description of Artificial Sequence: Synthetic peptide"
RHGLEPCSM

SEQ ID NO: 13533 - protein, 9 aa, Artificial Sequence
  source: /note="Description of Artificial Sequence: Synthetic peptide"
PARVPAVPF

SEQ ID NO: 13534 - protein, 9 aa, Artificial Sequence
  source: /note="Description of Artificial Sequence: Synthetic peptide"
PAVPFDLHF

SEQ ID NO: 13535 - protein, 9 aa, Artificial Sequence
  source: /note="Description of Artificial Sequence: Synthetic peptide"
LKAESKIMF

SEQ ID NO: 13536 - protein, 9 aa, Artificial Sequence
  source: /note="Description of Artificial Sequence: Synthetic peptide"
ATLQRSSLW

SEQ ID NO: 13537 - protein, 9 aa, Artificial Sequence
  source: /note="Description of Artificial Sequence: Synthetic peptide"
LQRSSLWCL

SEQ ID NO: 13538 - protein, 9 aa, Artificial Sequence
  source: /note="Description of Artificial Sequence: Synthetic peptide"
AESKIMFAT

SEQ ID NO: 13539 - protein, 9 aa, Artificial Sequence
  source: /note="Description of Artificial Sequence: Synthetic peptide"
ADAPAIQPV

SEQ ID NO: 13540 - protein, 9 aa, Artificial Sequence
  source: /note="Description of Artificial Sequence: Synthetic peptide"
APAIQPVLW

SEQ ID NO: 13541 - protein, 10 aa, Artificial Sequence
  source: /note="Description of Artificial Sequence: Synthetic peptide"
SMLTGPPARV

SEQ ID NO: 13542 - protein, 10 aa, Artificial Sequence
  source: /note="Description of Artificial Sequence: Synthetic peptide"
YMFLKAESKI

SEQ ID NO: 13543 - protein, 10 aa, Artificial Sequence
  source: /note="Description of Artificial Sequence: Synthetic peptide"
TLQRSSLWCL

SEQ ID NO: 13544 - protein, 10 aa, Artificial Sequence
  source: /note="Description of Artificial Sequence: Synthetic peptide"
HMSSLSHISA

SEQ ID NO: 13545 - protein, 10 aa, Artificial Sequence
  source: /note="Description of Artificial Sequence: Synthetic peptide"
CSMLTGPPAR

SEQ ID NO: 13546 - protein, 10 aa, Artificial Sequence
  source: /note="Description of Artificial Sequence: Synthetic peptide"
LHFCRSSIMK

SEQ ID NO: 13547 - protein, 10 aa, Artificial Sequence
  source: /note="Description of Artificial Sequence: Synthetic peptide"
FCRSSIMKPK

SEQ ID NO: 13548 - protein, 10 aa, Artificial Sequence
  source: /note="Description of Artificial Sequence: Synthetic peptide"
IMKPKRDGYM

SEQ ID NO: 13549 - protein, 10 aa, Artificial Sequence
  source: /note="Description of Artificial Sequence: Synthetic peptide"
GYMFLKAESK

SEQ ID NO: 13550 - protein, 10 aa, Artificial Sequence
  source: /note="Description of Artificial Sequence: Synthetic peptide"
SIMKPKRDGY

SEQ ID NO: 13551 - protein, 10 aa, Artificial Sequence
  source: /note="Description of Artificial Sequence: Synthetic peptide"
TTPPLQHGHR

SEQ ID NO: 13552 - protein, 10 aa, Artificial Sequence
  source: /note="Description of Artificial Sequence: Synthetic peptide"
AVPFDLHFCR

SEQ ID NO: 13553 - protein, 10 aa, Artificial Sequence
  source: /note="Description of Artificial Sequence: Synthetic peptide"
MSSLSHISAL

SEQ ID NO: 13554 - protein, 10 aa, Artificial Sequence
  source: /note="Description of Artificial Sequence: Synthetic peptide"
HADAPAIQPV

SEQ ID NO: 13555 - protein, 10 aa, Artificial Sequence
  source: /note="Description of Artificial Sequence: Synthetic peptide"
QPVLWTTPPL

SEQ ID NO: 13556 - protein, 10 aa, Artificial Sequence
  source: /note="Description of Artificial Sequence: Synthetic peptide"
KPKRDGYMFL

SEQ ID NO: 13557 - protein, 10 aa, Artificial Sequence
  source: /note="Description of Artificial Sequence: Synthetic peptide"
DLHFCRSSIM

SEQ ID NO: 13558 - protein, 10 aa, Artificial Sequence
  source: /note="Description of Artificial Sequence: Synthetic peptide"
MFATLQRSSL

SEQ ID NO: 13559 - protein, 10 aa, Artificial Sequence
  source: /note="Description of Artificial Sequence: Synthetic peptide"
FLKAESKIMF

SEQ ID NO: 13560 - protein, 10 aa, Artificial Sequence
  source: /note="Description of Artificial Sequence: Synthetic peptide"
LSHISALQPL

SEQ ID NO: 13561 - protein, 10 aa, Artificial Sequence
  source: /note="Description of Artificial Sequence: Synthetic peptide"
ADAPAIQPVL

SEQ ID NO: 13562 - protein, 10 aa, Artificial Sequence
  source: /note="Description of Artificial Sequence: Synthetic peptide"
HRHGLEPCSM

SEQ ID NO: 13563 - protein, 10 aa, Artificial Sequence
  source: /note="Description of Artificial Sequence: Synthetic peptide"
ARVPAVPFDL

SEQ ID NO: 13564 - protein, 10 aa, Artificial Sequence
  source: /note="Description of Artificial Sequence: Synthetic peptide"
VPAVPFDLHF

SEQ ID NO: 13565 - protein, 10 aa, Artificial Sequence
  source: /note="Description of Artificial Sequence: Synthetic peptide"
FDLHFCRSSI

SEQ ID NO: 13566 - protein, 10 aa, Artificial Sequence
  source: /note="Description of Artificial Sequence: Synthetic peptide"
MKPKRDGYMF

SEQ ID NO: 13567 - protein, 10 aa, Artificial Sequence
  source: /note="Description of Artificial Sequence: Synthetic peptide"
MFLKAESKIM

SEQ ID NO: 13568 - protein, 10 aa, Artificial Sequence
  source: /note="Description of Artificial Sequence: Synthetic peptide"
AESKIMFATL

SEQ ID NO: 13569 - protein, 10 aa, Artificial Sequence
  source: /note="Description of Artificial Sequence: Synthetic peptide"
IMFATLQRSS

SEQ ID NO: 13570 - protein, 10 aa, Artificial Sequence
  source: /note="Description of Artificial Sequence: Synthetic peptide"
FATLQRSSLW

SEQ ID NO: 13571 - protein, 10 aa, Artificial Sequence
  source: /note="Description of Artificial Sequence: Synthetic peptide"
LQRSSLWCLC

SEQ ID NO: 13572 - protein, 10 aa, Artificial Sequence
  source: /note="Description of Artificial Sequence: Synthetic peptide"
PPARVPAVPF

SEQ ID NO: 13573 - protein, 9 aa, Artificial Sequence
  source: /note="Description of Artificial Sequence: Synthetic peptide"
ALQPLQPHA

SEQ ID NO: 13574 - protein, 9 aa, Artificial Sequence
  source: /note="Description of Artificial Sequence: Synthetic peptide"
AIQPVLWTT

SEQ ID NO: 13575 - protein, 9 aa, Artificial Sequence
  source: /note="Description of Artificial Sequence: Synthetic peptide"
MLTGPPARV

SEQ ID NO: 13576 - protein, 9 aa, Artificial Sequence
  source: /note="Description of Artificial Sequence: Synthetic peptide"
FLKAESKIM

SEQ ID NO: 13577 - protein, 9 aa, Artificial Sequence
  source: /note="Description of Artificial Sequence: Synthetic peptide"
IMFATLQRS

SEQ ID NO: 13578 - protein, 9 aa, Artificial Sequence
  source: /note="Description of Artificial Sequence: Synthetic peptide"
YMFLKAESK

SEQ ID NO: 13579 - protein, 9 aa, Artificial Sequence
  source: /note="Description of Artificial Sequence: Synthetic peptide"
KIMFATLQR

SEQ ID NO: 13580 - protein, 9 aa, Artificial Sequence
  source: /note="Description of Artificial Sequence: Synthetic peptide"
SMLTGPPAR

SEQ ID NO: 13581 - protein, 9 aa, Artificial Sequence
  source: /note="Description of Artificial Sequence: Synthetic peptide"
HFCRSSIMK

SEQ ID NO: 13582 - protein, 9 aa, Artificial Sequence
  source: /note="Description of Artificial Sequence: Synthetic peptide"
MFLKAESKI

SEQ ID NO: 13583 - protein, 9 aa, Artificial Sequence
  source: /note="Description of Artificial Sequence: Synthetic peptide"
MSSLSHISA

SEQ ID NO: 13584 - protein, 9 aa, Artificial Sequence
  source: /note="Description of Artificial Sequence: Synthetic peptide"
SSLSHISAL

SEQ ID NO: 13585 - protein, 9 aa, Artificial Sequence
  source: /note="Description of Artificial Sequence: Synthetic peptide"
CSMLTGPPA

SEQ ID NO: 13586 - protein, 9 aa, Artificial Sequence
  source: /note="Description of Artificial Sequence: Synthetic peptide"
RSSIMKPKR

SEQ ID NO: 13587 - protein, 9 aa, Artificial Sequence
  source: /note="Description of Artificial Sequence: Synthetic peptide"
IMKPKRDGY

SEQ ID NO: 13588 - protein, 9 aa, Artificial Sequence
  source: /note="Description of Artificial Sequence: Synthetic peptide"
KAESKIMFA

SEQ ID NO: 13589 - protein, 9 aa, Artificial Sequence
  source: /note="Description of Artificial Sequence: Synthetic peptide"
VPFDLHFCR

SEQ ID NO: 13590 - protein, 9 aa, Artificial Sequence
  source: /note="Description of Artificial Sequence: Synthetic peptide"
GPPARVPAV

SEQ ID NO: 13591 - protein, 9 aa, Artificial Sequence
  source: /note="Description of Artificial Sequence: Synthetic peptide"
KPKRDGYMF

SEQ ID NO: 13592 - protein, 9 aa, Artificial Sequence
  source: /note="Description of Artificial Sequence: Synthetic peptide"
FATLQRSSL

SEQ ID NO: 13593 - protein, 9 aa, Artificial Sequence
  source: /note="Description of Artificial Sequence: Synthetic peptide"
DLHFCRSSI

SEQ ID NO: 13594 - protein, 9 aa, Artificial Sequence
  source: /note="Description of Artificial Sequence: Synthetic peptide"
LHFCRSSIM

SEQ ID NO: 13595 - protein, 9 aa, Artificial Sequence
  source: /note="Description of Artificial Sequence: Synthetic peptide"
ESKIMFATL

SEQ ID NO: 13596 - protein, 9 aa, Artificial Sequence
  source: /note="Description of Artificial Sequence: Synthetic peptide"
SHISALQPL

SEQ ID NO: 13597 - protein, 9 aa, Artificial Sequence
  source: /note="Description of Artificial Sequence: Synthetic peptide"
SALQPLQPH

SEQ ID NO: 13598 - protein, 9 aa, Artificial Sequence
  source: /note="Description of Artificial Sequence: Synthetic peptide"
LQPHADHAH

SEQ ID NO: 13599 - protein, 9 aa, Artificial Sequence
  source: /note="Description of Artificial Sequence: Synthetic peptide"
HAHADAPAI

SEQ ID NO: 13600 - protein, 9 aa, Artificial Sequence
  source: /note="Description of Artificial Sequence: Synthetic peptide"
LQHGHRHGL

SEQ ID NO: 13601 - protein, 9 aa, Artificial Sequence
  source: /note="Description of Artificial Sequence: Synthetic peptide"
RHGLEPCSM

SEQ ID NO: 13602 - protein, 9 aa, Artificial Sequence
  source: /note="Description of Artificial Sequence: Synthetic peptide"
PARVPAVPF

SEQ ID NO: 13603 - protein, 9 aa, Artificial Sequence
  source: /note="Description of Artificial Sequence: Synthetic peptide"
PAVPFDLHF

SEQ ID NO: 13604 - protein, 9 aa, Artificial Sequence
  source: /note="Description of Artificial Sequence: Synthetic peptide"
LKAESKIMF

SEQ ID NO: 13605 - protein, 9 aa, Artificial Sequence
  source: /note="Description of Artificial Sequence: Synthetic peptide"
ATLQRSSLW

SEQ ID NO: 13606 - protein, 9 aa, Artificial Sequence
  source: /note="Description of Artificial Sequence: Synthetic peptide"
LQRSSLWCL

SEQ ID NO: 13607 - protein, 9 aa, Artificial Sequence
  source: /note="Description of Artificial Sequence: Synthetic peptide"
AESKIMFAT

SEQ ID NO: 13608 - protein, 9 aa, Artificial Sequence
  source: /note="Description of Artificial Sequence: Synthetic peptide"
ADAPAIQPV

SEQ ID NO: 13609 - protein, 9 aa, Artificial Sequence
  source: /note="Description of Artificial Sequence: Synthetic peptide"
APAIQPVLW

SEQ ID NO: 13610 - protein, 10 aa, Artificial Sequence
  source: /note="Description of Artificial Sequence: Synthetic peptide"
SMLTGPPARV

SEQ ID NO: 13611 - protein, 10 aa, Artificial Sequence
  source: /note="Description of Artificial Sequence: Synthetic peptide"
YMFLKAESKI

SEQ ID NO: 13612 - protein, 10 aa, Artificial Sequence
  source: /note="Description of Artificial Sequence: Synthetic peptide"
TLQRSSLWCL

SEQ ID NO: 13613 - protein, 10 aa, Artificial Sequence
  source: /note="Description of Artificial Sequence: Synthetic peptide"
HMSSLSHISA

SEQ ID NO: 13614 - protein, 10 aa, Artificial Sequence
  source: /note="Description of Artificial Sequence: Synthetic peptide"
CSMLTGPPAR

SEQ ID NO: 13615 - protein, 10 aa, Artificial Sequence
  source: /note="Description of Artificial Sequence: Synthetic peptide"
LHFCRSSIMK

SEQ ID NO: 13616 - protein, 10 aa, Artificial Sequence
  source: /note="Description of Artificial Sequence: Synthetic peptide"
FCRSSIMKPK

SEQ ID NO: 13617 - protein, 10 aa, Artificial Sequence
  source: /note="Description of Artificial Sequence: Synthetic peptide"
IMKPKRDGYM

SEQ ID NO: 13618 - protein, 10 aa, Artificial Sequence
  source: /note="Description of Artificial Sequence: Synthetic peptide"
GYMFLKAESK

SEQ ID NO: 13619 - protein, 10 aa, Artificial Sequence
  source: /note="Description of Artificial Sequence: Synthetic peptide"
SIMKPKRDGY

SEQ ID NO: 13620 - protein, 10 aa, Artificial Sequence
  source: /note="Description of Artificial Sequence: Synthetic peptide"
TTPPLQHGHR

SEQ ID NO: 13621 - protein, 10 aa, Artificial Sequence
  source: /note="Description of Artificial Sequence: Synthetic peptide"
AVPFDLHFCR

SEQ ID NO: 13622 - protein, 10 aa, Artificial Sequence
  source: /note="Description of Artificial Sequence: Synthetic peptide"
MSSLSHISAL

SEQ ID NO: 13623 - protein, 10 aa, Artificial Sequence
  source: /note="Description of Artificial Sequence: Synthetic peptide"
HADAPAIQPV

SEQ ID NO: 13624 - protein, 10 aa, Artificial Sequence
  source: /note="Description of Artificial Sequence: Synthetic peptide"
QPVLWTTPPL

SEQ ID NO: 13625 - protein, 10 aa, Artificial Sequence
  source: /note="Description of Artificial Sequence: Synthetic peptide"
KPKRDGYMFL

SEQ ID NO: 13626 - protein, 10 aa, Artificial Sequence
  source: /note="Description of Artificial Sequence: Synthetic peptide"
DLHFCRSSIM

SEQ ID NO: 13627 - protein, 10 aa, Artificial Sequence
  source: /note="Description of Artificial Sequence: Synthetic peptide"
MFATLQRSSL

SEQ ID NO: 13628 - protein, 10 aa, Artificial Sequence
  source: /note="Description of Artificial Sequence: Synthetic peptide"
FLKAESKIMF

SEQ ID NO: 13629 - protein, 10 aa, Artificial Sequence
  source: /note="Description of Artificial Sequence: Synthetic peptide"
LSHISALQPL

SEQ ID NO: 13630 - protein, 10 aa, Artificial Sequence
  source: /note="Description of Artificial Sequence: Synthetic peptide"
ADAPAIQPVL

SEQ ID NO: 13631 - protein, 10 aa, Artificial Sequence
  source: /note="Description of Artificial Sequence: Synthetic peptide"
HRHGLEPCSM

SEQ ID NO: 13632 - protein, 10 aa, Artificial Sequence
  source: /note="Description of Artificial Sequence: Synthetic peptide"
ARVPAVPFDL

SEQ ID NO: 13633 - protein, 10 aa, Artificial Sequence
  source: /note="Description of Artificial Sequence: Synthetic peptide"
VPAVPFDLHF

SEQ ID NO: 13634 - protein, 10 aa, Artificial Sequence
  source: /note="Description of Artificial Sequence: Synthetic peptide"
FDLHFCRSSI

SEQ ID NO: 13635 - protein, 10 aa, Artificial Sequence
  source: /note="Description of Artificial Sequence: Synthetic peptide"
MKPKRDGYMF

SEQ ID NO: 13636 - protein, 10 aa, Artificial Sequence
  source: /note="Description of Artificial Sequence: Synthetic peptide"
MFLKAESKIM

SEQ ID NO: 13637 - protein, 10 aa, Artificial Sequence
  source: /note="Description of Artificial Sequence: Synthetic peptide"
AESKIMFATL

SEQ ID NO: 13638 - protein, 10 aa, Artificial Sequence
  source: /note="Description of Artificial Sequence: Synthetic peptide"
IMFATLQRSS

SEQ ID NO: 13639 - protein, 10 aa, Artificial Sequence
  source: /note="Description of Artificial Sequence: Synthetic peptide"
FATLQRSSLW

SEQ ID NO: 13640 - protein, 10 aa, Artificial Sequence
  source: /note="Description of Artificial Sequence: Synthetic peptide"
LQRSSLWCLC

SEQ ID NO: 13641 - protein, 10 aa, Artificial Sequence
  source: /note="Description of Artificial Sequence: Synthetic peptide"
PPARVPAVPF

SEQ ID NO: 13642 - protein, 9 aa, Artificial Sequence
  source: /note="Description of Artificial Sequence: Synthetic peptide"
MLTGPPARV

SEQ ID NO: 13643 - protein, 9 aa, Artificial Sequence
  source: /note="Description of Artificial Sequence: Synthetic peptide"
FLKAESKIM

SEQ ID NO: 13644 - protein, 9 aa, Artificial Sequence
  source: /note="Description of Artificial Sequence: Synthetic peptide"
IMFATLQRS

SEQ ID NO: 13645 - protein, 9 aa, Artificial Sequence
  source: /note="Description of Artificial Sequence: Synthetic peptide"
YMFLKAESK

SEQ ID NO: 13646 - protein, 9 aa, Artificial Sequence
  source: /note="Description of Artificial Sequence: Synthetic peptide"
KIMFATLQR

SEQ ID NO: 13647 - protein, 9 aa, Artificial Sequence
  source: /note="Description of Artificial Sequence: Synthetic peptide"
SMLTGPPAR

SEQ ID NO: 13648 - protein, 9 aa, Artificial Sequence
  source: /note="Description of Artificial Sequence: Synthetic peptide"
HFCRSSIMK

SEQ ID NO: 13649 - protein, 9 aa, Artificial Sequence
  source: /note="Description of Artificial Sequence: Synthetic peptide"
MFLKAESKI

SEQ ID NO: 13650 - protein, 9 aa, Artificial Sequence
  source: /note="Description of Artificial Sequence: Synthetic peptide"
LSFWTTPPL

SEQ ID NO: 13651 - protein, 9 aa, Artificial Sequence
  source: /note="Description of Artificial Sequence: Synthetic peptide"
CSMLTGPPA

SEQ ID NO: 13652 - protein, 9 aa, Artificial Sequence
  source: /note="Description of Artificial Sequence: Synthetic peptide"
RSSIMKPKR

SEQ ID NO: 13653 - protein, 9 aa, Artificial Sequence
  source: /note="Description of Artificial Sequence: Synthetic peptide"
IMKPKRDGY

SEQ ID NO: 13654 - protein, 9 aa, Artificial Sequence
  source: /note="Description of Artificial Sequence: Synthetic peptide"
KAESKIMFA

SEQ ID NO: 13655 - protein, 9 aa, Artificial Sequence
  source: /note="Description of Artificial Sequence: Synthetic peptide"
VPFDLHFCR

SEQ ID NO: 13656 - protein, 9 aa, Artificial Sequence
  source: /note="Description of Artificial Sequence: Synthetic peptide"
GPPARVPAV

SEQ ID NO: 13657 - protein, 9 aa, Artificial Sequence
  source: /note="Description of Artificial Sequence: Synthetic peptide"
KPKRDGYMF

SEQ ID NO: 13658 - protein, 9 aa, Artificial Sequence
  source: /note="Description of Artificial Sequence: Synthetic peptide"
FATLQRSSL

SEQ ID NO: 13659 - protein, 9 aa, Artificial Sequence
  source: /note="Description of Artificial Sequence: Synthetic peptide"
DLHFCRSSI

SEQ ID NO: 13660 - protein, 9 aa, Artificial Sequence
  source: /note="Description of Artificial Sequence: Synthetic peptide"
LHFCRSSIM

SEQ ID NO: 13661 - protein, 9 aa, Artificial Sequence
  source: /note="Description of Artificial Sequence: Synthetic peptide"
ESKIMFATL

SEQ ID NO: 13662 - protein, 9 aa, Artificial Sequence
  source: /note="Description of Artificial Sequence: Synthetic peptide"
LQHGHRHGL

SEQ ID NO: 13663 - protein, 9 aa, Artificial Sequence
  source: /note="Description of Artificial Sequence: Synthetic peptide"
RHGLEPCSM

SEQ ID NO: 13664 - protein, 9 aa, Artificial Sequence
  source: /note="Description of Artificial Sequence: Synthetic peptide"
PARVPAVPF

SEQ ID NO: 13665 - protein, 9 aa, Artificial Sequence
  source: /note="Description of Artificial Sequence: Synthetic peptide"
PAVPFDLHF

SEQ ID NO: 13666 - protein, 9 aa, Artificial Sequence
  source: /note="Description of Artificial Sequence: Synthetic peptide"
LKAESKIMF

SEQ ID NO: 13667 - protein, 9 aa, Artificial Sequence
  source: /note="Description of Artificial Sequence: Synthetic peptide"
ATLQRSSLW

SEQ ID NO: 13668 - protein, 9 aa, Artificial Sequence
  source: /note="Description of Artificial Sequence: Synthetic peptide"
LQRSSLWCL

SEQ ID NO: 13669 - protein, 9 aa, Artificial Sequence
  source: /note="Description of Artificial Sequence: Synthetic peptide"
AESKIMFAT

SEQ ID NO: 13670 - protein, 9 aa, Artificial Sequence
  source: /note="Description of Artificial Sequence: Synthetic peptide"
HPPSSLSFW

SEQ ID NO: 13671 - protein, 10 aa, Artificial Sequence
  source: /note="Description of Artificial Sequence: Synthetic peptide"
SLSFWTTPPL

SEQ ID NO: 13672 - protein, 10 aa, Artificial Sequence
  source: /note="Description of Artificial Sequence: Synthetic peptide"
SMLTGPPARV

SEQ ID NO: 13673 - protein, 10 aa, Artificial Sequence
  source: /note="Description of Artificial Sequence: Synthetic peptide"
YMFLKAESKI

SEQ ID NO: 13674 - protein, 10 aa, Artificial Sequence
  source: /note="Description of Artificial Sequence: Synthetic peptide"
TLQRSSLWCL

SEQ ID NO: 13675 - protein, 10 aa, Artificial Sequence
  source: /note="Description of Artificial Sequence: Synthetic peptide"
CSMLTGPPAR

SEQ ID NO: 13676 - protein, 10 aa, Artificial Sequence
  source: /note="Description of Artificial Sequence: Synthetic peptide"
MHPPSSLSFW

SEQ ID NO: 13677 - protein, 10 aa, Artificial Sequence
  source: /note="Description of Artificial Sequence: Synthetic peptide"
LHFCRSSIMK

SEQ ID NO: 13678 - protein, 10 aa, Artificial Sequence
  source: /note="Description of Artificial Sequence: Synthetic peptide"
FCRSSIMKPK

SEQ ID NO: 13679 - protein, 10 aa, Artificial Sequence
  source: /note="Description of Artificial Sequence: Synthetic peptide"
IMKPKRDGYM

SEQ ID NO: 13680 - protein, 10 aa, Artificial Sequence
  source: /note="Description of Artificial Sequence: Synthetic peptide"
GYMFLKAESK

SEQ ID NO: 13681 - protein, 10 aa, Artificial Sequence
  source: /note="Description of Artificial Sequence: Synthetic peptide"
SIMKPKRDGY

SEQ ID NO: 13682 - protein, 10 aa, Artificial Sequence
  source: /note="Description of Artificial Sequence: Synthetic peptide"
TTPPLQHGHR

SEQ ID NO: 13683 - protein, 10 aa, Artificial Sequence
  source: /note="Description of Artificial Sequence: Synthetic peptide"
AVPFDLHFCR

SEQ ID NO: 13684 - protein, 10 aa, Artificial Sequence
  source: /note="Description of Artificial Sequence: Synthetic peptide"
KPKRDGYMFL

SEQ ID NO: 13685 - protein, 10 aa, Artificial Sequence
  source: /note="Description of Artificial Sequence: Synthetic peptide"
DLHFCRSSIM

SEQ ID NO: 13686 - protein, 10 aa, Artificial Sequence
  source: /note="Description of Artificial Sequence: Synthetic peptide"
MFATLQRSSL

SEQ ID NO: 13687 - protein, 10 aa, Artificial Sequence
  source: /note="Description of Artificial Sequence: Synthetic peptide"
FLKAESKIMF

SEQ ID NO: 13688 - protein, 10 aa, Artificial Sequence
  source: /note="Description of Artificial Sequence: Synthetic peptide"
HRHGLEPCSM

SEQ ID NO: 13689 - protein, 10 aa, Artificial Sequence
  source: /note="Description of Artificial Sequence: Synthetic peptide"
ARVPAVPFDL

SEQ ID NO: 13690 - protein, 10 aa, Artificial Sequence
  source: /note="Description of Artificial Sequence: Synthetic peptide"
VPAVPFDLHF

SEQ ID NO: 13691 - protein, 10 aa, Artificial Sequence
  source: /note="Description of Artificial Sequence: Synthetic peptide"
FDLHFCRSSI

SEQ ID NO: 13692 - protein, 10 aa, Artificial Sequence
  source: /note="Description of Artificial Sequence: Synthetic peptide"
MKPKRDGYMF

SEQ ID NO: 13693 - protein, 10 aa, Artificial Sequence
  source: /note="Description of Artificial Sequence: Synthetic peptide"
MFLKAESKIM

SEQ ID NO: 13694 - protein, 10 aa, Artificial Sequence
  source: /note="Description of Artificial Sequence: Synthetic peptide"
AESKIMFATL

SEQ ID NO: 13695 - protein, 10 aa, Artificial Sequence
  source: /note="Description of Artificial Sequence: Synthetic peptide"
IMFATLQRSS

SEQ ID NO: 13696 - protein, 10 aa, Artificial Sequence
  source: /note="Description of Artificial Sequence: Synthetic peptide"
FATLQRSSLW

SEQ ID NO: 13697 - protein, 10 aa, Artificial Sequence
  source: /note="Description of Artificial Sequence: Synthetic peptide"
LQRSSLWCLC

SEQ ID NO: 13698 - protein, 10 aa, Artificial Sequence
  source: /note="Description of Artificial Sequence: Synthetic peptide"
PPARVPAVPF

SEQ ID NO: 13699 - protein, 9 aa, Artificial Sequence
  source: /note="Description of Artificial Sequence: Synthetic peptide"
MLTGPPARV

SEQ ID NO: 13700 - protein, 9 aa, Artificial Sequence
  source: /note="Description of Artificial Sequence: Synthetic peptide"
FLKAESKIM

SEQ ID NO: 13701 - protein, 9 aa, Artificial Sequence
  source: /note="Description of Artificial Sequence: Synthetic peptide"
IMFATLQRS

SEQ ID NO: 13702 - protein, 9 aa, Artificial Sequence
  source: /note="Description of Artificial Sequence: Synthetic peptide"
YMFLKAESK

SEQ ID NO: 13703 - protein, 9 aa, Artificial Sequence
  source: /note="Description of Artificial Sequence: Synthetic peptide"
KIMFATLQR

SEQ ID NO: 13704 - protein, 9 aa, Artificial Sequence
  source: /note="Description of Artificial Sequence: Synthetic peptide"
SMLTGPPAR

SEQ ID NO: 13705 - protein, 9 aa, Artificial Sequence
  source: /note="Description of Artificial Sequence: Synthetic peptide"
HFCRSSIMK

SEQ ID NO: 13706 - protein, 9 aa, Artificial Sequence
  source: /note="Description of Artificial Sequence: Synthetic peptide"
MFLKAESKI

SEQ ID NO: 13707 - protein, 9 aa, Artificial Sequence
  source: /note="Description of Artificial Sequence: Synthetic peptide"
CSMLTGPPA

SEQ ID NO: 13708 - protein, 9 aa, Artificial Sequence
  source: /note="Description of Artificial Sequence: Synthetic peptide"
RSSIMKPKR

SEQ ID NO: 13709 - protein, 9 aa, Artificial Sequence
  source: /note="Description of Artificial Sequence: Synthetic peptide"
IMKPKRDGY

SEQ ID NO: 13710 - protein, 9 aa, Artificial Sequence
  source: /note="Description of Artificial Sequence: Synthetic peptide"
KAESKIMFA

SEQ ID NO: 13711 - protein, 9 aa, Artificial Sequence
  source: /note="Description of Artificial Sequence: Synthetic peptide"
VPFDLHFCR

SEQ ID NO: 13712 - protein, 9 aa, Artificial Sequence
  source: /note="Description of Artificial Sequence: Synthetic peptide"
GPPARVPAV

SEQ ID NO: 13713 - protein, 9 aa, Artificial Sequence
  source: /note="Description of Artificial Sequence: Synthetic peptide"
KPKRDGYMF

SEQ ID NO: 13714 - protein, 9 aa, Artificial Sequence
  source: /note="Description of Artificial Sequence: Synthetic peptide"
FATLQRSSL

SEQ ID NO: 13715 - protein, 9 aa, Artificial Sequence
  source: /note="Description of Artificial Sequence: Synthetic peptide"
DLHFCRSSI

SEQ ID NO: 13716 - protein, 9 aa, Artificial Sequence
  source: /note="Description of Artificial Sequence: Synthetic peptide"
LHFCRSSIM

SEQ ID NO: 13717 - protein, 9 aa, Artificial Sequence
  source: /note="Description of Artificial Sequence: Synthetic peptide"
ESKIMFATL

SEQ ID NO: 13718 - protein, 9 aa, Artificial Sequence
  source: /note="Description of Artificial Sequence: Synthetic peptide"
LSFGPHPPL

SEQ ID NO: 13719 - protein, 9 aa, Artificial Sequence
  source: /note="Description of Artificial Sequence: Synthetic peptide"
LQHGHRHGL

SEQ ID NO: 13720 - protein, 9 aa, Artificial Sequence
  source: /note="Description of Artificial Sequence: Synthetic peptide"
RHGLEPCSM

SEQ ID NO: 13721 - protein, 9 aa, Artificial Sequence
  source: /note="Description of Artificial Sequence: Synthetic peptide"
PARVPAVPF

SEQ ID NO: 13722 - protein, 9 aa, Artificial Sequence
  source: /note="Description of Artificial Sequence: Synthetic peptide"
PAVPFDLHF

SEQ ID NO: 13723 - protein, 9 aa, Artificial Sequence
  source: /note="Description of Artificial Sequence: Synthetic peptide"
LKAESKIMF

SEQ ID NO: 13724 - protein, 9 aa, Artificial Sequence
  source: /note="Description of Artificial Sequence: Synthetic peptide"
ATLQRSSLW

SEQ ID NO: 13725 - protein, 9 aa, Artificial Sequence
  source: /note="Description of Artificial Sequence: Synthetic peptide"
LQRSSLWCL

SEQ ID NO: 13726 - protein, 9 aa, Artificial Sequence
  source: /note="Description of Artificial Sequence: Synthetic peptide"
AESKIMFAT

SEQ ID NO: 13727 - protein, 10 aa, Artificial Sequence
  source: /note="Description of Artificial Sequence: Synthetic peptide"
SLSFGPHPPL

SEQ ID NO: 13728 - protein, 10 aa, Artificial Sequence
  source: /note="Description of Artificial Sequence: Synthetic peptide"
SMLTGPPARV

SEQ ID NO: 13729 - protein, 10 aa, Artificial Sequence
  source: /note="Description of Artificial Sequence: Synthetic peptide"
YMFLKAESKI

SEQ ID NO: 13730 - protein, 10 aa, Artificial Sequence
  source: /note="Description of Artificial Sequence: Synthetic peptide"
TLQRSSLWCL

SEQ ID NO: 13731 - protein, 10 aa, Artificial Sequence
  source: /note="Description of Artificial Sequence: Synthetic peptide"
CSMLTGPPAR

SEQ ID NO: 13732 - protein, 10 aa, Artificial Sequence
  source: /note="Description of Artificial Sequence: Synthetic peptide"
LHFCRSSIMK

SEQ ID NO: 13733 - protein, 10 aa, Artificial Sequence
  source: /note="Description of Artificial Sequence: Synthetic peptide"
FCRSSIMKPK

SEQ ID NO: 13734 - protein, 10 aa, Artificial Sequence
  source: /note="Description of Artificial Sequence: Synthetic peptide"
IMKPKRDGYM

SEQ ID NO: 13735 - protein, 10 aa, Artificial Sequence
  source: /note="Description of Artificial Sequence: Synthetic peptide"
GYMFLKAESK

SEQ ID NO: 13736 - protein, 10 aa, Artificial Sequence
  source: /note="Description of Artificial Sequence: Synthetic peptide"
SIMKPKRDGY

SEQ ID NO: 13737 - protein, 10 aa, Artificial Sequence
  source: /note="Description of Artificial Sequence: Synthetic peptide"
AVPFDLHFCR

SEQ ID NO: 13738 - protein, 10 aa, Artificial Sequence
  source: /note="Description of Artificial Sequence: Synthetic peptide"
KPKRDGYMFL

SEQ ID NO: 13739 - protein, 10 aa, Artificial Sequence
  source: /note="Description of Artificial Sequence: Synthetic peptide"
DLHFCRSSIM

SEQ ID NO: 13740 - protein, 10 aa, Artificial Sequence
  source: /note="Description of Artificial Sequence: Synthetic peptide"
MFATLQRSSL

SEQ ID NO: 13741 - protein, 10 aa, Artificial Sequence
  source: /note="Description of Artificial Sequence: Synthetic peptide"
FLKAESKIMF

SEQ ID NO: 13742 - protein, 10 aa, Artificial Sequence
  source: /note="Description of Artificial Sequence: Synthetic peptide"
HRHGLEPCSM

SEQ ID NO: 13743 - protein, 10 aa, Artificial Sequence
  source: /note="Description of Artificial Sequence: Synthetic peptide"
ARVPAVPFDL

SEQ ID NO: 13744 - protein, 10 aa, Artificial Sequence
  source: /note="Description of Artificial Sequence: Synthetic peptide"
VPAVPFDLHF

SEQ ID NO: 13745 - protein, 10 aa, Artificial Sequence
  source: /note="Description of Artificial Sequence: Synthetic peptide"
FDLHFCRSSI

SEQ ID NO: 13746 - protein, 10 aa, Artificial Sequence
  source: /note="Description of Artificial Sequence: Synthetic peptide"
MKPKRDGYMF

SEQ ID NO: 13747 - protein, 10 aa, Artificial Sequence
  source: /note="Description of Artificial Sequence: Synthetic peptide"
MFLKAESKIM

SEQ ID NO: 13748 - protein, 10 aa, Artificial Sequence
  source: /note="Description of Artificial Sequence: Synthetic peptide"
AESKIMFATL

SEQ ID NO: 13749 - protein, 10 aa, Artificial Sequence
  source: /note="Description of Artificial Sequence: Synthetic peptide"
IMFATLQRSS

SEQ ID NO: 13750 - protein, 10 aa, Artificial Sequence
  source: /note="Description of Artificial Sequence: Synthetic peptide"
FATLQRSSLW

SEQ ID NO: 13751 - protein, 10 aa, Artificial Sequence
  source: /note="Description of Artificial Sequence: Synthetic peptide"
LQRSSLWCLC

SEQ ID NO: 13752 - protein, 10 aa, Artificial Sequence
  source: /note="Description of Artificial Sequence: Synthetic peptide"
PPARVPAVPF

SEQ ID NO: 13753 - protein, 9 aa, Artificial Sequence
  source: /note="Description of Artificial Sequence: Synthetic peptide"
MLTGPPARV

SEQ ID NO: 13754 - protein, 9 aa, Artificial Sequence
  source: /note="Description of Artificial Sequence: Synthetic peptide"
FLKAESKIM

SEQ ID NO: 13755 - protein, 9 aa, Artificial Sequence
  source: /note="Description of Artificial Sequence: Synthetic peptide"
IMFATLQRS

SEQ ID NO: 13756 - protein, 9 aa, Artificial Sequence
  source: /note="Description of Artificial Sequence: Synthetic peptide"
YMFLKAESK

SEQ ID NO: 13757 - protein, 9 aa, Artificial Sequence
  source: /note="Description of Artificial Sequence: Synthetic peptide"
KIMFATLQR

SEQ ID NO: 13758 - protein, 9 aa, Artificial Sequence
  source: /note="Description of Artificial Sequence: Synthetic peptide"
SMLTGPPAR

SEQ ID NO: 13759 - protein, 9 aa, Artificial Sequence
  source: /note="Description of Artificial Sequence: Synthetic peptide"
HFCRSSIMK

SEQ ID NO: 13760 - protein, 9 aa, Artificial Sequence
  source: /note="Description of Artificial Sequence: Synthetic peptide"
MFLKAESKI

SEQ ID NO: 13761 - protein, 9 aa, Artificial Sequence
  source: /note="Description of Artificial Sequence: Synthetic peptide"
CSMLTGPPA

SEQ ID NO: 13762 - protein, 9 aa, Artificial Sequence
  source: /note="Description of Artificial Sequence: Synthetic peptide"
RSSIMKPKR

SEQ ID NO: 13763 - protein, 9 aa, Artificial Sequence
  source: /note="Description of Artificial Sequence: Synthetic peptide"
IMKPKRDGY

SEQ ID NO: 13764 - protein, 9 aa, Artificial Sequence
  source: /note="Description of Artificial Sequence: Synthetic peptide"
KAESKIMFA

SEQ ID NO: 13765 - protein, 9 aa, Artificial Sequence
  source: /note="Description of Artificial Sequence: Synthetic peptide"
VPFDLHFCR

SEQ ID NO: 13766 - protein, 9 aa, Artificial Sequence
  source: /note="Description of Artificial Sequence: Synthetic peptide"
LSFGPHHPL

SEQ ID NO: 13767 - protein, 9 aa, Artificial Sequence
  source: /note="Description of Artificial Sequence: Synthetic peptide"
GPPARVPAV

SEQ ID NO: 13768 - protein, 9 aa, Artificial Sequence
  source: /note="Description of Artificial Sequence: Synthetic peptide"
KPKRDGYMF

SEQ ID NO: 13769 - protein, 9 aa, Artificial Sequence
  source: /note="Description of Artificial Sequence: Synthetic peptide"
FATLQRSSL

SEQ ID NO: 13770 - protein, 9 aa, Artificial Sequence
  source: /note="Description of Artificial Sequence: Synthetic peptide"
DLHFCRSSI

SEQ ID NO: 13771 - protein, 9 aa, Artificial Sequence
  source: /note="Description of Artificial Sequence: Synthetic peptide"
LHFCRSSIM

SEQ ID NO: 13772 - protein, 9 aa, Artificial Sequence
  source: /note="Description of Artificial Sequence: Synthetic peptide"
ESKIMFATL

SEQ ID NO: 13773 - protein, 9 aa, Artificial Sequence
  source: /note="Description of Artificial Sequence: Synthetic peptide"
LQHGHRHGL

SEQ ID NO: 13774 - protein, 9 aa, Artificial Sequence
  source: /note="Description of Artificial Sequence: Synthetic peptide"
RHGLEPCSM

SEQ ID NO: 13775 - protein, 9 aa, Artificial Sequence
  source: /note="Description of Artificial Sequence: Synthetic peptide"
PARVPAVPF

SEQ ID NO: 13776 - protein, 9 aa, Artificial Sequence
  source: /note="Description of Artificial Sequence: Synthetic peptide"
PAVPFDLHF

SEQ ID NO: 13777 - protein, 9 aa, Artificial Sequence
  source: /note="Description of Artificial Sequence: Synthetic peptide"
LKAESKIMF

SEQ ID NO: 13778 - protein, 9 aa, Artificial Sequence
  source: /note="Description of Artificial Sequence: Synthetic peptide"
ATLQRSSLW

SEQ ID NO: 13779 - protein, 9 aa, Artificial Sequence
  source: /note="Description of Artificial Sequence: Synthetic peptide"
LQRSSLWCL

SEQ ID NO: 13780 - protein, 9 aa, Artificial Sequence
  source: /note="Description of Artificial Sequence: Synthetic peptide"
HPLQHGHRH

SEQ ID NO: 13781 - protein, 9 aa, Artificial Sequence
  source: /note="Description of Artificial Sequence: Synthetic peptide"
AESKIMFAT

SEQ ID NO: 13782 - protein, 10 aa, Artificial Sequence
  source: /note="Description of Artificial Sequence: Synthetic peptide"
SLSFGPHHPL

SEQ ID NO: 13783 - protein, 10 aa, Artificial Sequence
  source: /note="Description of Artificial Sequence: Synthetic peptide"
SMLTGPPARV

SEQ ID NO: 13784 - protein, 10 aa, Artificial Sequence
  source: /note="Description of Artificial Sequence: Synthetic peptide"
YMFLKAESKI

SEQ ID NO: 13785 - protein, 10 aa, Artificial Sequence
  source: /note="Description of Artificial Sequence: Synthetic peptide"
TLQRSSLWCL

SEQ ID NO: 13786 - protein, 10 aa, Artificial Sequence
  source: /note="Description of Artificial Sequence: Synthetic peptide"
CSMLTGPPAR

SEQ ID NO: 13787 - protein, 10 aa, Artificial Sequence
  source: /note="Description of Artificial Sequence: Synthetic peptide"
LHFCRSSIMK

SEQ ID NO: 13788 - protein, 10 aa, Artificial Sequence
  source: /note="Description of Artificial Sequence: Synthetic peptide"
FCRSSIMKPK

SEQ ID NO: 13789 - protein, 10 aa, Artificial Sequence
  source: /note="Description of Artificial Sequence: Synthetic peptide"
IMKPKRDGYM

SEQ ID NO: 13790 - protein, 10 aa, Artificial Sequence
  source: /note="Description of Artificial Sequence: Synthetic peptide"
GYMFLKAESK

SEQ ID NO: 13791 - protein, 10 aa, Artificial Sequence
  source: /note="Description of Artificial Sequence: Synthetic peptide"
SIMKPKRDGY

SEQ ID NO: 13792 - protein, 10 aa, Artificial Sequence
  source: /note="Description of Artificial Sequence: Synthetic peptide"
AVPFDLHFCR

SEQ ID NO: 13793 - protein, 10 aa, Artificial Sequence
  source: /note="Description of Artificial Sequence: Synthetic peptide"
KPKRDGYMFL

SEQ ID NO: 13794 - protein, 10 aa, Artificial Sequence
  source: /note="Description of Artificial Sequence: Synthetic peptide"
DLHFCRSSIM

SEQ ID NO: 13795 - protein, 10 aa, Artificial Sequence
  source: /note="Description of Artificial Sequence: Synthetic peptide"
MFATLQRSSL

SEQ ID NO: 13796 - protein, 10 aa, Artificial Sequence
  source: /note="Description of Artificial Sequence: Synthetic peptide"
FLKAESKIMF

SEQ ID NO: 13797 - protein, 10 aa, Artificial Sequence
  source: /note="Description of Artificial Sequence: Synthetic peptide"
HRHGLEPCSM

SEQ ID NO: 13798 - protein, 10 aa, Artificial Sequence
  source: /note="Description of Artificial Sequence: Synthetic peptide"
ARVPAVPFDL

SEQ ID NO: 13799 - protein, 10 aa, Artificial Sequence
  source: /note="Description of Artificial Sequence: Synthetic peptide"
VPAVPFDLHF

SEQ ID NO: 13800 - protein, 10 aa, Artificial Sequence
  source: /note="Description of Artificial Sequence: Synthetic peptide"
FDLHFCRSSI

SEQ ID NO: 13801 - protein, 10 aa, Artificial Sequence
  source: /note="Description of Artificial Sequence: Synthetic peptide"
MKPKRDGYMF

SEQ ID NO: 13802 - protein, 10 aa, Artificial Sequence
  source: /note="Description of Artificial Sequence: Synthetic peptide"
MFLKAESKIM

SEQ ID NO: 13803 - protein, 10 aa, Artificial Sequence
  source: /note="Description of Artificial Sequence: Synthetic peptide"
AESKIMFATL

SEQ ID NO: 13804 - protein, 10 aa, Artificial Sequence
  source: /note="Description of Artificial Sequence: Synthetic peptide"
IMFATLQRSS

SEQ ID NO: 13805 - protein, 10 aa, Artificial Sequence
  source: /note="Description of Artificial Sequence: Synthetic peptide"
FATLQRSSLW

SEQ ID NO: 13806 - protein, 10 aa, Artificial Sequence
  source: /note="Description of Artificial Sequence: Synthetic peptide"
LQRSSLWCLC

SEQ ID NO: 13807 - protein, 10 aa, Artificial Sequence
  source: /note="Description of Artificial Sequence: Synthetic peptide"
PPARVPAVPF

SEQ ID NO: 13808 - protein, 9 aa, Artificial Sequence
  source: /note="Description of Artificial Sequence: Synthetic peptide"
HPSSMVTAI

SEQ ID NO: 13809 - protein, 9 aa, Artificial Sequence
  source: /note="Description of Artificial Sequence: Synthetic peptide"
CLQCLWALL

SEQ ID NO: 13810 - protein, 9 aa, Artificial Sequence
  source: /note="Description of Artificial Sequence: Synthetic peptide"
QWGPCLQCL

SEQ ID NO: 13811 - protein, 9 aa, Artificial Sequence
  source: /note="Description of Artificial Sequence: Synthetic peptide"
TTTTTLWRL

SEQ ID NO: 13812 - protein, 9 aa, Artificial Sequence
  source: /note="Description of Artificial Sequence: Synthetic peptide"
WALLQASQY

SEQ ID NO: 13813 - protein, 9 aa, Artificial Sequence
  source: /note="Description of Artificial Sequence: Synthetic peptide"
EECQWGPCL

SEQ ID NO: 13814 - protein, 10 aa, Artificial Sequence
  source: /note="Description of Artificial Sequence: Synthetic peptide"
QWGPCLQCLW

SEQ ID NO: 13815 - protein, 10 aa, Artificial Sequence
  source: /note="Description of Artificial Sequence: Synthetic peptide"
LWALLQASQY

SEQ ID NO: 13816 - protein, 10 aa, Artificial Sequence
  source: /note="Description of Artificial Sequence: Synthetic peptide"
QTTTTTLWRL

SEQ ID NO: 13817 - protein, 10 aa, Artificial Sequence
  source: /note="Description of Artificial Sequence: Synthetic peptide"
CQWGPCLQCL

SEQ ID NO: 13818 - protein, 10 aa, Artificial Sequence
  source: /note="Description of Artificial Sequence: Synthetic peptide"
LQCLWALLQA

SEQ ID NO: 13819 - protein, 9 aa, Artificial Sequence
  source: /note="Description of Artificial Sequence: Synthetic peptide"
FVPGGAQYL

SEQ ID NO: 13820 - protein, 9 aa, Artificial Sequence
  source: /note="Description of Artificial Sequence: Synthetic peptide"
AQYLLRSKK

SEQ ID NO: 13821 - protein, 9 aa, Artificial Sequence
  source: /note="Description of Artificial Sequence: Synthetic peptide"
GAQYLLRSK

SEQ ID NO: 13822 - protein, 9 aa, Artificial Sequence
  source: /note="Description of Artificial Sequence: Synthetic peptide"
FFVPGGAQY

SEQ ID NO: 13823 - protein, 9 aa, Artificial Sequence
  source: /note="Description of Artificial Sequence: Synthetic peptide"
VPGGAQYLL

SEQ ID NO: 13824 - protein, 10 aa, Artificial Sequence
  source: /note="Description of Artificial Sequence: Synthetic peptide"
FVPGGAQYLL

SEQ ID NO: 13825 - protein, 10 aa, Artificial Sequence
  source: /note="Description of Artificial Sequence: Synthetic peptide"
GAQYLLRSKK

SEQ ID NO: 13826 - protein, 10 aa, Artificial Sequence
  source: /note="Description of Artificial Sequence: Synthetic peptide"
FFVPGGAQYL

SEQ ID NO: 13827 - protein, 10 aa, Artificial Sequence
  source: /note="Description of Artificial Sequence: Synthetic peptide"
TFFVPGGAQY

SEQ ID NO: 13828 - protein, 9 aa, Artificial Sequence
  source: /note="Description of Artificial Sequence: Synthetic peptide"
MLGGMGFLT

SEQ ID NO: 13829 - protein, 9 aa, Artificial Sequence
  source: /note="Description of Artificial Sequence: Synthetic peptide"
RDMLGGMGF

SEQ ID NO: 13830 - protein, 9 aa, Artificial Sequence
  source: /note="Description of Artificial Sequence: Synthetic peptide"
GGMGFLTSI

SEQ ID NO: 13831 - protein, 10 aa, Artificial Sequence
  source: /note="Description of Artificial Sequence: Synthetic peptide"
RQARDMLGGM

SEQ ID NO: 13832 - protein, 10 aa, Artificial Sequence
  source: /note="Description of Artificial Sequence: Synthetic peptide"
RDMLGGMGFL

SEQ ID NO: 13833 - protein, 9 aa, Artificial Sequence
  source: /note="Description of Artificial Sequence: Synthetic peptide"
RLMPCILLA

SEQ ID NO: 13834 - protein, 9 aa, Artificial Sequence
  source: /note="Description of Artificial Sequence: Synthetic peptide"
MPCILLANR

SEQ ID NO: 13835 - protein, 9 aa, Artificial Sequence
  source: /note="Description of Artificial Sequence: Synthetic peptide"
QERLMPCIL

SEQ ID NO: 13836 - protein, 10 aa, Artificial Sequence
  source: /note="Description of Artificial Sequence: Synthetic peptide"
LMPCILLANR

SEQ ID NO: 13837 - protein, 10 aa, Artificial Sequence
  source: /note="Description of Artificial Sequence: Synthetic peptide"
CQERLMPCIL

SEQ ID NO: 13838 - protein, 10 aa, Artificial Sequence
  source: /note="Description of Artificial Sequence: Synthetic peptide"
QERLMPCILL

SEQ ID NO: 13839 - protein, 9 aa, Artificial Sequence
  source: /note="Description of Artificial Sequence: Synthetic peptide"
ILISAVLPA

SEQ ID NO: 13840 - protein, 9 aa, Artificial Sequence
  source: /note="Description of Artificial Sequence: Synthetic peptide"
LISAVLPAA

SEQ ID NO: 13841 - protein, 9 aa, Artificial Sequence
  source: /note="Description of Artificial Sequence: Synthetic peptide"
AVLPAAFRV

SEQ ID NO: 13842 - protein, 9 aa, Artificial Sequence
  source: /note="Description of Artificial Sequence: Synthetic peptide"
VLPAAFRVA

SEQ ID NO: 13843 - protein, 9 aa, Artificial Sequence
  source: /note="Description of Artificial Sequence: Synthetic peptide"
SAVLPAAFR

SEQ ID NO: 13844 - protein, 9 aa, Artificial Sequence
  source: /note="Description of Artificial Sequence: Synthetic peptide"
LPAAFRVAK

SEQ ID NO: 13845 - protein, 9 aa, Artificial Sequence
  source: /note="Description of Artificial Sequence: Synthetic peptide"
ISAVLPAAF

SEQ ID NO: 13846 - protein, 10 aa, Artificial Sequence
  source: /note="Description of Artificial Sequence: Synthetic peptide"
ILISAVLPAA

SEQ ID NO: 13847 - protein, 10 aa, Artificial Sequence
  source: /note="Description of Artificial Sequence: Synthetic peptide"
VLPAAFRVAK

SEQ ID NO: 13848 - protein, 10 aa, Artificial Sequence
  source: /note="Description of Artificial Sequence: Synthetic peptide"
ISAVLPAAFR

SEQ ID NO: 13849 - protein, 10 aa, Artificial Sequence
  source: /note="Description of Artificial Sequence: Synthetic peptide"
AVLPAAFRVA

SEQ ID NO: 13850 - protein, 10 aa, Artificial Sequence
  source: /note="Description of Artificial Sequence: Synthetic peptide"
SAVLPAAFRV

SEQ ID NO: 13851 - protein, 10 aa, Artificial Sequence
  source: /note="Description of Artificial Sequence: Synthetic peptide"
LISAVLPAAF

SEQ ID NO: 13852 - protein, 9 aa, Artificial Sequence
  source: /note="Description of Artificial Sequence: Synthetic peptide"
RICPQLLPA

SEQ ID NO: 13853 - protein, 9 aa, Artificial Sequence
  source: /note="Description of Artificial Sequence: Synthetic peptide"
ASRRQGTPK

SEQ ID NO: 13854 - protein, 9 aa, Artificial Sequence
  source: /note="Description of Artificial Sequence: Synthetic peptide"
QARTPSPNK

SEQ ID NO: 13855 - protein, 9 aa, Artificial Sequence
  source: /note="Description of Artificial Sequence: Synthetic peptide"
RTASRRQGT

SEQ ID NO: 13856 - protein, 9 aa, Artificial Sequence
  source: /note="Description of Artificial Sequence: Synthetic peptide"
KSRICPQLL

SEQ ID NO: 13857 - protein, 9 aa, Artificial Sequence
  source: /note="Description of Artificial Sequence: Synthetic peptide"
HTPRVHALA

SEQ ID NO: 13858 - protein, 9 aa, Artificial Sequence
  source: /note="Description of Artificial Sequence: Synthetic peptide"
SPTPHHTPR

SEQ ID NO: 13859 - protein, 9 aa, Artificial Sequence
  source: /note="Description of Artificial Sequence: Synthetic peptide"
HALAVQDAV

SEQ ID NO: 13860 - protein, 9 aa, Artificial Sequence
  source: /note="Description of Artificial Sequence: Synthetic peptide"
APTRAQGAV

SEQ ID NO: 13861 - protein, 9 aa, Artificial Sequence
  source: /note="Description of Artificial Sequence: Synthetic peptide"
TPRVHALAV

SEQ ID NO: 13862 - protein, 9 aa, Artificial Sequence
  source: /note="Description of Artificial Sequence: Synthetic peptide"
RQGTPKSRI

SEQ ID NO: 13863 - protein, 9 aa, Artificial Sequence
  source: /note="Description of Artificial Sequence: Synthetic peptide"
RAQGAVSPT

SEQ ID NO: 13864 - protein, 9 aa, Artificial Sequence
  source: /note="Description of Artificial Sequence: Synthetic peptide"
AQGAVSPTP

SEQ ID NO: 13865 - protein, 9 aa, Artificial Sequence
  source: /note="Description of Artificial Sequence: Synthetic peptide"
HHTPRVHAL

SEQ ID NO: 13866 - protein, 9 aa, Artificial Sequence
  source: /note="Description of Artificial Sequence: Synthetic peptide"
TPSPNKAGY

SEQ ID NO: 13867 - protein, 9 aa, Artificial Sequence
  source: /note="Description of Artificial Sequence: Synthetic peptide"
AEEGQGARA

SEQ ID NO: 13868 - protein, 10 aa, Artificial Sequence
  source: /note="Description of Artificial Sequence: Synthetic peptide"
LLPAEEGQGA

SEQ ID NO: 13869 - protein, 10 aa, Artificial Sequence
  source: /note="Description of Artificial Sequence: Synthetic peptide"
TQARTPSPNK

SEQ ID NO: 13870 - protein, 10 aa, Artificial Sequence
  source: /note="Description of Artificial Sequence: Synthetic peptide"
TASRRQGTPK

SEQ ID NO: 13871 - protein, 10 aa, Artificial Sequence
  source: /note="Description of Artificial Sequence: Synthetic peptide"
QARTPSPNKA

SEQ ID NO: 13872 - protein, 10 aa, Artificial Sequence
  source: /note="Description of Artificial Sequence: Synthetic peptide"
AGYSPDCDPK

SEQ ID NO: 13873 - protein, 10 aa, Artificial Sequence
  source: /note="Description of Artificial Sequence: Synthetic peptide"
ASRRQGTPKS

SEQ ID NO: 13874 - protein, 10 aa, Artificial Sequence
  source: /note="Description of Artificial Sequence: Synthetic peptide"
KSRICPQLLP

SEQ ID NO: 13875 - protein, 10 aa, Artificial Sequence
  source: /note="Description of Artificial Sequence: Synthetic peptide"
RVHALAVQDA

SEQ ID NO: 13876 - protein, 10 aa, Artificial Sequence
  source: /note="Description of Artificial Sequence: Synthetic peptide"
RTPSPNKAGY

SEQ ID NO: 13877 - protein, 10 aa, Artificial Sequence
  source: /note="Description of Artificial Sequence: Synthetic peptide"
HALAVQDAVR

SEQ ID NO: 13878 - protein, 10 aa, Artificial Sequence
  source: /note="Description of Artificial Sequence: Synthetic peptide"
HTPRVHALAV

SEQ ID NO: 13879 - protein, 10 aa, Artificial Sequence
  source: /note="Description of Artificial Sequence: Synthetic peptide"
TPKSRICPQL

SEQ ID NO: 13880 - protein, 10 aa, Artificial Sequence
  source: /note="Description of Artificial Sequence: Synthetic peptide"
SPTPHHTPRV

SEQ ID NO: 13881 - protein, 10 aa, Artificial Sequence
  source: /note="Description of Artificial Sequence: Synthetic peptide"
SRICPQLLPA

SEQ ID NO: 13882 - protein, 10 aa, Artificial Sequence
  source: /note="Description of Artificial Sequence: Synthetic peptide"
AQGAVSPTPH

SEQ ID NO: 13883 - protein, 9 aa, Artificial Sequence
  source: /note="Description of Artificial Sequence: Synthetic peptide"
GPRGGGQPH

SEQ ID NO: 13884 - protein, 9 aa, Artificial Sequence
  source: /note="Description of Artificial Sequence: Synthetic peptide"
EPRRAGGSV

SEQ ID NO: 13885 - protein, 9 aa, Artificial Sequence
  source: /note="Description of Artificial Sequence: Synthetic peptide"
QPPCGLQPL

SEQ ID NO: 13886 - protein, 9 aa, Artificial Sequence
  source: /note="Description of Artificial Sequence: Synthetic peptide"
HQDPHRAEW

SEQ ID NO: 13887 - protein, 9 aa, Artificial Sequence
  source: /note="Description of Artificial Sequence: Synthetic peptide"
AEWALAEDM

SEQ ID NO: 13888 - protein, 9 aa, Artificial Sequence
  source: /note="Description of Artificial Sequence: Synthetic peptide"
WALAEDMSV

SEQ ID NO: 13889 - protein, 9 aa, Artificial Sequence
  source: /note="Description of Artificial Sequence: Synthetic peptide"
AEDMSVPPV

SEQ ID NO: 13890 - protein, 9 aa, Artificial Sequence
  source: /note="Description of Artificial Sequence: Synthetic peptide"
RAGGSVSEL

SEQ ID NO: 13891 - protein, 9 aa, Artificial Sequence
  source: /note="Description of Artificial Sequence: Synthetic peptide"
WERAPQPPC

SEQ ID NO: 13892 - protein, 9 aa, Artificial Sequence
  source: /note="Description of Artificial Sequence: Synthetic peptide"
LQPLVSRSL

SEQ ID NO: 13893 - protein, 9 aa, Artificial Sequence
  source: /note="Description of Artificial Sequence: Synthetic peptide"
SELGVLWER

SEQ ID NO: 13894 - protein, 9 aa, Artificial Sequence
  source: /note="Description of Artificial Sequence: Synthetic peptide"
DPHRAEWAL

SEQ ID NO: 13895 - protein, 10 aa, Artificial Sequence
  source: /note="Description of Artificial Sequence: Synthetic peptide"
ALAEDMSVPP

SEQ ID NO: 13896 - protein, 10 aa, Artificial Sequence
  source: /note="Description of Artificial Sequence: Synthetic peptide"
GLQPLVSRSL

SEQ ID NO: 13897 - protein, 10 aa, Artificial Sequence
  source: /note="Description of Artificial Sequence: Synthetic peptide"
RAEWALAEDM

SEQ ID NO: 13898 - protein, 10 aa, Artificial Sequence
  source: /note="Description of Artificial Sequence: Synthetic peptide"
RRAGGSVSEL

SEQ ID NO: 13899 - protein, 10 aa, Artificial Sequence
  source: /note="Description of Artificial Sequence: Synthetic peptide"
AEWALAEDMS

SEQ ID NO: 13900 - protein, 10 aa, Artificial Sequence
  source: /note="Description of Artificial Sequence: Synthetic peptide"
SELGVLWERA

SEQ ID NO: 13901 - protein, 10 aa, Artificial Sequence
  source: /note="Description of Artificial Sequence: Synthetic peptide"
QPPCGLQPLV

SEQ ID NO: 13902 - protein, 9 aa, Artificial Sequence
  source: /note="Description of Artificial Sequence: Synthetic peptide"
RLFWGKIVA

SEQ ID NO: 13903 - protein, 9 aa, Artificial Sequence
  source: /note="Description of Artificial Sequence: Synthetic peptide"
SMPRKARLF

SEQ ID NO: 13904 - protein, 9 aa, Artificial Sequence
  source: /note="Description of Artificial Sequence: Synthetic peptide"
RKARLFWGK

SEQ ID NO: 13905 - protein, 9 aa, Artificial Sequence
  source: /note="Description of Artificial Sequence: Synthetic peptide"
KARLFWGKI

SEQ ID NO: 13906 - protein, 9 aa, Artificial Sequence
  source: /note="Description of Artificial Sequence: Synthetic peptide"
LFWGKIVAK

SEQ ID NO: 13907 - protein, 9 aa, Artificial Sequence
  source: /note="Description of Artificial Sequence: Synthetic peptide"
MPRKARLFW

SEQ ID NO: 13908 - protein, 9 aa, Artificial Sequence
  source: /note="Description of Artificial Sequence: Synthetic peptide"
ESMPRKARL

SEQ ID NO: 13909 - protein, 10 aa, Artificial Sequence
  source: /note="Description of Artificial Sequence: Synthetic peptide"
RLFWGKIVAK

SEQ ID NO: 13910 - protein, 10 aa, Artificial Sequence
  source: /note="Description of Artificial Sequence: Synthetic peptide"
SMPRKARLFW

SEQ ID NO: 13911 - protein, 10 aa, Artificial Sequence
  source: /note="Description of Artificial Sequence: Synthetic peptide"
KARLFWGKIV

SEQ ID NO: 13912 - protein, 10 aa, Artificial Sequence
  source: /note="Description of Artificial Sequence: Synthetic peptide"
MPRKARLFWG

SEQ ID NO: 13913 - protein, 10 aa, Artificial Sequence
  source: /note="Description of Artificial Sequence: Synthetic peptide"
KESMPRKARL

SEQ ID NO: 13914 - protein, 10 aa, Artificial Sequence
  source: /note="Description of Artificial Sequence: Synthetic peptide"
RKARLFWGKI

SEQ ID NO: 13915 - protein, 9 aa, Artificial Sequence
  source: /note="Description of Artificial Sequence: Synthetic peptide"
HKQNSKLNL

SEQ ID NO: 13916 - protein, 9 aa, Artificial Sequence
  source: /note="Description of Artificial Sequence: Synthetic peptide"
SKLNLGISP

SEQ ID NO: 13917 - protein, 9 aa, Artificial Sequence
  source: /note="Description of Artificial Sequence: Synthetic peptide"
LGISPDPTL

SEQ ID NO: 13918 - protein, 10 aa, Artificial Sequence
  source: /note="Description of Artificial Sequence: Synthetic peptide"
KQNSKLNLGI

SEQ ID NO: 13919 - protein, 10 aa, Artificial Sequence
  source: /note="Description of Artificial Sequence: Synthetic peptide"
FHKQNSKLNL

SEQ ID NO: 13920 - protein, 9 aa, Artificial Sequence
  source: /note="Description of Artificial Sequence: Synthetic peptide"
RLPRLAEEA

SEQ ID NO: 13921 - protein, 9 aa, Artificial Sequence
  source: /note="Description of Artificial Sequence: Synthetic peptide"
ALGRGRAPR

SEQ ID NO: 13922 - protein, 9 aa, Artificial Sequence
  source: /note="Description of Artificial Sequence: Synthetic peptide"
RGRAPRLPR

SEQ ID NO: 13923 - protein, 9 aa, Artificial Sequence
  source: /note="Description of Artificial Sequence: Synthetic peptide"
APRLPRLAE

SEQ ID NO: 13924 - protein, 10 aa, Artificial Sequence
  source: /note="Description of Artificial Sequence: Synthetic peptide"
AALGRGRAPR

SEQ ID NO: 13925 - protein, 10 aa, Artificial Sequence
  source: /note="Description of Artificial Sequence: Synthetic peptide"
RGRAPRLPRL

SEQ ID NO: 13926 - protein, 9 aa, Artificial Sequence
  source: /note="Description of Artificial Sequence: Synthetic peptide"
KIFKHMLHR

SEQ ID NO: 13927 - protein, 9 aa, Artificial Sequence
  source: /note="Description of Artificial Sequence: Synthetic peptide"
IFKHMLHRK

SEQ ID NO: 13928 - protein, 9 aa, Artificial Sequence
  source: /note="Description of Artificial Sequence: Synthetic peptide"
SLCKIFKHM

SEQ ID NO: 13929 - protein, 10 aa, Artificial Sequence
  source: /note="Description of Artificial Sequence: Synthetic peptide"
SLCKIFKHML

SEQ ID NO: 13930 - protein, 10 aa, Artificial Sequence
  source: /note="Description of Artificial Sequence: Synthetic peptide"
KIFKHMLHRK

SEQ ID NO: 13931 - protein, 10 aa, Artificial Sequence
  source: /note="Description of Artificial Sequence: Synthetic peptide"
KHMLHRKSCF

SEQ ID NO: 13932 - protein, 9 aa, Artificial Sequence
  source: /note="Description of Artificial Sequence: Synthetic peptide"
HVPWLLAHK

SEQ ID NO: 13933 - protein, 9 aa, Artificial Sequence
  source: /note="Description of Artificial Sequence: Synthetic peptide"
THVPWLLAH

SEQ ID NO: 13934 - protein, 9 aa, Artificial Sequence
  source: /note="Description of Artificial Sequence: Synthetic peptide"
VPWLLAHKI

SEQ ID NO: 13935 - protein, 9 aa, Artificial Sequence
  source: /note="Description of Artificial Sequence: Synthetic peptide"
GPTHVPWLL

SEQ ID NO: 13936 - protein, 10 aa, Artificial Sequence
  source: /note="Description of Artificial Sequence: Synthetic peptide"
NTDPNGPTHV

SEQ ID NO: 13937 - protein, 10 aa, Artificial Sequence
  source: /note="Description of Artificial Sequence: Synthetic peptide"
HVPWLLAHKI

SEQ ID NO: 13938 - protein, 10 aa, Artificial Sequence
  source: /note="Description of Artificial Sequence: Synthetic peptide"
DPNGPTHVPW

SEQ ID NO: 13939 - protein, 9 aa, Artificial Sequence
  source: /note="Description of Artificial Sequence: Synthetic peptide"
ESENWHIFR

SEQ ID NO: 13940 - protein, 9 aa, Artificial Sequence
  source: /note="Description of Artificial Sequence: Synthetic peptide"
SESENWHIF

SEQ ID NO: 13941 - protein, 10 aa, Artificial Sequence
  source: /note="Description of Artificial Sequence: Synthetic peptide"
RSESENWHIF

SEQ ID NO: 13942 - protein, 9 aa, Artificial Sequence
  source: /note="Description of Artificial Sequence: Synthetic peptide"
NVSFILPNL

SEQ ID NO: 13943 - protein, 9 aa, Artificial Sequence
  source: /note="Description of Artificial Sequence: Synthetic peptide"
IGFGRCFQK

SEQ ID NO: 13944 - protein, 9 aa, Artificial Sequence
  source: /note="Description of Artificial Sequence: Synthetic peptide"
IFKDVLIGF

SEQ ID NO: 13945 - protein, 9 aa, Artificial Sequence
  source: /note="Description of Artificial Sequence: Synthetic peptide"
CFQKYGIGF

SEQ ID NO: 13946 - protein, 9 aa, Artificial Sequence
  source: /note="Description of Artificial Sequence: Synthetic peptide"
IGFCRNVSF

SEQ ID NO: 13947 - protein, 9 aa, Artificial Sequence
  source: /note="Description of Artificial Sequence: Synthetic peptide"
GFGRCFQKY

SEQ ID NO: 13948 - protein, 9 aa, Artificial Sequence
  source: /note="Description of Artificial Sequence: Synthetic peptide"
VLIGFGRCF

SEQ ID NO: 13949 - protein, 9 aa, Artificial Sequence
  source: /note="Description of Artificial Sequence: Synthetic peptide"
VSFILPNLL

SEQ ID NO: 13950 - protein, 10 aa, Artificial Sequence
  source: /note="Description of Artificial Sequence: Synthetic peptide"
LIGFGRCFQK

SEQ ID NO: 13951 - protein, 10 aa, Artificial Sequence
  source: /note="Description of Artificial Sequence: Synthetic peptide"
KYGIGFCRNV

SEQ ID NO: 13952 - protein, 10 aa, Artificial Sequence
  source: /note="Description of Artificial Sequence: Synthetic peptide"
IGFGRCFQKY

SEQ ID NO: 13953 - protein, 10 aa, Artificial Sequence
  source: /note="Description of Artificial Sequence: Synthetic peptide"
FQKYGIGFCR

SEQ ID NO: 13954 - protein, 10 aa, Artificial Sequence
  source: /note="Description of Artificial Sequence: Synthetic peptide"
NVSFILPNLL

SEQ ID NO: 13955 - protein, 10 aa, Artificial Sequence
  source: /note="Description of Artificial Sequence: Synthetic peptide"
NIFKDVLIGF

SEQ ID NO: 13956 - protein, 10 aa, Artificial Sequence
  source: /note="Description of Artificial Sequence: Synthetic peptide"
AERNIFKDVL

SEQ ID NO: 13957 - protein, 10 aa, Artificial Sequence
  source: /note="Description of Artificial Sequence: Synthetic peptide"
RCFQKYGIGF

SEQ ID NO: 13958 - protein, 10 aa, Artificial Sequence
  source: /note="Description of Artificial Sequence: Synthetic peptide"
GIGFCRNVSF

SEQ ID NO: 13959 - protein, 10 aa, Artificial Sequence
  source: /note="Description of Artificial Sequence: Synthetic peptide"
IGFCRNVSFI

SEQ ID NO: 13960 - protein, 10 aa, Artificial Sequence
  source: /note="Description of Artificial Sequence: Synthetic peptide"
RNVSFILPNL

SEQ ID NO: 13961 - protein, 9 aa, Artificial Sequence
  source: /note="Description of Artificial Sequence: Synthetic peptide"
KTSVAKLEA

SEQ ID NO: 13962 - protein, 9 aa, Artificial Sequence
  source: /note="Description of Artificial Sequence: Synthetic peptide"
FTEEDKTSV

SEQ ID NO: 13963 - protein, 9 aa, Artificial Sequence
  source: /note="Description of Artificial Sequence: Synthetic peptide"
SVAKLEAIF

SEQ ID NO: 13964 - protein, 10 aa, Artificial Sequence
  source: /note="Description of Artificial Sequence: Synthetic peptide"
KTSVAKLEAI

SEQ ID NO: 13965 - protein, 10 aa, Artificial Sequence
  source: /note="Description of Artificial Sequence: Synthetic peptide"
TSVAKLEAIF

SEQ ID NO: 13966 - protein, 10 aa, Artificial Sequence
  source: /note="Description of Artificial Sequence: Synthetic peptide"
EEDKTSVAKL

SEQ ID NO: 13967 - protein, 9 aa, Artificial Sequence
  source: /note="Description of Artificial Sequence: Synthetic peptide"
RLMTCWKAT

SEQ ID NO: 13968 - protein, 9 aa, Artificial Sequence
  source: /note="Description of Artificial Sequence: Synthetic peptide"
RAPRSLHAV

SEQ ID NO: 13969 - protein, 9 aa, Artificial Sequence
  source: /note="Description of Artificial Sequence: Synthetic peptide"
SLRRRHLGR

SEQ ID NO: 13970 - protein, 9 aa, Artificial Sequence
  source: /note="Description of Artificial Sequence: Synthetic peptide"
TCWKATWAF

SEQ ID NO: 13971 - protein, 9 aa, Artificial Sequence
  source: /note="Description of Artificial Sequence: Synthetic peptide"
TWAFGTPSW

SEQ ID NO: 13972 - protein, 9 aa, Artificial Sequence
  source: /note="Description of Artificial Sequence: Synthetic peptide"
RLRSGGLPQ

SEQ ID NO: 13973 - protein, 9 aa, Artificial Sequence
  source: /note="Description of Artificial Sequence: Synthetic peptide"
QWRKRPVSL

SEQ ID NO: 13974 - protein, 9 aa, Artificial Sequence
  source: /note="Description of Artificial Sequence: Synthetic peptide"
RKRPVSLRR

SEQ ID NO: 13975 - protein, 9 aa, Artificial Sequence
  source: /note="Description of Artificial Sequence: Synthetic peptide"
RRRHLGRLM

SEQ ID NO: 13976 - protein, 9 aa, Artificial Sequence
  source: /note="Description of Artificial Sequence: Synthetic peptide"
LGRLMTCWK

SEQ ID NO: 13977 - protein, 9 aa, Artificial Sequence
  source: /note="Description of Artificial Sequence: Synthetic peptide"
CWKATWAFG

SEQ ID NO: 13978 - protein, 9 aa, Artificial Sequence
  source: /note="Description of Artificial Sequence: Synthetic peptide"
SWRPPWWRR

SEQ ID NO: 13979 - protein, 9 aa, Artificial Sequence
  source: /note="Description of Artificial Sequence: Synthetic peptide"
RPRRQRAPR

SEQ ID NO: 13980 - protein, 9 aa, Artificial Sequence
  source: /note="Description of Artificial Sequence: Synthetic peptide"
RQRAPRSLH

SEQ ID NO: 13981 - protein, 9 aa, Artificial Sequence
  source: /note="Description of Artificial Sequence: Synthetic peptide"
WAFGTPSWR

SEQ ID NO: 13982 - protein, 9 aa, Artificial Sequence
  source: /note="Description of Artificial Sequence: Synthetic peptide"
RPPWWRRPR

SEQ ID NO: 13983 - protein, 9 aa, Artificial Sequence
  source: /note="Description of Artificial Sequence: Synthetic peptide"
MTCWKATWA

SEQ ID NO: 13984 - protein, 9 aa, Artificial Sequence
  source: /note="Description of Artificial Sequence: Synthetic peptide"
LPQWRKRPV

SEQ ID NO: 13985 - protein, 9 aa, Artificial Sequence
  source: /note="Description of Artificial Sequence: Synthetic peptide"
TLRLRSGGL

SEQ ID NO: 13986 - protein, 9 aa, Artificial Sequence
  source: /note="Description of Artificial Sequence: Synthetic peptide"
LRSGGLPQW

SEQ ID NO: 13987 - protein, 9 aa, Artificial Sequence
  source: /note="Description of Artificial Sequence: Synthetic peptide"
LMTCWKATW

SEQ ID NO: 13988 - protein, 9 aa, Artificial Sequence
  source: /note="Description of Artificial Sequence: Synthetic peptide"
RRQRAPRSL

SEQ ID NO: 13989 - protein, 9 aa, Artificial Sequence
  source: /note="Description of Artificial Sequence: Synthetic peptide"
TPSWRPPWW

SEQ ID NO: 13990 - protein, 10 aa, Artificial Sequence
  source: /note="Description of Artificial Sequence: Synthetic peptide"
LMTCWKATWA

SEQ ID NO: 13991 - protein, 10 aa, Artificial Sequence
  source: /note="Description of Artificial Sequence: Synthetic peptide"
GLPQWRKRPV

SEQ ID NO: 13992 - protein, 10 aa, Artificial Sequence
  source: /note="Description of Artificial Sequence: Synthetic peptide"
SLRRRHLGRL

SEQ ID NO: 13993 - protein, 10 aa, Artificial Sequence
  source: /note="Description of Artificial Sequence: Synthetic peptide"
HLGRLMTCWK

SEQ ID NO: 13994 - protein, 10 aa, Artificial Sequence
  source: /note="Description of Artificial Sequence: Synthetic peptide"
RSGGLPQWRK

SEQ ID NO: 13995 - protein, 10 aa, Artificial Sequence
  source: /note="Description of Artificial Sequence: Synthetic peptide"
VSLRRRHLGR

SEQ ID NO: 13996 - protein, 10 aa, Artificial Sequence
  source: /note="Description of Artificial Sequence: Synthetic peptide"
RLMTCWKATW

SEQ ID NO: 13997 - protein, 10 aa, Artificial Sequence
  source: /note="Description of Artificial Sequence: Synthetic peptide"
MTCWKATWAF

SEQ ID NO: 13998 - protein, 10 aa, Artificial Sequence
  source: /note="Description of Artificial Sequence: Synthetic peptide"
RLRSGGLPQW

SEQ ID NO: 13999 - protein, 10 aa, Artificial Sequence
  source: /note="Description of Artificial Sequence: Synthetic peptide"
QWRKRPVSLR

SEQ ID NO: 14000 - protein, 10 aa, Artificial Sequence
  source: /note="Description of Artificial Sequence: Synthetic peptide"
RKRPVSLRRR

SEQ ID NO: 14001 - protein, 10 aa, Artificial Sequence
  source: /note="Description of Artificial Sequence: Synthetic peptide"
SWRPPWWRRP

SEQ ID NO: 14002 - protein, 10 aa, Artificial Sequence
  source: /note="Description of Artificial Sequence: Synthetic peptide"
WWRRPRRQRA

SEQ ID NO: 14003 - protein, 10 aa, Artificial Sequence
  source: /note="Description of Artificial Sequence: Synthetic peptide"
RQRAPRSLHA

SEQ ID NO: 14004 - protein, 10 aa, Artificial Sequence
  source: /note="Description of Artificial Sequence: Synthetic peptide"
TWAFGTPSWR

SEQ ID NO: 14005 - protein, 10 aa, Artificial Sequence
  source: /note="Description of Artificial Sequence: Synthetic peptide"
TPSWRPPWWR

SEQ ID NO: 14006 - protein, 10 aa, Artificial Sequence
  source: /note="Description of Artificial Sequence: Synthetic peptide"
RPPWWRRPRR

SEQ ID NO: 14007 - protein, 10 aa, Artificial Sequence
  source: /note="Description of Artificial Sequence: Synthetic peptide"
ETLRLRSGGL

SEQ ID NO: 14008 - protein, 10 aa, Artificial Sequence
  source: /note="Description of Artificial Sequence: Synthetic peptide"
LPQWRKRPVS

SEQ ID NO: 14009 - protein, 10 aa, Artificial Sequence
  source: /note="Description of Artificial Sequence: Synthetic peptide"
RPVSLRRRHL

SEQ ID NO: 14010 - protein, 10 aa, Artificial Sequence
  source: /note="Description of Artificial Sequence: Synthetic peptide"
RPRRQRAPRS

SEQ ID NO: 14011 - protein, 10 aa, Artificial Sequence
  source: /note="Description of Artificial Sequence: Synthetic peptide"
PQWRKRPVSL

SEQ ID NO: 14012 - protein, 10 aa, Artificial Sequence
  source: /note="Description of Artificial Sequence: Synthetic peptide"
LRRRHLGRLM

SEQ ID NO: 14013 - protein, 10 aa, Artificial Sequence
  source: /note="Description of Artificial Sequence: Synthetic peptide"
RHLGRLMTCW

SEQ ID NO: 14014 - protein, 10 aa, Artificial Sequence
  source: /note="Description of Artificial Sequence: Synthetic peptide"
ATWAFGTPSW

SEQ ID NO: 14015 - protein, 10 aa, Artificial Sequence
  source: /note="Description of Artificial Sequence: Synthetic peptide"
FGTPSWRPPW

SEQ ID NO: 14016 - protein, 9 aa, Artificial Sequence
  source: /note="Description of Artificial Sequence: Synthetic peptide"
CLDDDSVTA

SEQ ID NO: 14017 - protein, 9 aa, Artificial Sequence
  source: /note="Description of Artificial Sequence: Synthetic peptide"
LPCLDDDSV

SEQ ID NO: 14018 - protein, 10 aa, Artificial Sequence
  source: /note="Description of Artificial Sequence: Synthetic peptide"
RLPCLDDDSV

SEQ ID NO: 14019 - protein, 10 aa, Artificial Sequence
  source: /note="Description of Artificial Sequence: Synthetic peptide"
LAFVHRLPCL

SEQ ID NO: 14020 - protein, 9 aa, Artificial Sequence
  source: /note="Description of Artificial Sequence: Synthetic peptide"
SLTPMHSLL

SEQ ID NO: 14021 - protein, 9 aa, Artificial Sequence
  source: /note="Description of Artificial Sequence: Synthetic peptide"
LISPMITRI

SEQ ID NO: 14022 - protein, 9 aa, Artificial Sequence
  source: /note="Description of Artificial Sequence: Synthetic peptide"
KQASEQNWV

SEQ ID NO: 14023 - protein, 9 aa, Artificial Sequence
  source: /note="Description of Artificial Sequence: Synthetic peptide"
LLISPMITR

SEQ ID NO: 14024 - protein, 9 aa, Artificial Sequence
  source: /note="Description of Artificial Sequence: Synthetic peptide"
SPMITRILK

SEQ ID NO: 14025 - protein, 9 aa, Artificial Sequence
  source: /note="Description of Artificial Sequence: Synthetic peptide"
QASEQNWVI

SEQ ID NO: 14026 - protein, 9 aa, Artificial Sequence
  source: /note="Description of Artificial Sequence: Synthetic peptide"
WVITVQNKI

SEQ ID NO: 14027 - protein, 9 aa, Artificial Sequence
  source: /note="Description of Artificial Sequence: Synthetic peptide"
REAPSLTPM

SEQ ID NO: 14028 - protein, 9 aa, Artificial Sequence
  source: /note="Description of Artificial Sequence: Synthetic peptide"
SEQNWVITV

SEQ ID NO: 14029 - protein, 9 aa, Artificial Sequence
  source: /note="Description of Artificial Sequence: Synthetic peptide"
WGRREAPSL

SEQ ID NO: 14030 - protein, 9 aa, Artificial Sequence
  source: /note="Description of Artificial Sequence: Synthetic peptide"
MHSLLISPM

SEQ ID NO: 14031 - protein, 9 aa, Artificial Sequence
  source: /note="Description of Artificial Sequence: Synthetic peptide"
IEWGRREAP

SEQ ID NO: 14032 - protein, 10 aa, Artificial Sequence
  source: /note="Description of Artificial Sequence: Synthetic peptide"
KQASEQNWVI

SEQ ID NO: 14033 - protein, 10 aa, Artificial Sequence
  source: /note="Description of Artificial Sequence: Synthetic peptide"
SLTPMHSLLI

SEQ ID NO: 14034 - protein, 10 aa, Artificial Sequence
  source: /note="Description of Artificial Sequence: Synthetic peptide"
LLISPMITRI

SEQ ID NO: 14035 - protein, 10 aa, Artificial Sequence
  source: /note="Description of Artificial Sequence: Synthetic peptide"
LISPMITRIL

SEQ ID NO: 14036 - protein, 10 aa, Artificial Sequence
  source: /note="Description of Artificial Sequence: Synthetic peptide"
SLLISPMITR

SEQ ID NO: 14037 - protein, 10 aa, Artificial Sequence
  source: /note="Description of Artificial Sequence: Synthetic peptide"
ISPMITRILK

SEQ ID NO: 14038 - protein, 10 aa, Artificial Sequence
  source: /note="Description of Artificial Sequence: Synthetic peptide"
NWVITVQNKI

SEQ ID NO: 14039 - protein, 10 aa, Artificial Sequence
  source: /note="Description of Artificial Sequence: Synthetic peptide"
TVQNKIEWGR

SEQ ID NO: 14040 - protein, 10 aa, Artificial Sequence
  source: /note="Description of Artificial Sequence: Synthetic peptide"
APSLTPMHSL

SEQ ID NO: 14041 - protein, 10 aa, Artificial Sequence
  source: /note="Description of Artificial Sequence: Synthetic peptide"
RREAPSLTPM

SEQ ID NO: 14042 - protein, 10 aa, Artificial Sequence
  source: /note="Description of Artificial Sequence: Synthetic peptide"
REAPSLTPMH

SEQ ID NO: 14043 - protein, 10 aa, Artificial Sequence
  source: /note="Description of Artificial Sequence: Synthetic peptide"
PMHSLLISPM

SEQ ID NO: 14044 - protein, 10 aa, Artificial Sequence
  source: /note="Description of Artificial Sequence: Synthetic peptide"
MHSLLISPMI

SEQ ID NO: 14045 - protein, 10 aa, Artificial Sequence
  source: /note="Description of Artificial Sequence: Synthetic peptide"
IEWGRREAPS

SEQ ID NO: 14046 - protein, 9 aa, Artificial Sequence
  source: /note="Description of Artificial Sequence: Synthetic peptide"
NMPHLVQCA

SEQ ID NO: 14047 - protein, 9 aa, Artificial Sequence
  source: /note="Description of Artificial Sequence: Synthetic peptide"
HLVQCANVA

SEQ ID NO: 14048 - protein, 9 aa, Artificial Sequence
  source: /note="Description of Artificial Sequence: Synthetic peptide"
MPHLVQCAN

SEQ ID NO: 14049 - protein, 10 aa, Artificial Sequence
  source: /note="Description of Artificial Sequence: Synthetic peptide"
LWHGFNMPHL

SEQ ID NO: 14050 - protein, 10 aa, Artificial Sequence
  source: /note="Description of Artificial Sequence: Synthetic peptide"
MPHLVQCANV

SEQ ID NO: 14051 - protein, 9 aa, Artificial Sequence
  source: /note="Description of Artificial Sequence: Synthetic peptide"
VLSSIWLSV

SEQ ID NO: 14052 - protein, 9 aa, Artificial Sequence
  source: /note="Description of Artificial Sequence: Synthetic peptide"
SIWLSVVFI

SEQ ID NO: 14053 - protein, 9 aa, Artificial Sequence
  source: /note="Description of Artificial Sequence: Synthetic peptide"
LSSIWLSVV

SEQ ID NO: 14054 - protein, 9 aa, Artificial Sequence
  source: /note="Description of Artificial Sequence: Synthetic peptide"
KYSTVLSSI

SEQ ID NO: 14055 - protein, 9 aa, Artificial Sequence
  source: /note="Description of Artificial Sequence: Synthetic peptide"
SSIWLSVVF

SEQ ID NO: 14056 - protein, 9 aa, Artificial Sequence
  source: /note="Description of Artificial Sequence: Synthetic peptide"
STVLSSIWL

SEQ ID NO: 14057 - protein, 9 aa, Artificial Sequence
  source: /note="Description of Artificial Sequence: Synthetic peptide"
NKYSTVLSS

SEQ ID NO: 14058 - protein, 9 aa, Artificial Sequence
  source: /note="Description of Artificial Sequence: Synthetic peptide"
YSTVLSSIW

SEQ ID NO: 14059 - protein, 10 aa, Artificial Sequence
  source: /note="Description of Artificial Sequence: Synthetic peptide"
TVLSSIWLSV

SEQ ID NO: 14060 - protein, 10 aa, Artificial Sequence
  source: /note="Description of Artificial Sequence: Synthetic peptide"
VLSSIWLSVV

SEQ ID NO: 14061 - protein, 10 aa, Artificial Sequence
  source: /note="Description of Artificial Sequence: Synthetic peptide"
KYSTVLSSIW

SEQ ID NO: 14062 - protein, 10 aa, Artificial Sequence
  source: /note="Description of Artificial Sequence: Synthetic peptide"
SIWLSVVFIF

SEQ ID NO: 14063 - protein, 10 aa, Artificial Sequence
  source: /note="Description of Artificial Sequence: Synthetic peptide"
SSIWLSVVFI

SEQ ID NO: 14064 - protein, 10 aa, Artificial Sequence
  source: /note="Description of Artificial Sequence: Synthetic peptide"
LSSIWLSVVF

SEQ ID NO: 14065 - protein, 10 aa, Artificial Sequence
  source: /note="Description of Artificial Sequence: Synthetic peptide"
NKYSTVLSSI

SEQ ID NO: 14066 - protein, 10 aa, Artificial Sequence
  source: /note="Description of Artificial Sequence: Synthetic peptide"
YSTVLSSIWL

SEQ ID NO: 14067 - protein, 9 aa, Artificial Sequence
  source: /note="Description of Artificial Sequence: Synthetic peptide"
ALKYLGEPM

SEQ ID NO: 14068 - protein, 9 aa, Artificial Sequence
  source: /note="Description of Artificial Sequence: Synthetic peptide"
EPMKSEKPI

SEQ ID NO: 14069 - protein, 9 aa, Artificial Sequence
  source: /note="Description of Artificial Sequence: Synthetic peptide"
MKSEKPINM

SEQ ID NO: 14070 - protein, 10 aa, Artificial Sequence
  source: /note="Description of Artificial Sequence: Synthetic peptide"
ALKYLGEPMK

SEQ ID NO: 14071 - protein, 10 aa, Artificial Sequence
  source: /note="Description of Artificial Sequence: Synthetic peptide"
DALKYLGEPM

SEQ ID NO: 14072 - protein, 9 aa, Artificial Sequence
  source: /note="Description of Artificial Sequence: Synthetic peptide"
KEFVCHWGA

SEQ ID NO: 14073 - protein, 10 aa, Artificial Sequence
  source: /note="Description of Artificial Sequence: Synthetic peptide"
KEFVCHWGAA

SEQ ID NO: 14074 - protein, 9 aa, Artificial Sequence
  source: /note="Description of Artificial Sequence: Synthetic peptide"
ALGHGVRRA

SEQ ID NO: 14075 - protein, 9 aa, Artificial Sequence
  source: /note="Description of Artificial Sequence: Synthetic peptide"
DALGHGVRR

SEQ ID NO: 14076 - protein, 9 aa, Artificial Sequence
  source: /note="Description of Artificial Sequence: Synthetic peptide"
RHLQPHDAL

SEQ ID NO: 14077 - protein, 10 aa, Artificial Sequence
  source: /note="Description of Artificial Sequence: Synthetic peptide"
RRHLQPHDAL

SEQ ID NO: 14078 - protein, 9 aa, Artificial Sequence
  source: /note="Description of Artificial Sequence: Synthetic peptide"
AVSCFRITR

SEQ ID NO: 14079 - protein, 9 aa, Artificial Sequence
  source: /note="Description of Artificial Sequence: Synthetic peptide"
SSLSSCNPR

SEQ ID NO: 14080 - protein, 9 aa, Artificial Sequence
  source: /note="Description of Artificial Sequence: Synthetic peptide"
SLSSCNPRR

SEQ ID NO: 14081 - protein, 9 aa, Artificial Sequence
  source: /note="Description of Artificial Sequence: Synthetic peptide"
SCNPRRWPR

SEQ ID NO: 14082 - protein, 9 aa, Artificial Sequence
  source: /note="Description of Artificial Sequence: Synthetic peptide"
RWPRPRRSA

SEQ ID NO: 14083 - protein, 9 aa, Artificial Sequence
  source: /note="Description of Artificial Sequence: Synthetic peptide"
RRSAVSCFR

SEQ ID NO: 14084 - protein, 9 aa, Artificial Sequence
  source: /note="Description of Artificial Sequence: Synthetic peptide"
RSAVSCFRI

SEQ ID NO: 14085 - protein, 9 aa, Artificial Sequence
  source: /note="Description of Artificial Sequence: Synthetic peptide"
CFRITRGPR

SEQ ID NO: 14086 - protein, 9 aa, Artificial Sequence
  source: /note="Description of Artificial Sequence: Synthetic peptide"
ITRGPRAAS

SEQ ID NO: 14087 - protein, 9 aa, Artificial Sequence
  source: /note="Description of Artificial Sequence: Synthetic peptide"
STRPPVLPA

SEQ ID NO: 14088 - protein, 9 aa, Artificial Sequence
  source: /note="Description of Artificial Sequence: Synthetic peptide"
NPRRWPRPR

SEQ ID NO: 14089 - protein, 9 aa, Artificial Sequence
  source: /note="Description of Artificial Sequence: Synthetic peptide"
WPRPRRSAV

SEQ ID NO: 14090 - protein, 9 aa, Artificial Sequence
  source: /note="Description of Artificial Sequence: Synthetic peptide"
RPRRSAVSC

SEQ ID NO: 14091 - protein, 9 aa, Artificial Sequence
  source: /note="Description of Artificial Sequence: Synthetic peptide"
GPRAASPET

SEQ ID NO: 14092 - protein, 9 aa, Artificial Sequence
  source: /note="Description of Artificial Sequence: Synthetic peptide"
LPASPRTSP

SEQ ID NO: 14093 - protein, 10 aa, Artificial Sequence
  source: /note="Description of Artificial Sequence: Synthetic peptide"
FSSLSSCNPR

SEQ ID NO: 14094 - protein, 10 aa, Artificial Sequence
  source: /note="Description of Artificial Sequence: Synthetic peptide"
SSLSSCNPRR

SEQ ID NO: 14095 - protein, 10 aa, Artificial Sequence
  source: /note="Description of Artificial Sequence: Synthetic peptide"
SSCNPRRWPR

SEQ ID NO: 14096 - protein, 10 aa, Artificial Sequence
  source: /note="Description of Artificial Sequence: Synthetic peptide"
SAVSCFRITR

SEQ ID NO: 14097 - protein, 10 aa, Artificial Sequence
  source: /note="Description of Artificial Sequence: Synthetic peptide"
RWPRPRRSAV

SEQ ID NO: 14098 - protein, 10 aa, Artificial Sequence
  source: /note="Description of Artificial Sequence: Synthetic peptide"
CFRITRGPRA

SEQ ID NO: 14099 - protein, 10 aa, Artificial Sequence
  source: /note="Description of Artificial Sequence: Synthetic peptide"
ITRGPRAASP

SEQ ID NO: 14100 - protein, 10 aa, Artificial Sequence
  source: /note="Description of Artificial Sequence: Synthetic peptide"
RAASPETSTR

SEQ ID NO: 14101 - protein, 10 aa, Artificial Sequence
  source: /note="Description of Artificial Sequence: Synthetic peptide"
STRPPVLPAS

SEQ ID NO: 14102 - protein, 10 aa, Artificial Sequence
  source: /note="Description of Artificial Sequence: Synthetic peptide"
CNPRRWPRPR

SEQ ID NO: 14103 - protein, 10 aa, Artificial Sequence
  source: /note="Description of Artificial Sequence: Synthetic peptide"
SCFRITRGPR

SEQ ID NO: 14104 - protein, 10 aa, Artificial Sequence
  source: /note="Description of Artificial Sequence: Synthetic peptide"
WPRPRRSAVS

SEQ ID NO: 14105 - protein, 10 aa, Artificial Sequence
  source: /note="Description of Artificial Sequence: Synthetic peptide"
RPRRSAVSCF

SEQ ID NO: 14106 - protein, 10 aa, Artificial Sequence
  source: /note="Description of Artificial Sequence: Synthetic peptide"
SPETSTRPPV

SEQ ID NO: 14107 - protein, 10 aa, Artificial Sequence
  source: /note="Description of Artificial Sequence: Synthetic peptide"
LPASPRTSPW

SEQ ID NO: 14108 - protein, 10 aa, Artificial Sequence
  source: /note="Description of Artificial Sequence: Synthetic peptide"
RRWPRPRRSA

SEQ ID NO: 14109 - protein, 10 aa, Artificial Sequence
  source: /note="Description of Artificial Sequence: Synthetic peptide"
RRSAVSCFRI

SEQ ID NO: 14110 - protein, 10 aa, Artificial Sequence
  source: /note="Description of Artificial Sequence: Synthetic peptide"
FRITRGPRAA

SEQ ID NO: 14111 - protein, 9 aa, Artificial Sequence
  source: /note="Description of Artificial Sequence: Synthetic peptide"
HVQKLDILY

SEQ ID NO: 14112 - protein, 9 aa, Artificial Sequence
  source: /note="Description of Artificial Sequence: Synthetic peptide"
SILNFMVLV

SEQ ID NO: 14113 - protein, 9 aa, Artificial Sequence
  source: /note="Description of Artificial Sequence: Synthetic peptide"
ALKMNLLQV

SEQ ID NO: 14114 - protein, 9 aa, Artificial Sequence
  source: /note="Description of Artificial Sequence: Synthetic peptide"
KMNLLQVLL

SEQ ID NO: 14115 - protein, 9 aa, Artificial Sequence
  source: /note="Description of Artificial Sequence: Synthetic peptide"
LLQVLLSEV

SEQ ID NO: 14116 - protein, 9 aa, Artificial Sequence
  source: /note="Description of Artificial Sequence: Synthetic peptide"
KMAVALETV

SEQ ID NO: 14117 - protein, 9 aa, Artificial Sequence
  source: /note="Description of Artificial Sequence: Synthetic peptide"
LIIFSLFGT

SEQ ID NO: 14118 - protein, 9 aa, Artificial Sequence
  source: /note="Description of Artificial Sequence: Synthetic peptide"
TLTKLVVLL

SEQ ID NO: 14119 - protein, 9 aa, Artificial Sequence
  source: /note="Description of Artificial Sequence: Synthetic peptide"
KLVVLLLHV

SEQ ID NO: 14120 - protein, 9 aa, Artificial Sequence
  source: /note="Description of Artificial Sequence: Synthetic peptide"
VLLLHVQKL

SEQ ID NO: 14121 - protein, 9 aa, Artificial Sequence
  source: /note="Description of Artificial Sequence: Synthetic peptide"
YMQQFSYAT

SEQ ID NO: 14122 - protein, 9 aa, Artificial Sequence
  source: /note="Description of Artificial Sequence: Synthetic peptide"
VLVKICGSA

SEQ ID NO: 14123 - protein, 9 aa, Artificial Sequence
  source: /note="Description of Artificial Sequence: Synthetic peptide"
CLRIIFIYK

SEQ ID NO: 14124 - protein, 9 aa, Artificial Sequence
  source: /note="Description of Artificial Sequence: Synthetic peptide"
IIFIYKMYK

SEQ ID NO: 14125 - protein, 9 aa, Artificial Sequence
  source: /note="Description of Artificial Sequence: Synthetic peptide"
KMYKWSILN

SEQ ID NO: 14126 - protein, 9 aa, Artificial Sequence
  source: /note="Description of Artificial Sequence: Synthetic peptide"
ILNFMVLVK

SEQ ID NO: 14127 - protein, 9 aa, Artificial Sequence
  source: /note="Description of Artificial Sequence: Synthetic peptide"
SLFGTTLTK

SEQ ID NO: 14128 - protein, 9 aa, Artificial Sequence
  source: /note="Description of Artificial Sequence: Synthetic peptide"
VVLLLHVQK

SEQ ID NO: 14129 - protein, 9 aa, Artificial Sequence
  source: /note="Description of Artificial Sequence: Synthetic peptide"
ILYMQQFSY

SEQ ID NO: 14130 - protein, 9 aa, Artificial Sequence
  source: /note="Description of Artificial Sequence: Synthetic peptide"
QQFSYATMR

SEQ ID NO: 14131 - protein, 9 aa, Artificial Sequence
  source: /note="Description of Artificial Sequence: Synthetic peptide"
IFIYKMYKW

SEQ ID NO: 14132 - protein, 9 aa, Artificial Sequence
  source: /note="Description of Artificial Sequence: Synthetic peptide"
IYKMYKWSI

SEQ ID NO: 14133 - protein, 9 aa, Artificial Sequence
  source: /note="Description of Artificial Sequence: Synthetic peptide"
MYKWSILNF

SEQ ID NO: 14134 - protein, 9 aa, Artificial Sequence
  source: /note="Description of Artificial Sequence: Synthetic peptide"
KWSILNFMV

SEQ ID NO: 14135 - protein, 9 aa, Artificial Sequence
  source: /note="Description of Artificial Sequence: Synthetic peptide"
TVLIIFSLF

SEQ ID NO: 14136 - protein, 9 aa, Artificial Sequence
  source: /note="Description of Artificial Sequence: Synthetic peptide"
IFSLFGTTL

SEQ ID NO: 14137 - protein, 9 aa, Artificial Sequence
  source: /note="Description of Artificial Sequence: Synthetic peptide"
LYMQQFSYA

SEQ ID NO: 14138 - protein, 9 aa, Artificial Sequence
  source: /note="Description of Artificial Sequence: Synthetic peptide"
TARAWGKNV

SEQ ID NO: 14139 - protein, 9 aa, Artificial Sequence
  source: /note="Description of Artificial Sequence: Synthetic peptide"
MQRRKCTIL

SEQ ID NO: 14140 - protein, 9 aa, Artificial Sequence
  source: /note="Description of Artificial Sequence: Synthetic peptide"
QRRKCTILK

SEQ ID NO: 14141 - protein, 9 aa, Artificial Sequence
  source: /note="Description of Artificial Sequence: Synthetic peptide"
RIIFIYKMY

SEQ ID NO: 14142 - protein, 9 aa, Artificial Sequence
  source: /note="Description of Artificial Sequence: Synthetic peptide"
LLSEVGMQR

SEQ ID NO: 14143 - protein, 9 aa, Artificial Sequence
  source: /note="Description of Artificial Sequence: Synthetic peptide"
CTILKMAVA

SEQ ID NO: 14144 - protein, 9 aa, Artificial Sequence
  source: /note="Description of Artificial Sequence: Synthetic peptide"
ETVLIIFSL

SEQ ID NO: 14145 - protein, 9 aa, Artificial Sequence
  source: /note="Description of Artificial Sequence: Synthetic peptide"
LVKICGSAL

SEQ ID NO: 14146 - protein, 9 aa, Artificial Sequence
  source: /note="Description of Artificial Sequence: Synthetic peptide"
YKMYKWSIL

SEQ ID NO: 14147 - protein, 9 aa, Artificial Sequence
  source: /note="Description of Artificial Sequence: Synthetic peptide"
GMQRRKCTI

SEQ ID NO: 14148 - protein, 9 aa, Artificial Sequence
  source: /note="Description of Artificial Sequence: Synthetic peptide"
VQKLDILYM

SEQ ID NO: 14149 - protein, 9 aa, Artificial Sequence
  source: /note="Description of Artificial Sequence: Synthetic peptide"
MQQFSYATM

SEQ ID NO: 14150 - protein, 9 aa, Artificial Sequence
  source: /note="Description of Artificial Sequence: Synthetic peptide"
RAWGKNVCL

SEQ ID NO: 14151 - protein, 9 aa, Artificial Sequence
  source: /note="Description of Artificial Sequence: Synthetic peptide"
KNVCLRIIF

SEQ ID NO: 14152 - protein, 9 aa, Artificial Sequence
  source: /note="Description of Artificial Sequence: Synthetic peptide"
LRIIFIYKM

SEQ ID NO: 14153 - protein, 9 aa, Artificial Sequence
  source: /note="Description of Artificial Sequence: Synthetic peptide"
YKWSILNFM

SEQ ID NO: 14154 - protein, 9 aa, Artificial Sequence
  source: /note="Description of Artificial Sequence: Synthetic peptide"
WSILNFMVL

SEQ ID NO: 14155 - protein, 9 aa, Artificial Sequence
  source: /note="Description of Artificial Sequence: Synthetic peptide"
KICGSALKM

SEQ ID NO: 14156 - protein, 9 aa, Artificial Sequence
  source: /note="Description of Artificial Sequence: Synthetic peptide"
LKMNLLQVL

SEQ ID NO: 14157 - protein, 9 aa, Artificial Sequence
  source: /note="Description of Artificial Sequence: Synthetic peptide"
LQVLLSEVG

SEQ ID NO: 14158 - protein, 9 aa, Artificial Sequence
  source: /note="Description of Artificial Sequence: Synthetic peptide"
RRKCTILKM

SEQ ID NO: 14159 - protein, 9 aa, Artificial Sequence
  source: /note="Description of Artificial Sequence: Synthetic peptide"
LKMAVALET

SEQ ID NO: 14160 - protein, 9 aa, Artificial Sequence
  source: /note="Description of Artificial Sequence: Synthetic peptide"
MAVALETVL

SEQ ID NO: 14161 - protein, 9 aa, Artificial Sequence
  source: /note="Description of Artificial Sequence: Synthetic peptide"
VALETVLII

SEQ ID NO: 14162 - protein, 9 aa, Artificial Sequence
  source: /note="Description of Artificial Sequence: Synthetic peptide"
ALETVLIIF

SEQ ID NO: 14163 - protein, 9 aa, Artificial Sequence
  source: /note="Description of Artificial Sequence: Synthetic peptide"
LHVQKLDIL

SEQ ID NO: 14164 - protein, 9 aa, Artificial Sequence
  source: /note="Description of Artificial Sequence: Synthetic peptide"
LDILYMQQF

SEQ ID NO: 14165 - protein, 10 aa, Artificial Sequence
  source: /note="Description of Artificial Sequence: Synthetic peptide"
FIYKMYKWSI

SEQ ID NO: 14166 - protein, 10 aa, Artificial Sequence
  source: /note="Description of Artificial Sequence: Synthetic peptide"
YKWSILNFMV

SEQ ID NO: 14167 - protein, 10 aa, Artificial Sequence
  source: /note="Description of Artificial Sequence: Synthetic peptide"
WSILNFMVLV

SEQ ID NO: 14168 - protein, 10 aa, Artificial Sequence
  source: /note="Description of Artificial Sequence: Synthetic peptide"
ILNFMVLVKI

SEQ ID NO: 14169 - protein, 10 aa, Artificial Sequence
  source: /note="Description of Artificial Sequence: Synthetic peptide"
NLLQVLLSEV

SEQ ID NO: 14170 - protein, 10 aa, Artificial Sequence
  source: /note="Description of Artificial Sequence: Synthetic peptide"
KMAVALETVL

SEQ ID NO: 14171 - protein, 10 aa, Artificial Sequence
  source: /note="Description of Artificial Sequence: Synthetic peptide"
VLIIFSLFGT

SEQ ID NO: 14172 - protein, 10 aa, Artificial Sequence
  source: /note="Description of Artificial Sequence: Synthetic peptide"
IIFSLFGTTL

SEQ ID NO: 14173 - protein, 10 aa, Artificial Sequence
  source: /note="Description of Artificial Sequence: Synthetic peptide"
SLFGTTLTKL

SEQ ID NO: 14174 - protein, 10 aa, Artificial Sequence
  source: /note="Description of Artificial Sequence: Synthetic peptide"
TLTKLVVLLL

SEQ ID NO: 14175 - protein, 10 aa, Artificial Sequence
  source: /note="Description of Artificial Sequence: Synthetic peptide"
ILYMQQFSYA

SEQ ID NO: 14176 - protein, 10 aa, Artificial Sequence
  source: /note="Description of Artificial Sequence: Synthetic peptide"
YMQQFSYATM

SEQ ID NO: 14177 - protein, 10 aa, Artificial Sequence
  source: /note="Description of Artificial Sequence: Synthetic peptide"
VLVKICGSAL

SEQ ID NO: 14178 - protein, 10 aa, Artificial Sequence
  source: /note="Description of Artificial Sequence: Synthetic peptide"
ALKMNLLQVL

SEQ ID NO: 14179 - protein, 10 aa, Artificial Sequence
  source: /note="Description of Artificial Sequence: Synthetic peptide"
RIIFIYKMYK

SEQ ID NO: 14180 - protein, 10 aa, Artificial Sequence
  source: /note="Description of Artificial Sequence: Synthetic peptide"
KMYKWSILNF

SEQ ID NO: 14181 - protein, 10 aa, Artificial Sequence
  source: /note="Description of Artificial Sequence: Synthetic peptide"
SILNFMVLVK

SEQ ID NO: 14182 - protein, 10 aa, Artificial Sequence
  source: /note="Description of Artificial Sequence: Synthetic peptide"
LVKICGSALK

SEQ ID NO: 14183 - protein, 10 aa, Artificial Sequence
  source: /note="Description of Artificial Sequence: Synthetic peptide"
MQRRKCTILK

SEQ ID NO: 14184 - protein, 10 aa, Artificial Sequence
  source: /note="Description of Artificial Sequence: Synthetic peptide"
FSLFGTTLTK

SEQ ID NO: 14185 - protein, 10 aa, Artificial Sequence
  source: /note="Description of Artificial Sequence: Synthetic peptide"
RAWGKNVCLR

SEQ ID NO: 14186 - protein, 10 aa, Artificial Sequence
  source: /note="Description of Artificial Sequence: Synthetic peptide"
LVVLLLHVQK

SEQ ID NO: 14187 - protein, 10 aa, Artificial Sequence
  source: /note="Description of Artificial Sequence: Synthetic peptide"
MQQFSYATMR

SEQ ID NO: 14188 - protein, 10 aa, Artificial Sequence
  source: /note="Description of Artificial Sequence: Synthetic peptide"
AWGKNVCLRI

SEQ ID NO: 14189 - protein, 10 aa, Artificial Sequence
  source: /note="Description of Artificial Sequence: Synthetic peptide"
IYKMYKWSIL

SEQ ID NO: 14190 - protein, 10 aa, Artificial Sequence
  source: /note="Description of Artificial Sequence: Synthetic peptide"
MYKWSILNFM

SEQ ID NO: 14191 - protein, 10 aa, Artificial Sequence
  source: /note="Description of Artificial Sequence: Synthetic peptide"
KWSILNFMVL

SEQ ID NO: 14192 - protein, 10 aa, Artificial Sequence
  source: /note="Description of Artificial Sequence: Synthetic peptide"
VALETVLIIF

SEQ ID NO: 14193 - protein, 10 aa, Artificial Sequence
  source: /note="Description of Artificial Sequence: Synthetic peptide"
ETVLIIFSLF

SEQ ID NO: 14194 - protein, 10 aa, Artificial Sequence
  source: /note="Description of Artificial Sequence: Synthetic peptide"
LYMQQFSYAT

SEQ ID NO: 14195 - protein, 10 aa, Artificial Sequence
  source: /note="Description of Artificial Sequence: Synthetic peptide"
RTARAWGKNV

SEQ ID NO: 14196 - protein, 10 aa, Artificial Sequence
  source: /note="Description of Artificial Sequence: Synthetic peptide"
CLRIIFIYKM

SEQ ID NO: 14197 - protein, 10 aa, Artificial Sequence
  source: /note="Description of Artificial Sequence: Synthetic peptide"
DILYMQQFSY

SEQ ID NO: 14198 - protein, 10 aa, Artificial Sequence
  source: /note="Description of Artificial Sequence: Synthetic peptide"
CTILKMAVAL

SEQ ID NO: 14199 - protein, 10 aa, Artificial Sequence
  source: /note="Description of Artificial Sequence: Synthetic peptide"
MAVALETVLI

SEQ ID NO: 14200 - protein, 10 aa, Artificial Sequence
  source: /note="Description of Artificial Sequence: Synthetic peptide"
VGMQRRKCTI

SEQ ID NO: 14201 - protein, 10 aa, Artificial Sequence
  source: /note="Description of Artificial Sequence: Synthetic peptide"
GMQRRKCTIL

SEQ ID NO: 14202 - protein, 10 aa, Artificial Sequence
  source: /note="Description of Artificial Sequence: Synthetic peptide"
LQVLLSEVGM

SEQ ID NO: 14203 - protein, 10 aa, Artificial Sequence
  source: /note="Description of Artificial Sequence: Synthetic peptide"
ARAWGKNVCL

SEQ ID NO: 14204 - protein, 10 aa, Artificial Sequence
  source: /note="Description of Artificial Sequence: Synthetic peptide"
GKNVCLRIIF

SEQ ID NO: 14205 - protein, 10 aa, Artificial Sequence
  source: /note="Description of Artificial Sequence: Synthetic peptide"
LRIIFIYKMY

SEQ ID NO: 14206 - protein, 10 aa, Artificial Sequence
  source: /note="Description of Artificial Sequence: Synthetic peptide"
IIFIYKMYKW

SEQ ID NO: 14207 - protein, 10 aa, Artificial Sequence
  source: /note="Description of Artificial Sequence: Synthetic peptide"
VKICGSALKM

SEQ ID NO: 14208 - protein, 10 aa, Artificial Sequence
  source: /note="Description of Artificial Sequence: Synthetic peptide"
LKMNLLQVLL

SEQ ID NO: 14209 - protein, 10 aa, Artificial Sequence
  source: /note="Description of Artificial Sequence: Synthetic peptide"
QRRKCTILKM

SEQ ID NO: 14210 - protein, 10 aa, Artificial Sequence
  source: /note="Description of Artificial Sequence: Synthetic peptide"
LKMAVALETV

SEQ ID NO: 14211 - protein, 10 aa, Artificial Sequence
  source: /note="Description of Artificial Sequence: Synthetic peptide"
LETVLIIFSL

SEQ ID NO: 14212 - protein, 10 aa, Artificial Sequence
  source: /note="Description of Artificial Sequence: Synthetic peptide"
LHVQKLDILY

SEQ ID NO: 14213 - protein, 10 aa, Artificial Sequence
  source: /note="Description of Artificial Sequence: Synthetic peptide"
HVQKLDILYM

SEQ ID NO: 14214 - protein, 10 aa, Artificial Sequence
  source: /note="Description of Artificial Sequence: Synthetic peptide"
KLDILYMQQF

SEQ ID NO: 14215 - protein, 10 aa, Artificial Sequence
  source: /note="Description of Artificial Sequence: Synthetic peptide"
QQFSYATMRQ

SEQ ID NO: 14216 - protein, 9 aa, Artificial Sequence
  source: /note="Description of Artificial Sequence: Synthetic peptide"
IAFSCPPER

SEQ ID NO: 14217 - protein, 9 aa, Artificial Sequence
  source: /note="Description of Artificial Sequence: Synthetic peptide"
NSTGGHSGR

SEQ ID NO: 14218 - protein, 9 aa, Artificial Sequence
  source: /note="Description of Artificial Sequence: Synthetic peptide"
HPRESNSTG

SEQ ID NO: 14219 - protein, 9 aa, Artificial Sequence
  source: /note="Description of Artificial Sequence: Synthetic peptide"
RESNSTGGH

SEQ ID NO: 14220 - protein, 9 aa, Artificial Sequence
  source: /note="Description of Artificial Sequence: Synthetic peptide"
CPPERVARL

SEQ ID NO: 14221 - protein, 10 aa, Artificial Sequence
  source: /note="Description of Artificial Sequence: Synthetic peptide"
RIAFSCPPER

SEQ ID NO: 14222 - protein, 10 aa, Artificial Sequence
  source: /note="Description of Artificial Sequence: Synthetic peptide"
VARLRRLDEK

SEQ ID NO: 14223 - protein, 10 aa, Artificial Sequence
  source: /note="Description of Artificial Sequence: Synthetic peptide"
FSCPPERVAR

SEQ ID NO: 14224 - protein, 10 aa, Artificial Sequence
  source: /note="Description of Artificial Sequence: Synthetic peptide"
IAFSCPPERV

SEQ ID NO: 14225 - protein, 9 aa, Artificial Sequence
  source: /note="Description of Artificial Sequence: Synthetic peptide"
FYWVIYKII

SEQ ID NO: 14226 - protein, 10 aa, Artificial Sequence
  source: /note="Description of Artificial Sequence: Synthetic peptide"
IFYWVIYKII

SEQ ID NO: 14227 - protein, 10 aa, Artificial Sequence
  source: /note="Description of Artificial Sequence: Synthetic peptide"
IYKIIRHEDI

SEQ ID NO: 14228 - protein, 10 aa, Artificial Sequence
  source: /note="Description of Artificial Sequence: Synthetic peptide"
FYWVIYKIIR

SEQ ID NO: 14229 - protein, 9 aa, Artificial Sequence
  source: /note="Description of Artificial Sequence: Synthetic peptide"
LLFANEKGA

SEQ ID NO: 14230 - protein, 9 aa, Artificial Sequence
  source: /note="Description of Artificial Sequence: Synthetic peptide"
SIWKPDLLF

SEQ ID NO: 14231 - protein, 9 aa, Artificial Sequence
  source: /note="Description of Artificial Sequence: Synthetic peptide"
IWKPDLLFA

SEQ ID NO: 14232 - protein, 9 aa, Artificial Sequence
  source: /note="Description of Artificial Sequence: Synthetic peptide"
DSIWKPDLL

SEQ ID NO: 14233 - protein, 10 aa, Artificial Sequence
  source: /note="Description of Artificial Sequence: Synthetic peptide"
SIWKPDLLFA

SEQ ID NO: 14234 - protein, 10 aa, Artificial Sequence
  source: /note="Description of Artificial Sequence: Synthetic peptide"
LFANEKGANF

SEQ ID NO: 14235 - protein, 9 aa, Artificial Sequence
  source: /note="Description of Artificial Sequence: Synthetic peptide"
TLALGHVAA

SEQ ID NO: 14236 - protein, 9 aa, Artificial Sequence
  source: /note="Description of Artificial Sequence: Synthetic peptide"
DTTLALGHV

SEQ ID NO: 14237 - protein, 9 aa, Artificial Sequence
  source: /note="Description of Artificial Sequence: Synthetic peptide"
TTLALGHVA

SEQ ID NO: 14238 - protein, 9 aa, Artificial Sequence
  source: /note="Description of Artificial Sequence: Synthetic peptide"
LALGHVAAF

SEQ ID NO: 14239 - protein, 10 aa, Artificial Sequence
  source: /note="Description of Artificial Sequence: Synthetic peptide"
DTTLALGHVA

SEQ ID NO: 14240 - protein, 10 aa, Artificial Sequence
  source: /note="Description of Artificial Sequence: Synthetic peptide"
TTLALGHVAA

SEQ ID NO: 14241 - protein, 10 aa, Artificial Sequence
  source: /note="Description of Artificial Sequence: Synthetic peptide"
TLALGHVAAF

SEQ ID NO: 14242 - protein, 9 aa, Artificial Sequence
  source: /note="Description of Artificial Sequence: Synthetic peptide"
RRRRRQARR

SEQ ID NO: 14243 - protein, 9 aa, Artificial Sequence
  source: /note="Description of Artificial Sequence: Synthetic peptide"
ELARRRRRR

SEQ ID NO: 14244 - protein, 9 aa, Artificial Sequence
  source: /note="Description of Artificial Sequence: Synthetic peptide"
RLAELARRR

SEQ ID NO: 14245 - protein, 10 aa, Artificial Sequence
  source: /note="Description of Artificial Sequence: Synthetic peptide"
LARRRRRRQA

SEQ ID NO: 14246 - protein, 10 aa, Artificial Sequence
  source: /note="Description of Artificial Sequence: Synthetic peptide"
RRRRRRQARR

SEQ ID NO: 14247 - protein, 10 aa, Artificial Sequence
  source: /note="Description of Artificial Sequence: Synthetic peptide"
RLAELARRRR

SEQ ID NO: 14248 - protein, 9 aa, Artificial Sequence
  source: /note="Description of Artificial Sequence: Synthetic peptide"
SPRLRESAA

SEQ ID NO: 14249 - protein, 9 aa, Artificial Sequence
  source: /note="Description of Artificial Sequence: Synthetic peptide"
GALSGSPRL

SEQ ID NO: 14250 - protein, 10 aa, Artificial Sequence
  source: /note="Description of Artificial Sequence: Synthetic peptide"
RGGALSGSPR

SEQ ID NO: 14251 - protein, 10 aa, Artificial Sequence
  source: /note="Description of Artificial Sequence: Synthetic peptide"
QVIVSRGGAL

SEQ ID NO: 14252 - protein, 10 aa, Artificial Sequence
  source: /note="Description of Artificial Sequence: Synthetic peptide"
SPRLRESAAV

SEQ ID NO: 14253 - protein, 9 aa, Artificial Sequence
  source: /note="Description of Artificial Sequence: Synthetic peptide"
ILLAGRPTK

SEQ ID NO: 14254 - protein, 9 aa, Artificial Sequence
  source: /note="Description of Artificial Sequence: Synthetic peptide"
SQQDILLAG

SEQ ID NO: 14255 - protein, 10 aa, Artificial Sequence
  source: /note="Description of Artificial Sequence: Synthetic peptide"
LLAGRPTKGI

SEQ ID NO: 14256 - protein, 9 aa, Artificial Sequence
  source: /note="Description of Artificial Sequence: Synthetic peptide"
KIKKSQLTI

SEQ ID NO: 14257 - protein, 9 aa, Artificial Sequence
  source: /note="Description of Artificial Sequence: Synthetic peptide"
QLTICFPEY

SEQ ID NO: 14258 - protein, 9 aa, Artificial Sequence
  source: /note="Description of Artificial Sequence: Synthetic peptide"
KKSQLTICF

SEQ ID NO: 14259 - protein, 10 aa, Artificial Sequence
  source: /note="Description of Artificial Sequence: Synthetic peptide"
KIKKSQLTIC

SEQ ID NO: 14260 - protein, 10 aa, Artificial Sequence
  source: /note="Description of Artificial Sequence: Synthetic peptide"
SQLTICFPEY

SEQ ID NO: 14261 - protein, 10 aa, Artificial Sequence
  source: /note="Description of Artificial Sequence: Synthetic peptide"
IKKSQLTICF

SEQ ID NO: 14262 - protein, 10 aa, Artificial Sequence
  source: /note="Description of Artificial Sequence: Synthetic peptide"
FEEKIKKSQL

SEQ ID NO: 14263 - protein, 9 aa, Artificial Sequence
  source: /note="Description of Artificial Sequence: Synthetic peptide"
CCVLTSGIF

SEQ ID NO: 14264 - protein, 10 aa, Artificial Sequence
  source: /note="Description of Artificial Sequence: Synthetic peptide"
RCCVLTSGIF

SEQ ID NO: 14265 - protein, 9 aa, Artificial Sequence
  source: /note="Description of Artificial Sequence: Synthetic peptide"
LLRCHVLTS

SEQ ID NO: 14266 - protein, 9 aa, Artificial Sequence
  source: /note="Description of Artificial Sequence: Synthetic peptide"
CHVLTSGIF

SEQ ID NO: 14267 - protein, 10 aa, Artificial Sequence
  source: /note="Description of Artificial Sequence: Synthetic peptide"
RCHVLTSGIF

SEQ ID NO: 14268 - protein, 9 aa, Artificial Sequence
  source: /note="Description of Artificial Sequence: Synthetic peptide"
LTIWDSYTT

SEQ ID NO: 14269 - protein, 9 aa, Artificial Sequence
  source: /note="Description of Artificial Sequence: Synthetic peptide"
SQDGKLTIW

SEQ ID NO: 14270 - protein, 9 aa, Artificial Sequence
  source: /note="Description of Artificial Sequence: Synthetic peptide"
GKLTIWDSY

SEQ ID NO: 14271 - protein, 10 aa, Artificial Sequence
  source: /note="Description of Artificial Sequence: Synthetic peptide"
TIWDSYTTNK

SEQ ID NO: 14272 - protein, 10 aa, Artificial Sequence
  source: /note="Description of Artificial Sequence: Synthetic peptide"
ASQDGKLTIW

SEQ ID NO: 14273 - protein, 9 aa, Artificial Sequence
  source: /note="Description of Artificial Sequence: Synthetic peptide"
KLASSYSGI

SEQ ID NO: 14274 - protein, 9 aa, Artificial Sequence
  source: /note="Description of Artificial Sequence: Synthetic peptide"
ASSYSGIEK

SEQ ID NO: 14275 - protein, 9 aa, Artificial Sequence
  source: /note="Description of Artificial Sequence: Synthetic peptide"
LLASSQQRK

SEQ ID NO: 14276 - protein, 9 aa, Artificial Sequence
  source: /note="Description of Artificial Sequence: Synthetic peptide"
KDKKLASSY

SEQ ID NO: 14277 - protein, 9 aa, Artificial Sequence
  source: /note="Description of Artificial Sequence: Synthetic peptide"
KKLASSYSG

SEQ ID NO: 14278 - protein, 9 aa, Artificial Sequence
  source: /note="Description of Artificial Sequence: Synthetic peptide"
KQLLASSQQ

SEQ ID NO: 14279 - protein, 9 aa, Artificial Sequence
  source: /note="Description of Artificial Sequence: Synthetic peptide"
IEKQLLASS

SEQ ID NO: 14280 - protein, 10 aa, Artificial Sequence
  source: /note="Description of Artificial Sequence: Synthetic peptide"
LLASSQQRKL

SEQ ID NO: 14281 - protein, 10 aa, Artificial Sequence
  source: /note="Description of Artificial Sequence: Synthetic peptide"
QLLASSQQRK

SEQ ID NO: 14282 - protein, 10 aa, Artificial Sequence
  source: /note="Description of Artificial Sequence: Synthetic peptide"
LASSYSGIEK

SEQ ID NO: 14283 - protein, 10 aa, Artificial Sequence
  source: /note="Description of Artificial Sequence: Synthetic peptide"
SYSGIEKQLL

SEQ ID NO: 14284 - protein, 10 aa, Artificial Sequence
  source: /note="Description of Artificial Sequence: Synthetic peptide"
FKDKKLASSY

SEQ ID NO: 14285 - protein, 10 aa, Artificial Sequence
  source: /note="Description of Artificial Sequence: Synthetic peptide"
KKLASSYSGI

SEQ ID NO: 14286 - protein, 10 aa, Artificial Sequence
  source: /note="Description of Artificial Sequence: Synthetic peptide"
SSYSGIEKQL

SEQ ID NO: 14287 - protein, 10 aa, Artificial Sequence
  source: /note="Description of Artificial Sequence: Synthetic peptide"
SENPFKDKKL

SEQ ID NO: 14288 - protein, 9 aa, Artificial Sequence
  source: /note="Description of Artificial Sequence: Synthetic peptide"
RGFLRYWVS

SEQ ID NO: 14289 - protein, 9 aa, Artificial Sequence
  source: /note="Description of Artificial Sequence: Synthetic peptide"
DLNRGFLRY

SEQ ID NO: 14290 - protein, 10 aa, Artificial Sequence
  source: /note="Description of Artificial Sequence: Synthetic peptide"
TADLNRGFLR

SEQ ID NO: 14291 - protein, 10 aa, Artificial Sequence
  source: /note="Description of Artificial Sequence: Synthetic peptide"
CTADLNRGFL

SEQ ID NO: 14292 - protein, 10 aa, Artificial Sequence
  source: /note="Description of Artificial Sequence: Synthetic peptide"
ADLNRGFLRY

SEQ ID NO: 14293 - protein, 9 aa, Artificial Sequence
  source: /note="Description of Artificial Sequence: Synthetic peptide"
EYQNRFLHM

SEQ ID NO: 14294 - protein, 9 aa, Artificial Sequence
  source: /note="Description of Artificial Sequence: Synthetic peptide"
LPREYQNRF

SEQ ID NO: 14295 - protein, 9 aa, Artificial Sequence
  source: /note="Description of Artificial Sequence: Synthetic peptide"
REYQNRFLH

SEQ ID NO: 14296 - protein, 9 aa, Artificial Sequence
  source: /note="Description of Artificial Sequence: Synthetic peptide"
YQNRFLHMH

SEQ ID NO: 14297 - protein, 10 aa, Artificial Sequence
  source: /note="Description of Artificial Sequence: Synthetic peptide"
LPREYQNRFL

SEQ ID NO: 14298 - protein, 10 aa, Artificial Sequence
  source: /note="Description of Artificial Sequence: Synthetic peptide"
REYQNRFLHM

SEQ ID NO: 14299 - protein, 10 aa, Artificial Sequence
  source: /note="Description of Artificial Sequence: Synthetic peptide"
SQFELPREYQ

SEQ ID NO: 14300 - protein, 9 aa, Artificial Sequence
  source: /note="Description of Artificial Sequence: Synthetic peptide"
MELEDHITH

SEQ ID NO: 14301 - protein, 9 aa, Artificial Sequence
  source: /note="Description of Artificial Sequence: Synthetic peptide"
HKTIEIESL

SEQ ID NO: 14302 - protein, 10 aa, Artificial Sequence
  source: /note="Description of Artificial Sequence: Synthetic peptide"
LEDHITHKTI

SEQ ID NO: 14303 - protein, 9 aa, Artificial Sequence
  source: /note="Description of Artificial Sequence: Synthetic peptide"
KLMGQIHQI

SEQ ID NO: 14304 - protein, 10 aa, Artificial Sequence
  source: /note="Description of Artificial Sequence: Synthetic peptide"
KLMGQIHQIR

SEQ ID NO: 14305 - protein, 10 aa, Artificial Sequence
  source: /note="Description of Artificial Sequence: Synthetic peptide"
HQIRSELQDM

SEQ ID NO: 14306 - protein, 10 aa, Artificial Sequence
  source: /note="Description of Artificial Sequence: Synthetic peptide"
QKLMGQIHQI

SEQ ID NO: 14307 - protein, 10 aa, Artificial Sequence
  source: /note="Description of Artificial Sequence: Synthetic peptide"
GQIHQIRSEL

SEQ ID NO: 14308 - protein, 9 aa, Artificial Sequence
  source: /note="Description of Artificial Sequence: Synthetic peptide"
RIIGMWTQL

SEQ ID NO: 14309 - protein, 9 aa, Artificial Sequence
  source: /note="Description of Artificial Sequence: Synthetic peptide"
IIGMWTQLV

SEQ ID NO: 14310 - protein, 9 aa, Artificial Sequence
  source: /note="Description of Artificial Sequence: Synthetic peptide"
WTQLVSNLK

SEQ ID NO: 14311 - protein, 9 aa, Artificial Sequence
  source: /note="Description of Artificial Sequence: Synthetic peptide"
MWTQLVSNL

SEQ ID NO: 14312 - protein, 9 aa, Artificial Sequence
  source: /note="Description of Artificial Sequence: Synthetic peptide"
MADRIIGMW

SEQ ID NO: 14313 - protein, 10 aa, Artificial Sequence
  source: /note="Description of Artificial Sequence: Synthetic peptide"
RIIGMWTQLV

SEQ ID NO: 14314 - protein, 10 aa, Artificial Sequence
  source: /note="Description of Artificial Sequence: Synthetic peptide"
GMWTQLVSNL

SEQ ID NO: 14315 - protein, 10 aa, Artificial Sequence
  source: /note="Description of Artificial Sequence: Synthetic peptide"
MWTQLVSNLK

SEQ ID NO: 14316 - protein, 10 aa, Artificial Sequence
  source: /note="Description of Artificial Sequence: Synthetic peptide"
WTQLVSNLKK

SEQ ID NO: 14317 - protein, 10 aa, Artificial Sequence
  source: /note="Description of Artificial Sequence: Synthetic peptide"
VMADRIIGMW

SEQ ID NO: 14318 - protein, 9 aa, Artificial Sequence
  source: /note="Description of Artificial Sequence: Synthetic peptide"
NPIEASLYG

SEQ ID NO: 14319 - protein, 10 aa, Artificial Sequence
  source: /note="Description of Artificial Sequence: Synthetic peptide"
YGNPIEASLY

SEQ ID NO: 14320 - protein, 10 aa, Artificial Sequence
  source: /note="Description of Artificial Sequence: Synthetic peptide"
NPIEASLYGL

SEQ ID NO: 14321 - protein, 10 aa, Artificial Sequence
  source: /note="Description of Artificial Sequence: Synthetic peptide"
IEASLYGLDL

SEQ ID NO: 14322 - protein, 9 aa, Artificial Sequence
  source: /note="Description of Artificial Sequence: Synthetic peptide"
EAERGGRSY

SEQ ID NO: 14323 - protein, 10 aa, Artificial Sequence
  source: /note="Description of Artificial Sequence: Synthetic peptide"
KEAERGGRSY

SEQ ID NO: 14324 - protein, 10 aa, Artificial Sequence
  source: /note="Description of Artificial Sequence: Synthetic peptide"
AERGGRSYSI

SEQ ID NO: 14325 - protein, 9 aa, Artificial Sequence
  source: /note="Description of Artificial Sequence: Synthetic peptide"
MQMRSTQNM

SEQ ID NO: 14326 - protein, 9 aa, Artificial Sequence
  source: /note="Description of Artificial Sequence: Synthetic peptide"
QMRSTQNML

SEQ ID NO: 14327 - protein, 9 aa, Artificial Sequence
  source: /note="Description of Artificial Sequence: Synthetic peptide"
MLSRTSEKA

SEQ ID NO: 14328 - protein, 9 aa, Artificial Sequence
  source: /note="Description of Artificial Sequence: Synthetic peptide"
NMLSRTSEK

SEQ ID NO: 14329 - protein, 9 aa, Artificial Sequence
  source: /note="Description of Artificial Sequence: Synthetic peptide"
QMKERVQLK

SEQ ID NO: 14330 - protein, 9 aa, Artificial Sequence
  source: /note="Description of Artificial Sequence: Synthetic peptide"
RSTQNMLSR

SEQ ID NO: 14331 - protein, 9 aa, Artificial Sequence
  source: /note="Description of Artificial Sequence: Synthetic peptide"
RVQLKGMRR

SEQ ID NO: 14332 - protein, 9 aa, Artificial Sequence
  source: /note="Description of Artificial Sequence: Synthetic peptide"
KRKRKGGRK

SEQ ID NO: 14333 - protein, 9 aa, Artificial Sequence
  source: /note="Description of Artificial Sequence: Synthetic peptide"
KGGRKRRKK

SEQ ID NO: 14334 - protein, 9 aa, Artificial Sequence
  source: /note="Description of Artificial Sequence: Synthetic peptide"
RRKKLQHLK

SEQ ID NO: 14335 - protein, 9 aa, Artificial Sequence
  source: /note="Description of Artificial Sequence: Synthetic peptide"
LSRTSEKAR

SEQ ID NO: 14336 - protein, 9 aa, Artificial Sequence
  source: /note="Description of Artificial Sequence: Synthetic peptide"
RTSEKARRR

SEQ ID NO: 14337 - protein, 9 aa, Artificial Sequence
  source: /note="Description of Artificial Sequence: Synthetic peptide"
KARRRKGDI

SEQ ID NO: 14338 - protein, 9 aa, Artificial Sequence
  source: /note="Description of Artificial Sequence: Synthetic peptide"
RRRKGDIKK

SEQ ID NO: 14339 - protein, 9 aa, Artificial Sequence
  source: /note="Description of Artificial Sequence: Synthetic peptide"
KGMRRRTLQ

SEQ ID NO: 14340 - protein, 9 aa, Artificial Sequence
  source: /note="Description of Artificial Sequence: Synthetic peptide"
GMRRRTLQE

SEQ ID NO: 14341 - protein, 9 aa, Artificial Sequence
  source: /note="Description of Artificial Sequence: Synthetic peptide"
HLKGMMQMR

SEQ ID NO: 14342 - protein, 9 aa, Artificial Sequence
  source: /note="Description of Artificial Sequence: Synthetic peptide"
LKGMRRRTL

SEQ ID NO: 14343 - protein, 9 aa, Artificial Sequence
  source: /note="Description of Artificial Sequence: Synthetic peptide"
KKLQHLKGM

SEQ ID NO: 14344 - protein, 9 aa, Artificial Sequence
  source: /note="Description of Artificial Sequence: Synthetic peptide"
QHLKGMMQM

SEQ ID NO: 14345 - protein, 9 aa, Artificial Sequence
  source: /note="Description of Artificial Sequence: Synthetic peptide"
GMMQMRSTQ

SEQ ID NO: 14346 - protein, 9 aa, Artificial Sequence
  source: /note="Description of Artificial Sequence: Synthetic peptide"
SQMKERVQL

SEQ ID NO: 14347 - protein, 9 aa, Artificial Sequence
  source: /note="Description of Artificial Sequence: Synthetic peptide"
KERVQLKGM

SEQ ID NO: 14348 - protein, 9 aa, Artificial Sequence
  source: /note="Description of Artificial Sequence: Synthetic peptide"
RTLQEQVGL

SEQ ID NO: 14349 - protein, 10 aa, Artificial Sequence
  source: /note="Description of Artificial Sequence: Synthetic peptide"
MQMRSTQNML

SEQ ID NO: 14350 - protein, 10 aa, Artificial Sequence
  source: /note="Description of Artificial Sequence: Synthetic peptide"
MMQMRSTQNM

SEQ ID NO: 14351 - protein, 10 aa, Artificial Sequence
  source: /note="Description of Artificial Sequence: Synthetic peptide"
SQMKERVQLK

SEQ ID NO: 14352 - protein, 10 aa, Artificial Sequence
  source: /note="Description of Artificial Sequence: Synthetic peptide"
RTSEKARRRK

SEQ ID NO: 14353 - protein, 10 aa, Artificial Sequence
  source: /note="Description of Artificial Sequence: Synthetic peptide"
KKRKRKGGRK

SEQ ID NO: 14354 - protein, 10 aa, Artificial Sequence
  source: /note="Description of Artificial Sequence: Synthetic peptide"
KRKGGRKRRK

SEQ ID NO: 14355 - protein, 10 aa, Artificial Sequence
  source: /note="Description of Artificial Sequence: Synthetic peptide"
KRRKKLQHLK

SEQ ID NO: 14356 - protein, 10 aa, Artificial Sequence
  source: /note="Description of Artificial Sequence: Synthetic peptide"
QMRSTQNMLS

SEQ ID NO: 14357 - protein, 10 aa, Artificial Sequence
  source: /note="Description of Artificial Sequence: Synthetic peptide"
QNMLSRTSEK

SEQ ID NO: 14358 - protein, 10 aa, Artificial Sequence
  source: /note="Description of Artificial Sequence: Synthetic peptide"
LSRTSEKARR

SEQ ID NO: 14359 - protein, 10 aa, Artificial Sequence
  source: /note="Description of Artificial Sequence: Synthetic peptide"
KARRRKGDIK

SEQ ID NO: 14360 - protein, 10 aa, Artificial Sequence
  source: /note="Description of Artificial Sequence: Synthetic peptide"
RSQMKERVQL

SEQ ID NO: 14361 - protein, 10 aa, Artificial Sequence
  source: /note="Description of Artificial Sequence: Synthetic peptide"
RVQLKGMRRR

SEQ ID NO: 14362 - protein, 10 aa, Artificial Sequence
  source: /note="Description of Artificial Sequence: Synthetic peptide"
MLSRTSEKAR

SEQ ID NO: 14363 - protein, 10 aa, Artificial Sequence
  source: /note="Description of Artificial Sequence: Synthetic peptide"
QLKGMRRRTL

SEQ ID NO: 14364 - protein, 10 aa, Artificial Sequence
  source: /note="Description of Artificial Sequence: Synthetic peptide"
LQHLKGMMQM

SEQ ID NO: 14365 - protein, 10 aa, Artificial Sequence
  source: /note="Description of Artificial Sequence: Synthetic peptide"
RKRRKKLQHL

SEQ ID NO: 14366 - protein, 10 aa, Artificial Sequence
  source: /note="Description of Artificial Sequence: Synthetic peptide"
RKKLQHLKGM

SEQ ID NO: 14367 - protein, 10 aa, Artificial Sequence
  source: /note="Description of Artificial Sequence: Synthetic peptide"
KKLQHLKGMM

SEQ ID NO: 14368 - protein, 10 aa, Artificial Sequence
  source: /note="Description of Artificial Sequence: Synthetic peptide"
MKERVQLKGM

SEQ ID NO: 14369 - protein, 10 aa, Artificial Sequence
  source: /note="Description of Artificial Sequence: Synthetic peptide"
KERSQMKERV

SEQ ID NO: 14370 - protein, 9 aa, Artificial Sequence
  source: /note="Description of Artificial Sequence: Synthetic peptide"
EQVNRICGL

SEQ ID NO: 14371 - protein, 10 aa, Artificial Sequence
  source: /note="Description of Artificial Sequence: Synthetic peptide"
QVNRICGLPV

SEQ ID NO: 14372 - protein, 10 aa, Artificial Sequence
  source: /note="Description of Artificial Sequence: Synthetic peptide"
VNRICGLPVR

SEQ ID NO: 14373 - protein, 10 aa, Artificial Sequence
  source: /note="Description of Artificial Sequence: Synthetic peptide"
LEQVNRICGL

SEQ ID NO: 14374 - protein, 9 aa, Artificial Sequence
  source: /note="Description of Artificial Sequence: Synthetic peptide"
VTRTFIAAR

SEQ ID NO: 14375 - protein, 9 aa, Artificial Sequence
  source: /note="Description of Artificial Sequence: Synthetic peptide"
RTFIAARTF

SEQ ID NO: 14376 - protein, 9 aa, Artificial Sequence
  source: /note="Description of Artificial Sequence: Synthetic peptide"
KIQVTRTFI

SEQ ID NO: 14377 - protein, 9 aa, Artificial Sequence
  source: /note="Description of Artificial Sequence: Synthetic peptide"
QVTRTFIAA

SEQ ID NO: 14378 - protein, 9 aa, Artificial Sequence
  source: /note="Description of Artificial Sequence: Synthetic peptide"
TFIAARTFV

SEQ ID NO: 14379 - protein, 9 aa, Artificial Sequence
  source: /note="Description of Artificial Sequence: Synthetic peptide"
LKIQVTRTF

SEQ ID NO: 14380 - protein, 9 aa, Artificial Sequence
  source: /note="Description of Artificial Sequence: Synthetic peptide"
IQVTRTFIA

SEQ ID NO: 14381 - protein, 10 aa, Artificial Sequence
  source: /note="Description of Artificial Sequence: Synthetic peptide"
RTFIAARTFV

SEQ ID NO: 14382 - protein, 10 aa, Artificial Sequence
  source: /note="Description of Artificial Sequence: Synthetic peptide"
KLKIQVTRTF

SEQ ID NO: 14383 - protein, 10 aa, Artificial Sequence
  source: /note="Description of Artificial Sequence: Synthetic peptide"
KIQVTRTFIA

SEQ ID NO: 14384 - protein, 10 aa, Artificial Sequence
  source: /note="Description of Artificial Sequence: Synthetic peptide"
VTRTFIAART

SEQ ID NO: 14385 - protein, 10 aa, Artificial Sequence
  source: /note="Description of Artificial Sequence: Synthetic peptide"
QVTRTFIAAR

SEQ ID NO: 14386 - protein, 10 aa, Artificial Sequence
  source: /note="Description of Artificial Sequence: Synthetic peptide"
LKIQVTRTFI

SEQ ID NO: 14387 - protein, 10 aa, Artificial Sequence
  source: /note="Description of Artificial Sequence: Synthetic peptide"
IQVTRTFIAA

SEQ ID NO: 14388 - protein, 10 aa, Artificial Sequence
  source: /note="Description of Artificial Sequence: Synthetic peptide"
TRTFIAARTF

SEQ ID NO: 14389 - protein, 9 aa, Artificial Sequence
  source: /note="Description of Artificial Sequence: Synthetic peptide"
SQFGGVLHL

SEQ ID NO: 14390 - protein, 9 aa, Artificial Sequence
  source: /note="Description of Artificial Sequence: Synthetic peptide"
SGDRRFSQF

SEQ ID NO: 14391 - protein, 9 aa, Artificial Sequence
  source: /note="Description of Artificial Sequence: Synthetic peptide"
RRFSQFGGV

SEQ ID NO: 14392 - protein, 9 aa, Artificial Sequence
  source: /note="Description of Artificial Sequence: Synthetic peptide"
RFSQFGGVL

SEQ ID NO: 14393 - protein, 10 aa, Artificial Sequence
  source: /note="Description of Artificial Sequence: Synthetic peptide"
FSGDRRFSQF

SEQ ID NO: 14394 - protein, 10 aa, Artificial Sequence
  source: /note="Description of Artificial Sequence: Synthetic peptide"
RRFSQFGGVL

SEQ ID NO: 14395 - protein, 10 aa, Artificial Sequence
  source: /note="Description of Artificial Sequence: Synthetic peptide"
FSQFGGVLHL

SEQ ID NO: 14396 - protein, 10 aa, Artificial Sequence
  source: /note="Description of Artificial Sequence: Synthetic peptide"
SQFGGVLHLS

SEQ ID NO: 14397 - protein, 9 aa, Artificial Sequence
  source: /note="Description of Artificial Sequence: Synthetic peptide"
VLSGTVNIL

SEQ ID NO: 14398 - protein, 9 aa, Artificial Sequence
  source: /note="Description of Artificial Sequence: Synthetic peptide"
EVLSGTVNI

SEQ ID NO: 14399 - protein, 10 aa, Artificial Sequence
  source: /note="Description of Artificial Sequence: Synthetic peptide"
ALFCGCGHEV

SEQ ID NO: 14400 - protein, 10 aa, Artificial Sequence
  source: /note="Description of Artificial Sequence: Synthetic peptide"
EVLSGTVNIL

SEQ ID NO: 14401 - protein, 10 aa, Artificial Sequence
  source: /note="Description of Artificial Sequence: Synthetic peptide"
HEVLSGTVNI

SEQ ID NO: 14402 - protein, 9 aa, Artificial Sequence
  source: /note="Description of Artificial Sequence: Synthetic peptide"
FMYVFHTLG

SEQ ID NO: 14403 - protein, 9 aa, Artificial Sequence
  source: /note="Description of Artificial Sequence: Synthetic peptide"
RRWNFMYVF

SEQ ID NO: 14404 - protein, 9 aa, Artificial Sequence
  source: /note="Description of Artificial Sequence: Synthetic peptide"
NFMYVFHTL

SEQ ID NO: 14405 - protein, 9 aa, Artificial Sequence
  source: /note="Description of Artificial Sequence: Synthetic peptide"
GWRRWNFMY

SEQ ID NO: 14406 - protein, 9 aa, Artificial Sequence
  source: /note="Description of Artificial Sequence: Synthetic peptide"
RWNFMYVFH

SEQ ID NO: 14407 - protein, 10 aa, Artificial Sequence
  source: /note="Description of Artificial Sequence: Synthetic peptide"
MYVFHTLGQY

SEQ ID NO: 14408 - protein, 10 aa, Artificial Sequence
  source: /note="Description of Artificial Sequence: Synthetic peptide"
GWRRWNFMYV

SEQ ID NO: 14409 - protein, 10 aa, Artificial Sequence
  source: /note="Description of Artificial Sequence: Synthetic peptide"
RWNFMYVFHT

SEQ ID NO: 14410 - protein, 10 aa, Artificial Sequence
  source: /note="Description of Artificial Sequence: Synthetic peptide"
HPGWRRWNFM

SEQ ID NO: 14411 - protein, 10 aa, Artificial Sequence
  source: /note="Description of Artificial Sequence: Synthetic peptide"
WNFMYVFHTL

SEQ ID NO: 14412 - protein, 10 aa, Artificial Sequence
  source: /note="Description of Artificial Sequence: Synthetic peptide"
WRRWNFMYVF

SEQ ID NO: 14413 - protein, 10 aa, Artificial Sequence
  source: /note="Description of Artificial Sequence: Synthetic peptide"
FMYVFHTLGQ

SEQ ID NO: 14414 - protein, 9 aa, Artificial Sequence
  source: /note="Description of Artificial Sequence: Synthetic peptide"
LLFPGISAP

SEQ ID NO: 14415 - protein, 9 aa, Artificial Sequence
  source: /note="Description of Artificial Sequence: Synthetic peptide"
MECLLFPGI

SEQ ID NO: 14416 - protein, 10 aa, Artificial Sequence
  source: /note="Description of Artificial Sequence: Synthetic peptide"
LLFPGISAPG

SEQ ID NO: 14417 - protein, 10 aa, Artificial Sequence
  source: /note="Description of Artificial Sequence: Synthetic peptide"
MECLLFPGIS

SEQ ID NO: 14418 - protein, 9 aa, Artificial Sequence
  source: /note="Description of Artificial Sequence: Synthetic peptide"
KGGYSYQIK

SEQ ID NO: 14419 - protein, 9 aa, Artificial Sequence
  source: /note="Description of Artificial Sequence: Synthetic peptide"
SQLKGGYSY

SEQ ID NO: 14420 - protein, 9 aa, Artificial Sequence
  source: /note="Description of Artificial Sequence: Synthetic peptide"
LKGGYSYQI

SEQ ID NO: 14421 - protein, 9 aa, Artificial Sequence
  source: /note="Description of Artificial Sequence: Synthetic peptide"
GGYSYQIKM

SEQ ID NO: 14422 - protein, 10 aa, Artificial Sequence
  source: /note="Description of Artificial Sequence: Synthetic peptide"
QLKGGYSYQI

SEQ ID NO: 14423 - protein, 10 aa, Artificial Sequence
  source: /note="Description of Artificial Sequence: Synthetic peptide"
VNKSQLKGGY

SEQ ID NO: 14424 - protein, 10 aa, Artificial Sequence
  source: /note="Description of Artificial Sequence: Synthetic peptide"
KSQLKGGYSY

SEQ ID NO: 14425 - protein, 10 aa, Artificial Sequence
  source: /note="Description of Artificial Sequence: Synthetic peptide"
SQLKGGYSYQ

SEQ ID NO: 14426 - protein, 10 aa, Artificial Sequence
  source: /note="Description of Artificial Sequence: Synthetic peptide"
KGGYSYQIKM

SEQ ID NO: 14427 - protein, 9 aa, Artificial Sequence
  source: /note="Description of Artificial Sequence: Synthetic peptide"
KNYFISYSR

SEQ ID NO: 14428 - protein, 9 aa, Artificial Sequence
  source: /note="Description of Artificial Sequence: Synthetic peptide"
MSPSKNYFI

SEQ ID NO: 14429 - protein, 9 aa, Artificial Sequence
  source: /note="Description of Artificial Sequence: Synthetic peptide"
PSKNYFISY

SEQ ID NO: 14430 - protein, 9 aa, Artificial Sequence
  source: /note="Description of Artificial Sequence: Synthetic peptide"
EMSPSKNYF

SEQ ID NO: 14431 - protein, 9 aa, Artificial Sequence
  source: /note="Description of Artificial Sequence: Synthetic peptide"
TEMSPSKNY

SEQ ID NO: 14432 - protein, 10 aa, Artificial Sequence
  source: /note="Description of Artificial Sequence: Synthetic peptide"
VTEMSPSKNY

SEQ ID NO: 14433 - protein, 10 aa, Artificial Sequence
  source: /note="Description of Artificial Sequence: Synthetic peptide"
EMSPSKNYFI

SEQ ID NO: 14434 - protein, 10 aa, Artificial Sequence
  source: /note="Description of Artificial Sequence: Synthetic peptide"
SPSKNYFISY

SEQ ID NO: 14435 - protein, 10 aa, Artificial Sequence
  source: /note="Description of Artificial Sequence: Synthetic peptide"
TEMSPSKNYF

SEQ ID NO: 14436 - protein, 10 aa, Artificial Sequence
  source: /note="Description of Artificial Sequence: Synthetic peptide"
DLAPDTSPCR

SEQ ID NO: 14437 - protein, 9 aa, Artificial Sequence
  source: /note="Description of Artificial Sequence: Synthetic peptide"
LQNNLISSI

SEQ ID NO: 14438 - protein, 10 aa, Artificial Sequence
  source: /note="Description of Artificial Sequence: Synthetic peptide"
LERLDLQNNL

SEQ ID NO: 14439 - protein, 9 aa, Artificial Sequence
  source: /note="Description of Artificial Sequence: Synthetic peptide"
QVTAICVTV

SEQ ID NO: 14440 - protein, 9 aa, Artificial Sequence
  source: /note="Description of Artificial Sequence: Synthetic peptide"
ICVTVILLY

SEQ ID NO: 14441 - protein, 9 aa, Artificial Sequence
  source: /note="Description of Artificial Sequence: Synthetic peptide"
TAICVTVIL

SEQ ID NO: 14442 - protein, 9 aa, Artificial Sequence
  source: /note="Description of Artificial Sequence: Synthetic peptide"
CQVTAICVT

SEQ ID NO: 14443 - protein, 10 aa, Artificial Sequence
  source: /note="Description of Artificial Sequence: Synthetic peptide"
CQVTAICVTV

SEQ ID NO: 14444 - protein, 10 aa, Artificial Sequence
  source: /note="Description of Artificial Sequence: Synthetic peptide"
AICVTVILLY

SEQ ID NO: 14445 - protein, 10 aa, Artificial Sequence
  source: /note="Description of Artificial Sequence: Synthetic peptide"
SVCQVTAICV

SEQ ID NO: 14446 - protein, 10 aa, Artificial Sequence
  source: /note="Description of Artificial Sequence: Synthetic peptide"
QVTAICVTVI

SEQ ID NO: 14447 - protein, 10 aa, Artificial Sequence
  source: /note="Description of Artificial Sequence: Synthetic peptide"
TAICVTVILL

SEQ ID NO: 14448 - protein, 9 aa, Artificial Sequence
  source: /note="Description of Artificial Sequence: Synthetic peptide"
SSSDELFCR

SEQ ID NO: 14449 - protein, 9 aa, Artificial Sequence
  source: /note="Description of Artificial Sequence: Synthetic peptide"
LFCRCHRPY

SEQ ID NO: 14450 - protein, 9 aa, Artificial Sequence
  source: /note="Description of Artificial Sequence: Synthetic peptide"
TESSSSDEL

SEQ ID NO: 14451 - protein, 10 aa, Artificial Sequence
  source: /note="Description of Artificial Sequence: Synthetic peptide"
SSSSDELFCR

SEQ ID NO: 14452 - protein, 10 aa, Artificial Sequence
  source: /note="Description of Artificial Sequence: Synthetic peptide"
ELFCRCHRPY

SEQ ID NO: 14453 - protein, 10 aa, Artificial Sequence
  source: /note="Description of Artificial Sequence: Synthetic peptide"
TESSSSDELF

SEQ ID NO: 14454 - protein, 9 aa, Artificial Sequence
  source: /note="Description of Artificial Sequence: Synthetic peptide"
KTSNHLIFN

SEQ ID NO: 14455 - protein, 9 aa, Artificial Sequence
  source: /note="Description of Artificial Sequence: Synthetic peptide"
TSNHLIFNM

SEQ ID NO: 14456 - protein, 9 aa, Artificial Sequence
  source: /note="Description of Artificial Sequence: Synthetic peptide"
GQGKTSNHL

SEQ ID NO: 14457 - protein, 9 aa, Artificial Sequence
  source: /note="Description of Artificial Sequence: Synthetic peptide"
GKTSNHLIF

SEQ ID NO: 14458 - protein, 10 aa, Artificial Sequence
  source: /note="Description of Artificial Sequence: Synthetic peptide"
KTSNHLIFNM

SEQ ID NO: 14459 - protein, 10 aa, Artificial Sequence
  source: /note="Description of Artificial Sequence: Synthetic peptide"
GQGKTSNHLI

SEQ ID NO: 14460 - protein, 10 aa, Artificial Sequence
  source: /note="Description of Artificial Sequence: Synthetic peptide"
QGKTSNHLIF

SEQ ID NO: 14461 - protein, 9 aa, Artificial Sequence
  source: /note="Description of Artificial Sequence: Synthetic peptide"
RITEITETV

SEQ ID NO: 14462 - protein, 10 aa, Artificial Sequence
  source: /note="Description of Artificial Sequence: Synthetic peptide"
RRITEITETV

SEQ ID NO: 14463 - protein, 9 aa, Artificial Sequence
  source: /note="Description of Artificial Sequence: Synthetic peptide"
TARTVPGAA

SEQ ID NO: 14464 - protein, 9 aa, Artificial Sequence
  source: /note="Description of Artificial Sequence: Synthetic peptide"
VTARTVPGA

SEQ ID NO: 14465 - protein, 9 aa, Artificial Sequence
  source: /note="Description of Artificial Sequence: Synthetic peptide"
TVPGAASGA

SEQ ID NO: 14466 - protein, 9 aa, Artificial Sequence
  source: /note="Description of Artificial Sequence: Synthetic peptide"
VPGAASGAA

SEQ ID NO: 14467 - protein, 10 aa, Artificial Sequence
  source: /note="Description of Artificial Sequence: Synthetic peptide"
LVTARTVPGA

SEQ ID NO: 14468 - protein, 10 aa, Artificial Sequence
  source: /note="Description of Artificial Sequence: Synthetic peptide"
RTVPGAASGA

SEQ ID NO: 14469 - protein, 10 aa, Artificial Sequence
  source: /note="Description of Artificial Sequence: Synthetic peptide"
VTARTVPGAA

SEQ ID NO: 14470 - protein, 10 aa, Artificial Sequence
  source: /note="Description of Artificial Sequence: Synthetic peptide"
TVPGAASGAA

SEQ ID NO: 14471 - protein, 9 aa, Artificial Sequence
  source: /note="Description of Artificial Sequence: Synthetic peptide"
FTYFNIFHI

SEQ ID NO: 14472 - protein, 9 aa, Artificial Sequence
  source: /note="Description of Artificial Sequence: Synthetic peptide"
TYFNIFHIC

SEQ ID NO: 14473 - protein, 10 aa, Artificial Sequence
  source: /note="Description of Artificial Sequence: Synthetic peptide"
CFTYFNIFHI

SEQ ID NO: 14474 - protein, 10 aa, Artificial Sequence
  source: /note="Description of Artificial Sequence: Synthetic peptide"
IFHICQQHTK

SEQ ID NO: 14475 - protein, 10 aa, Artificial Sequence
  source: /note="Description of Artificial Sequence: Synthetic peptide"
FTYFNIFHIC

SEQ ID NO: 14476 - protein, 9 aa, Artificial Sequence
  source: /note="Description of Artificial Sequence: Synthetic peptide"
VAAEGAAAL

SEQ ID NO: 14477 - protein, 9 aa, Artificial Sequence
  source: /note="Description of Artificial Sequence: Synthetic peptide"
AEGAAALGA

SEQ ID NO: 14478 - protein, 10 aa, Artificial Sequence
  source: /note="Description of Artificial Sequence: Synthetic peptide"
VVAAEGAAAL

SEQ ID NO: 14479 - protein, 10 aa, Artificial Sequence
  source: /note="Description of Artificial Sequence: Synthetic peptide"
AEGAAALGAG

SEQ ID NO: 14480 - protein, 9 aa, Artificial Sequence
  source: /note="Description of Artificial Sequence: Synthetic peptide"
ASIIIWGDK

SEQ ID NO: 14481 - protein, 9 aa, Artificial Sequence
  source: /note="Description of Artificial Sequence: Synthetic peptide"
SIIIWGDKR

SEQ ID NO: 14482 - protein, 9 aa, Artificial Sequence
  source: /note="Description of Artificial Sequence: Synthetic peptide"
KGSASIIIW

SEQ ID NO: 14483 - protein, 10 aa, Artificial Sequence
  source: /note="Description of Artificial Sequence: Synthetic peptide"
SASIIIWGDK

SEQ ID NO: 14484 - protein, 10 aa, Artificial Sequence
  source: /note="Description of Artificial Sequence: Synthetic peptide"
VKGSASIIIW

SEQ ID NO: 14485 - protein, 9 aa, Artificial Sequence
  source: /note="Description of Artificial Sequence: Synthetic peptide"
WTAEAGLDF

SEQ ID NO: 14486 - protein, 9 aa, Artificial Sequence
  source: /note="Description of Artificial Sequence: Synthetic peptide"
KTMSWTAEA

SEQ ID NO: 14487 - protein, 9 aa, Artificial Sequence
  source: /note="Description of Artificial Sequence: Synthetic peptide"
RLWYKTMSW

SEQ ID NO: 14488 - protein, 9 aa, Artificial Sequence
  source: /note="Description of Artificial Sequence: Synthetic peptide"
WYKTMSWTA

SEQ ID NO: 14489 - protein, 9 aa, Artificial Sequence
  source: /note="Description of Artificial Sequence: Synthetic peptide"
MSWTAEAGL

SEQ ID NO: 14490 - protein, 10 aa, Artificial Sequence
  source: /note="Description of Artificial Sequence: Synthetic peptide"
TMSWTAEAGL

SEQ ID NO: 14491 - protein, 10 aa, Artificial Sequence
  source: /note="Description of Artificial Sequence: Synthetic peptide"
WTAEAGLDFV

SEQ ID NO: 14492 - protein, 10 aa, Artificial Sequence
  source: /note="Description of Artificial Sequence: Synthetic peptide"
RLWYKTMSWT

SEQ ID NO: 14493 - protein, 10 aa, Artificial Sequence
  source: /note="Description of Artificial Sequence: Synthetic peptide"
SWTAEAGLDF

SEQ ID NO: 14494 - protein, 10 aa, Artificial Sequence
  source: /note="Description of Artificial Sequence: Synthetic peptide"
VRLWYKTMSW

SEQ ID NO: 14495 - protein, 10 aa, Artificial Sequence
  source: /note="Description of Artificial Sequence: Synthetic peptide"
LWYKTMSWTA

SEQ ID NO: 14496 - protein, 10 aa, Artificial Sequence
  source: /note="Description of Artificial Sequence: Synthetic peptide"
YKTMSWTAEA

SEQ ID NO: 14497 - protein, 9 aa, Artificial Sequence
  source: /note="Description of Artificial Sequence: Synthetic peptide"
YVFMVFFIL

SEQ ID NO: 14498 - protein, 9 aa, Artificial Sequence
  source: /note="Description of Artificial Sequence: Synthetic peptide"
QGLYVFMVF

SEQ ID NO: 14499 - protein, 9 aa, Artificial Sequence
  source: /note="Description of Artificial Sequence: Synthetic peptide"
LYVFMVFFI

SEQ ID NO: 14500 - protein, 9 aa, Artificial Sequence
  source: /note="Description of Artificial Sequence: Synthetic peptide"
VFFILHNQM

SEQ ID NO: 14501 - protein, 9 aa, Artificial Sequence
  source: /note="Description of Artificial Sequence: Synthetic peptide"
GLYVFMVFF

SEQ ID NO: 14502 - protein, 10 aa, Artificial Sequence
  source: /note="Description of Artificial Sequence: Synthetic peptide"
GLYVFMVFFI

SEQ ID NO: 14503 - protein, 10 aa, Artificial Sequence
  source: /note="Description of Artificial Sequence: Synthetic peptide"
LQGLYVFMVF

SEQ ID NO: 14504 - protein, 10 aa, Artificial Sequence
  source: /note="Description of Artificial Sequence: Synthetic peptide"
QGLYVFMVFF

SEQ ID NO: 14505 - protein, 10 aa, Artificial Sequence
  source: /note="Description of Artificial Sequence: Synthetic peptide"
LYVFMVFFIL

SEQ ID NO: 14506 - protein, 10 aa, Artificial Sequence
  source: /note="Description of Artificial Sequence: Synthetic peptide"
MVFFILHNQM

SEQ ID NO: 14507 - protein, 9 aa, Artificial Sequence
  source: /note="Description of Artificial Sequence: Synthetic peptide"
IVNLWFWSR

SEQ ID NO: 14508 - protein, 9 aa, Artificial Sequence
  source: /note="Description of Artificial Sequence: Synthetic peptide"
VNLWFWSRK

SEQ ID NO: 14509 - protein, 9 aa, Artificial Sequence
  source: /note="Description of Artificial Sequence: Synthetic peptide"
NLWFWSRKY

SEQ ID NO: 14510 - protein, 9 aa, Artificial Sequence
  source: /note="Description of Artificial Sequence: Synthetic peptide"
EEEDIVNLW

SEQ ID NO: 14511 - protein, 9 aa, Artificial Sequence
  source: /note="Description of Artificial Sequence: Synthetic peptide"
EEDIVNLWF

SEQ ID NO: 14512 - protein, 9 aa, Artificial Sequence
  source: /note="Description of Artificial Sequence: Synthetic peptide"
EEEEDIVNL

SEQ ID NO: 14513 - protein, 10 aa, Artificial Sequence
  source: /note="Description of Artificial Sequence: Synthetic peptide"
IVNLWFWSRK

SEQ ID NO: 14514 - protein, 10 aa, Artificial Sequence
  source: /note="Description of Artificial Sequence: Synthetic peptide"
LWFWSRKYTK

SEQ ID NO: 14515 - protein, 10 aa, Artificial Sequence
  source: /note="Description of Artificial Sequence: Synthetic peptide"
VNLWFWSRKY

SEQ ID NO: 14516 - protein, 10 aa, Artificial Sequence
  source: /note="Description of Artificial Sequence: Synthetic peptide"
DIVNLWFWSR

SEQ ID NO: 14517 - protein, 10 aa, Artificial Sequence
  source: /note="Description of Artificial Sequence: Synthetic peptide"
EEEDIVNLWF

SEQ ID NO: 14518 - protein, 10 aa, Artificial Sequence
  source: /note="Description of Artificial Sequence: Synthetic peptide"
EEDIVNLWFW

SEQ ID NO: 14519 - protein, 9 aa, Artificial Sequence
  source: /note="Description of Artificial Sequence: Synthetic peptide"
IILETVATA

SEQ ID NO: 14520 - protein, 9 aa, Artificial Sequence
  source: /note="Description of Artificial Sequence: Synthetic peptide"
AWGIILETV

SEQ ID NO: 14521 - protein, 9 aa, Artificial Sequence
  source: /note="Description of Artificial Sequence: Synthetic peptide"
EAWGIILET

SEQ ID NO: 14522 - protein, 9 aa, Artificial Sequence
  source: /note="Description of Artificial Sequence: Synthetic peptide"
KAEAWGIIL

SEQ ID NO: 14523 - protein, 9 aa, Artificial Sequence
  source: /note="Description of Artificial Sequence: Synthetic peptide"
AEAWGIILE

SEQ ID NO: 14524 - protein, 10 aa, Artificial Sequence
  source: /note="Description of Artificial Sequence: Synthetic peptide"
ILETVATAGV

SEQ ID NO: 14525 - protein, 10 aa, Artificial Sequence
  source: /note="Description of Artificial Sequence: Synthetic peptide"
GIILETVATA

SEQ ID NO: 14526 - protein, 10 aa, Artificial Sequence
  source: /note="Description of Artificial Sequence: Synthetic peptide"
EAWGIILETV

SEQ ID NO: 14527 - protein, 10 aa, Artificial Sequence
  source: /note="Description of Artificial Sequence: Synthetic peptide"
AEAWGIILET

SEQ ID NO: 14528 - protein, 10 aa, Artificial Sequence
  source: /note="Description of Artificial Sequence: Synthetic peptide"
TVSPRKVDPV

SEQ ID NO: 14529 - protein, 10 aa, Artificial Sequence
  source: /note="Description of Artificial Sequence: Synthetic peptide"
KTYTVSPRKV

SEQ ID NO: 14530 - protein, 9 aa, Artificial Sequence
  source: /note="Description of Artificial Sequence: Synthetic peptide"
MQSLRHPSC

SEQ ID NO: 14531 - protein, 9 aa, Artificial Sequence
  source: /note="Description of Artificial Sequence: Synthetic peptide"
STVGNVSPM

SEQ ID NO: 14532 - protein, 10 aa, Artificial Sequence
  source: /note="Description of Artificial Sequence: Synthetic peptide"
SSTVGNVSPM

SEQ ID NO: 14533 - protein, 9 aa, Artificial Sequence
  source: /note="Description of Artificial Sequence: Synthetic peptide"
ALLCGMREM

SEQ ID NO: 14534 - protein, 9 aa, Artificial Sequence
  source: /note="Description of Artificial Sequence: Synthetic peptide"
LLCGMREMR

SEQ ID NO: 14535 - protein, 9 aa, Artificial Sequence
  source: /note="Description of Artificial Sequence: Synthetic peptide"
REMRAGGCC

SEQ ID NO: 14536 - protein, 10 aa, Artificial Sequence
  source: /note="Description of Artificial Sequence: Synthetic peptide"
AALLCGMREM

SEQ ID NO: 14537 - protein, 10 aa, Artificial Sequence
  source: /note="Description of Artificial Sequence: Synthetic peptide"
REMRAGGCCH

SEQ ID NO: 14538 - protein, 10 aa, Artificial Sequence
  source: /note="Description of Artificial Sequence: Synthetic peptide"
MRAGGCCHAL

SEQ ID NO: 14539 - protein, 9 aa, Artificial Sequence
  source: /note="Description of Artificial Sequence: Synthetic peptide"
ASASSSRSK

SEQ ID NO: 14540 - protein, 9 aa, Artificial Sequence
  source: /note="Description of Artificial Sequence: Synthetic peptide"
RSVKASPPG

SEQ ID NO: 14541 - protein, 9 aa, Artificial Sequence
  source: /note="Description of Artificial Sequence: Synthetic peptide"
KASPPGPAA

SEQ ID NO: 14542 - protein, 9 aa, Artificial Sequence
  source: /note="Description of Artificial Sequence: Synthetic peptide"
SPPGPAASA

SEQ ID NO: 14543 - protein, 10 aa, Artificial Sequence
  source: /note="Description of Artificial Sequence: Synthetic peptide"
AASASSSRSK

SEQ ID NO: 14544 - protein, 10 aa, Artificial Sequence
  source: /note="Description of Artificial Sequence: Synthetic peptide"
SVKASPPGPA

SEQ ID NO: 14545 - protein, 10 aa, Artificial Sequence
  source: /note="Description of Artificial Sequence: Synthetic peptide"
VKASPPGPAA

SEQ ID NO: 14546 - protein, 9 aa, Artificial Sequence
  source: /note="Description of Artificial Sequence: Synthetic peptide"
LVRPGCGPR

SEQ ID NO: 14547 - protein, 10 aa, Artificial Sequence
  source: /note="Description of Artificial Sequence: Synthetic peptide"
RPGCGPRTPS

SEQ ID NO: 14548 - protein, 10 aa, Artificial Sequence
  source: /note="Description of Artificial Sequence: Synthetic peptide"
MQRAAALVRP

SEQ ID NO: 14549 - protein, 9 aa, Artificial Sequence
  source: /note="Description of Artificial Sequence: Synthetic peptide"
SLFGKDMKV

SEQ ID NO: 14550 - protein, 9 aa, Artificial Sequence
  source: /note="Description of Artificial Sequence: Synthetic peptide"
ASLFGKDMK

SEQ ID NO: 14551 - protein, 9 aa, Artificial Sequence
  source: /note="Description of Artificial Sequence: Synthetic peptide"
HASLFGKDM

SEQ ID NO: 14552 - protein, 9 aa, Artificial Sequence
  source: /note="Description of Artificial Sequence: Synthetic peptide"
KDMKVVIPV

SEQ ID NO: 14553 - protein, 10 aa, Artificial Sequence
  source: /note="Description of Artificial Sequence: Synthetic peptide"
SLFGKDMKVV

SEQ ID NO: 14554 - protein, 10 aa, Artificial Sequence
  source: /note="Description of Artificial Sequence: Synthetic peptide"
HASLFGKDMK

SEQ ID NO: 14555 - protein, 10 aa, Artificial Sequence
  source: /note="Description of Artificial Sequence: Synthetic peptide"
FHASLFGKDM

SEQ ID NO: 14556 - protein, 10 aa, Artificial Sequence
  source: /note="Description of Artificial Sequence: Synthetic peptide"
KDMKVVIPVV

SEQ ID NO: 14557 - protein, 10 aa, Artificial Sequence
  source: /note="Description of Artificial Sequence: Synthetic peptide"
MKVVIPVVSV

SEQ ID NO: 14558 - protein, 9 aa, Artificial Sequence
  source: /note="Description of Artificial Sequence: Synthetic peptide"
QADNLLMGK

SEQ ID NO: 14559 - protein, 9 aa, Artificial Sequence
  source: /note="Description of Artificial Sequence: Synthetic peptide"
SRHQADNLL

SEQ ID NO: 14560 - protein, 9 aa, Artificial Sequence
  source: /note="Description of Artificial Sequence: Synthetic peptide"
RHQADNLLM

SEQ ID NO: 14561 - protein, 9 aa, Artificial Sequence
  source: /note="Description of Artificial Sequence: Synthetic peptide"
HQADNLLMG

SEQ ID NO: 14562 - protein, 10 aa, Artificial Sequence
  source: /note="Description of Artificial Sequence: Synthetic peptide"
GLSRHQADNL

SEQ ID NO: 14563 - protein, 10 aa, Artificial Sequence
  source: /note="Description of Artificial Sequence: Synthetic peptide"
HQADNLLMGK

SEQ ID NO: 14564 - protein, 10 aa, Artificial Sequence
  source: /note="Description of Artificial Sequence: Synthetic peptide"
SRHQADNLLM

SEQ ID NO: 14565 - protein, 9 aa, Artificial Sequence
  source: /note="Description of Artificial Sequence: Synthetic peptide"
KKHGTPTNY

SEQ ID NO: 14566 - protein, 9 aa, Artificial Sequence
  source: /note="Description of Artificial Sequence: Synthetic peptide"
HGTPTNYGF

SEQ ID NO: 14567 - protein, 9 aa, Artificial Sequence
  source: /note="Description of Artificial Sequence: Synthetic peptide"
TPTNYGFCF

SEQ ID NO: 14568 - protein, 10 aa, Artificial Sequence
  source: /note="Description of Artificial Sequence: Synthetic peptide"
GTPTNYGFCF

SEQ ID NO: 14569 - protein, 10 aa, Artificial Sequence
  source: /note="Description of Artificial Sequence: Synthetic peptide"
KKKHGTPTNY

SEQ ID NO: 14570 - protein, 10 aa, Artificial Sequence
  source: /note="Description of Artificial Sequence: Synthetic peptide"
KHGTPTNYGF

SEQ ID NO: 14571 - protein, 9 aa, Artificial Sequence
  source: /note="Description of Artificial Sequence: Synthetic peptide"
LGSGRKLWK

SEQ ID NO: 14572 - protein, 9 aa, Artificial Sequence
  source: /note="Description of Artificial Sequence: Synthetic peptide"
EIQGFLQLL

SEQ ID NO: 14573 - protein, 9 aa, Artificial Sequence
  source: /note="Description of Artificial Sequence: Synthetic peptide"
LLGSGRKLW

SEQ ID NO: 14574 - protein, 10 aa, Artificial Sequence
  source: /note="Description of Artificial Sequence: Synthetic peptide"
LLGSGRKLWK

SEQ ID NO: 14575 - protein, 10 aa, Artificial Sequence
  source: /note="Description of Artificial Sequence: Synthetic peptide"
LQLLGSGRKL

SEQ ID NO: 14576 - protein, 10 aa, Artificial Sequence
  source: /note="Description of Artificial Sequence: Synthetic peptide"
QLLGSGRKLW

SEQ ID NO: 14577 - protein, 10 aa, Artificial Sequence
  source: /note="Description of Artificial Sequence: Synthetic peptide"
PEIQGFLQLL

SEQ ID NO: 14578 - protein, 9 aa, Artificial Sequence
  source: /note="Description of Artificial Sequence: Synthetic peptide"
AGMYCVPQV

SEQ ID NO: 14579 - protein, 9 aa, Artificial Sequence
  source: /note="Description of Artificial Sequence: Synthetic peptide"
MYCVPQVGL

SEQ ID NO: 14580 - protein, 9 aa, Artificial Sequence
  source: /note="Description of Artificial Sequence: Synthetic peptide"
AKYESAGMY

SEQ ID NO: 14581 - protein, 9 aa, Artificial Sequence
  source: /note="Description of Artificial Sequence: Synthetic peptide"
YESAGMYCV

SEQ ID NO: 14582 - protein, 9 aa, Artificial Sequence
  source: /note="Description of Artificial Sequence: Synthetic peptide"
GMYCVPQVG

SEQ ID NO: 14583 - protein, 10 aa, Artificial Sequence
  source: /note="Description of Artificial Sequence: Synthetic peptide"
GMYCVPQVGL

SEQ ID NO: 14584 - protein, 10 aa, Artificial Sequence
  source: /note="Description of Artificial Sequence: Synthetic peptide"
KYESAGMYCV

SEQ ID NO: 14585 - protein, 10 aa, Artificial Sequence
  source: /note="Description of Artificial Sequence: Synthetic peptide"
MYCVPQVGLV

SEQ ID NO: 14586 - protein, 10 aa, Artificial Sequence
  source: /note="Description of Artificial Sequence: Synthetic peptide"
RAKYESAGMY

SEQ ID NO: 14587 - protein, 10 aa, Artificial Sequence
  source: /note="Description of Artificial Sequence: Synthetic peptide"
YESAGMYCVP

SEQ ID NO: 14588 - protein, 9 aa, Artificial Sequence
  source: /note="Description of Artificial Sequence: Synthetic peptide"
AWGSYKLTL

SEQ ID NO: 14589 - protein, 9 aa, Artificial Sequence
  source: /note="Description of Artificial Sequence: Synthetic peptide"
QIEEAWGSY

SEQ ID NO: 14590 - protein, 9 aa, Artificial Sequence
  source: /note="Description of Artificial Sequence: Synthetic peptide"
FQLQIEEAW

SEQ ID NO: 14591 - protein, 9 aa, Artificial Sequence
  source: /note="Description of Artificial Sequence: Synthetic peptide"
EEAWGSYKL

SEQ ID NO: 14592 - protein, 10 aa, Artificial Sequence
  source: /note="Description of Artificial Sequence: Synthetic peptide"
QIEEAWGSYK

SEQ ID NO: 14593 - protein, 10 aa, Artificial Sequence
  source: /note="Description of Artificial Sequence: Synthetic peptide"
TFQLQIEEAW

SEQ ID NO: 14594 - protein, 10 aa, Artificial Sequence
  source: /note="Description of Artificial Sequence: Synthetic peptide"
LQIEEAWGSY

SEQ ID NO: 14595 - protein, 10 aa, Artificial Sequence
  source: /note="Description of Artificial Sequence: Synthetic peptide"
IEEAWGSYKL

SEQ ID NO: 14596 - protein, 10 aa, Artificial Sequence
  source: /note="Description of Artificial Sequence: Synthetic peptide"
EEAWGSYKLT

SEQ ID NO: 14597 - protein, 9 aa, Artificial Sequence
  source: /note="Description of Artificial Sequence: Synthetic peptide"
CLNAILGQI

SEQ ID NO: 14598 - protein, 9 aa, Artificial Sequence
  source: /note="Description of Artificial Sequence: Synthetic peptide"
CESECLNAI

SEQ ID NO: 14599 - protein, 10 aa, Artificial Sequence
  source: /note="Description of Artificial Sequence: Synthetic peptide"
CLNAILGQII

SEQ ID NO: 14600 - protein, 10 aa, Artificial Sequence
  source: /note="Description of Artificial Sequence: Synthetic peptide"
CESECLNAIL

SEQ ID NO: 14601 - protein, 9 aa, Artificial Sequence
  source: /note="Description of Artificial Sequence: Synthetic peptide"
KSRAEAKQM

SEQ ID NO: 14602 - protein, 9 aa, Artificial Sequence
  source: /note="Description of Artificial Sequence: Synthetic peptide"
AEAKQMKVA

SEQ ID NO: 14603 - protein, 9 aa, Artificial Sequence
  source: /note="Description of Artificial Sequence: Synthetic peptide"
KQMKVAKNA

SEQ ID NO: 14604 - protein, 10 aa, Artificial Sequence
  source: /note="Description of Artificial Sequence: Synthetic peptide"
KSRAEAKQMK

SEQ ID NO: 14605 - protein, 10 aa, Artificial Sequence
  source: /note="Description of Artificial Sequence: Synthetic peptide"
YKSRAEAKQM

SEQ ID NO: 14606 - protein, 10 aa, Artificial Sequence
  source: /note="Description of Artificial Sequence: Synthetic peptide"
KQMKVAKNAQ

SEQ ID NO: 14607 - protein, 9 aa, Artificial Sequence
  source: /note="Description of Artificial Sequence: Synthetic peptide"
GAFVQQGGK

SEQ ID NO: 14608 - protein, 9 aa, Artificial Sequence
  source: /note="Description of Artificial Sequence: Synthetic peptide"
KSSVNSMAM

SEQ ID NO: 14609 - protein, 9 aa, Artificial Sequence
  source: /note="Description of Artificial Sequence: Synthetic peptide"
VQQGGKSSV

SEQ ID NO: 14610 - protein, 9 aa, Artificial Sequence
  source: /note="Description of Artificial Sequence: Synthetic peptide"
GGKSSVNSM

SEQ ID NO: 14611 - protein, 10 aa, Artificial Sequence
  source: /note="Description of Artificial Sequence: Synthetic peptide"
FVQQGGKSSV

SEQ ID NO: 14612 - protein, 10 aa, Artificial Sequence
  source: /note="Description of Artificial Sequence: Synthetic peptide"
KSSVNSMAMR

SEQ ID NO: 14613 - protein, 10 aa, Artificial Sequence
  source: /note="Description of Artificial Sequence: Synthetic peptide"
GKSSVNSMAM

SEQ ID NO: 14614 - protein, 9 aa, Artificial Sequence
  source: /note="Description of Artificial Sequence: Synthetic peptide"
VLDSAVYEY

SEQ ID NO: 14615 - protein, 9 aa, Artificial Sequence
  source: /note="Description of Artificial Sequence: Synthetic peptide"
VEMSYGTVL

SEQ ID NO: 14616 - protein, 9 aa, Artificial Sequence
  source: /note="Description of Artificial Sequence: Synthetic peptide"
LDSAVYEYF

SEQ ID NO: 14617 - protein, 10 aa, Artificial Sequence
  source: /note="Description of Artificial Sequence: Synthetic peptide"
VLDSAVYEYF

SEQ ID NO: 14618 - protein, 10 aa, Artificial Sequence
  source: /note="Description of Artificial Sequence: Synthetic peptide"
TVLDSAVYEY

SEQ ID NO: 14619 - protein, 10 aa, Artificial Sequence
  source: /note="Description of Artificial Sequence: Synthetic peptide"
MSYGTVLDSA

SEQ ID NO: 14620 - protein, 9 aa, Artificial Sequence
  source: /note="Description of Artificial Sequence: Synthetic peptide"
SLLSSLLHA

SEQ ID NO: 14621 - protein, 9 aa, Artificial Sequence
  source: /note="Description of Artificial Sequence: Synthetic peptide"
LLSSLLHAL

SEQ ID NO: 14622 - protein, 9 aa, Artificial Sequence
  source: /note="Description of Artificial Sequence: Synthetic peptide"
TQTSLLSSL

SEQ ID NO: 14623 - protein, 9 aa, Artificial Sequence
  source: /note="Description of Artificial Sequence: Synthetic peptide"
LSSLLHALK

SEQ ID NO: 14624 - protein, 9 aa, Artificial Sequence
  source: /note="Description of Artificial Sequence: Synthetic peptide"
SLSRTFPSK

SEQ ID NO: 14625 - protein, 9 aa, Artificial Sequence
  source: /note="Description of Artificial Sequence: Synthetic peptide"
SSYTQTSLL

SEQ ID NO: 14626 - protein, 9 aa, Artificial Sequence
  source: /note="Description of Artificial Sequence: Synthetic peptide"
SSLSRTFPS

SEQ ID NO: 14627 - protein, 9 aa, Artificial Sequence
  source: /note="Description of Artificial Sequence: Synthetic peptide"
KQKSLMAQS

SEQ ID NO: 14628 - protein, 9 aa, Artificial Sequence
  source: /note="Description of Artificial Sequence: Synthetic peptide"
QTSLLSSLL

SEQ ID NO: 14629 - protein, 9 aa, Artificial Sequence
  source: /note="Description of Artificial Sequence: Synthetic peptide"
HALKVPSSL

SEQ ID NO: 14630 - protein, 9 aa, Artificial Sequence
  source: /note="Description of Artificial Sequence: Synthetic peptide"
VPSSLSRTF

SEQ ID NO: 14631 - protein, 9 aa, Artificial Sequence
  source: /note="Description of Artificial Sequence: Synthetic peptide"
FPSKQKSLM

SEQ ID NO: 14632 - protein, 9 aa, Artificial Sequence
  source: /note="Description of Artificial Sequence: Synthetic peptide"
ISSYTQTSL

SEQ ID NO: 14633 - protein, 10 aa, Artificial Sequence
  source: /note="Description of Artificial Sequence: Synthetic peptide"
SLLSSLLHAL

SEQ ID NO: 14634 - protein, 10 aa, Artificial Sequence
  source: /note="Description of Artificial Sequence: Synthetic peptide"
VISSYTQTSL

SEQ ID NO: 14635 - protein, 10 aa, Artificial Sequence
  source: /note="Description of Artificial Sequence: Synthetic peptide"
YTQTSLLSSL

SEQ ID NO: 14636 - protein, 10 aa, Artificial Sequence
  source: /note="Description of Artificial Sequence: Synthetic peptide"
TQTSLLSSLL

SEQ ID NO: 14637 - protein, 10 aa, Artificial Sequence
  source: /note="Description of Artificial Sequence: Synthetic peptide"
LLSSLLHALK

SEQ ID NO: 14638 - protein, 10 aa, Artificial Sequence
  source: /note="Description of Artificial Sequence: Synthetic peptide"
ALKVPSSLSR

SEQ ID NO: 14639 - protein, 10 aa, Artificial Sequence
  source: /note="Description of Artificial Sequence: Synthetic peptide"
SSLSRTFPSK

SEQ ID NO: 14640 - protein, 10 aa, Artificial Sequence
  source: /note="Description of Artificial Sequence: Synthetic peptide"
KVPSSLSRTF

SEQ ID NO: 14641 - protein, 10 aa, Artificial Sequence
  source: /note="Description of Artificial Sequence: Synthetic peptide"
LSRTFPSKQK

SEQ ID NO: 14642 - protein, 10 aa, Artificial Sequence
  source: /note="Description of Artificial Sequence: Synthetic peptide"
RTFPSKQKSL

SEQ ID NO: 14643 - protein, 10 aa, Artificial Sequence
  source: /note="Description of Artificial Sequence: Synthetic peptide"
FPSKQKSLMA

SEQ ID NO: 14644 - protein, 10 aa, Artificial Sequence
  source: /note="Description of Artificial Sequence: Synthetic peptide"
ISSYTQTSLL

SEQ ID NO: 14645 - protein, 10 aa, Artificial Sequence
  source: /note="Description of Artificial Sequence: Synthetic peptide"
LHALKVPSSL

SEQ ID NO: 14646 - protein, 9 aa, Artificial Sequence
  source: /note="Description of Artificial Sequence: Synthetic peptide"
AQWDGLTGH

SEQ ID NO: 14647 - protein, 9 aa, Artificial Sequence
  source: /note="Description of Artificial Sequence: Synthetic peptide"
KEAQWDGLT

SEQ ID NO: 14648 - protein, 10 aa, Artificial Sequence
  source: /note="Description of Artificial Sequence: Synthetic peptide"
AQWDGLTGHI

SEQ ID NO: 14649 - protein, 10 aa, Artificial Sequence
  source: /note="Description of Artificial Sequence: Synthetic peptide"
LIKEAQWDGL

SEQ ID NO: 14650 - protein, 10 aa, Artificial Sequence
  source: /note="Description of Artificial Sequence: Synthetic peptide"
FMNLIKEAQW

SEQ ID NO: 14651 - protein, 10 aa, Artificial Sequence
  source: /note="Description of Artificial Sequence: Synthetic peptide"
KEAQWDGLTG

SEQ ID NO: 14652 - protein, 9 aa, Artificial Sequence
  source: /note="Description of Artificial Sequence: Synthetic peptide"
TINEEQSEV

SEQ ID NO: 14653 - protein, 9 aa, Artificial Sequence
  source: /note="Description of Artificial Sequence: Synthetic peptide"
EEQSEVVDF

SEQ ID NO: 14654 - protein, 10 aa, Artificial Sequence
  source: /note="Description of Artificial Sequence: Synthetic peptide"
LTINEEQSEV

SEQ ID NO: 14655 - protein, 10 aa, Artificial Sequence
  source: /note="Description of Artificial Sequence: Synthetic peptide"
TINEEQSEVV

SEQ ID NO: 14656 - protein, 10 aa, Artificial Sequence
  source: /note="Description of Artificial Sequence: Synthetic peptide"
EQSEVVDFSV

SEQ ID NO: 14657 - protein, 10 aa, Artificial Sequence
  source: /note="Description of Artificial Sequence: Synthetic peptide"
NEEQSEVVDF

SEQ ID NO: 14658 - protein, 10 aa, Artificial Sequence
  source: /note="Description of Artificial Sequence: Synthetic peptide"
RQGGYGKKKW

SEQ ID NO: 14659 - protein, 9 aa, Artificial Sequence
  source: /note="Description of Artificial Sequence: Synthetic peptide"
KLISPSSQV

SEQ ID NO: 14660 - protein, 9 aa, Artificial Sequence
  source: /note="Description of Artificial Sequence: Synthetic peptide"
LISPSSQVF

SEQ ID NO: 14661 - protein, 10 aa, Artificial Sequence
  source: /note="Description of Artificial Sequence: Synthetic peptide"
LISPSSQVFI

SEQ ID NO: 14662 - protein, 10 aa, Artificial Sequence
  source: /note="Description of Artificial Sequence: Synthetic peptide"
KLISPSSQVF

SEQ ID NO: 14663 - protein, 10 aa, Artificial Sequence
  source: /note="Description of Artificial Sequence: Synthetic peptide"
AQRPKLISPS

SEQ ID NO: 14664 - protein, 10 aa, Artificial Sequence
  source: /note="Description of Artificial Sequence: Synthetic peptide"
VKNGAQRPKL

SEQ ID NO: 14665 - protein, 9 aa, Artificial Sequence
  source: /note="Description of Artificial Sequence: Synthetic peptide"
LSDKSCYDY

SEQ ID NO: 14666 - protein, 9 aa, Artificial Sequence
  source: /note="Description of Artificial Sequence: Synthetic peptide"
KSCYDYFAR

SEQ ID NO: 14667 - protein, 9 aa, Artificial Sequence
  source: /note="Description of Artificial Sequence: Synthetic peptide"
AKLSDKSCY

SEQ ID NO: 14668 - protein, 10 aa, Artificial Sequence
  source: /note="Description of Artificial Sequence: Synthetic peptide"
LSDKSCYDYF

SEQ ID NO: 14669 - protein, 10 aa, Artificial Sequence
  source: /note="Description of Artificial Sequence: Synthetic peptide"
KLSDKSCYDY

SEQ ID NO: 14670 - protein, 10 aa, Artificial Sequence
  source: /note="Description of Artificial Sequence: Synthetic peptide"
SAKLSDKSCY

SEQ ID NO: 14671 - protein, 9 aa, Artificial Sequence
  source: /note="Description of Artificial Sequence: Synthetic peptide"
WWESNNEQF

SEQ ID NO: 14672 - protein, 9 aa, Artificial Sequence
  source: /note="Description of Artificial Sequence: Synthetic peptide"
EIECFTPQR

SEQ ID NO: 14673 - protein, 9 aa, Artificial Sequence
  source: /note="Description of Artificial Sequence: Synthetic peptide"
SEIECFTPQ

SEQ ID NO: 14674 - protein, 9 aa, Artificial Sequence
  source: /note="Description of Artificial Sequence: Synthetic peptide"
REYGEWWES

SEQ ID NO: 14675 - protein, 9 aa, Artificial Sequence
  source: /note="Description of Artificial Sequence: Synthetic peptide"
EQFQWKIRH

SEQ ID NO: 14676 - protein, 9 aa, Artificial Sequence
  source: /note="Description of Artificial Sequence: Synthetic peptide"
FQWKIRHVG

SEQ ID NO: 14677 - protein, 9 aa, Artificial Sequence
  source: /note="Description of Artificial Sequence: Synthetic peptide"
TPQREYGEW

SEQ ID NO: 14678 - protein, 9 aa, Artificial Sequence
  source: /note="Description of Artificial Sequence: Synthetic peptide"
ESNNEQFQW

SEQ ID NO: 14679 - protein, 10 aa, Artificial Sequence
  source: /note="Description of Artificial Sequence: Synthetic peptide"
EWWESNNEQF

SEQ ID NO: 14680 - protein, 10 aa, Artificial Sequence
  source: /note="Description of Artificial Sequence: Synthetic peptide"
EQFQWKIRHV

SEQ ID NO: 14681 - protein, 10 aa, Artificial Sequence
  source: /note="Description of Artificial Sequence: Synthetic peptide"
IECFTPQREY

SEQ ID NO: 14682 - protein, 10 aa, Artificial Sequence
  source: /note="Description of Artificial Sequence: Synthetic peptide"
WESNNEQFQW

SEQ ID NO: 14683 - protein, 10 aa, Artificial Sequence
  source: /note="Description of Artificial Sequence: Synthetic peptide"
FQWKIRHVGP

SEQ ID NO: 14684 - protein, 10 aa, Artificial Sequence
  source: /note="Description of Artificial Sequence: Synthetic peptide"
REYGEWWESN

SEQ ID NO: 14685 - protein, 10 aa, Artificial Sequence
  source: /note="Description of Artificial Sequence: Synthetic peptide"
GEWWESNNEQ

SEQ ID NO: 14686 - protein, 10 aa, Artificial Sequence
  source: /note="Description of Artificial Sequence: Synthetic peptide"
TPQREYGEWW

SEQ ID NO: 14687 - protein, 9 aa, Artificial Sequence
  source: /note="Description of Artificial Sequence: Synthetic peptide"
WEDNFNCKL

SEQ ID NO: 14688 - protein, 10 aa, Artificial Sequence
  source: /note="Description of Artificial Sequence: Synthetic peptide"
EFWEDNFNCK

SEQ ID NO: 14689 - protein, 10 aa, Artificial Sequence
  source: /note="Description of Artificial Sequence: Synthetic peptide"
AEFWEDNFNC

SEQ ID NO: 14690 - protein, 9 aa, Artificial Sequence
  source: /note="Description of Artificial Sequence: Synthetic peptide"
MIAWLGGPA

SEQ ID NO: 14691 - protein, 10 aa, Artificial Sequence
  source: /note="Description of Artificial Sequence: Synthetic peptide"
GMIAWLGGPA

SEQ ID NO: 14692 - protein, 9 aa, Artificial Sequence
  source: /note="Description of Artificial Sequence: Synthetic peptide"
ALLTKTNQI

SEQ ID NO: 14693 - protein, 9 aa, Artificial Sequence
  source: /note="Description of Artificial Sequence: Synthetic peptide"
LTKTNQIYR

SEQ ID NO: 14694 - protein, 9 aa, Artificial Sequence
  source: /note="Description of Artificial Sequence: Synthetic peptide"
KTNQIYRIF

SEQ ID NO: 14695 - protein, 9 aa, Artificial Sequence
  source: /note="Description of Artificial Sequence: Synthetic peptide"
LLTKTNQIY

SEQ ID NO: 14696 - protein, 10 aa, Artificial Sequence
  source: /note="Description of Artificial Sequence: Synthetic peptide"
QIYRIFEQGK

SEQ ID NO: 14697 - protein, 10 aa, Artificial Sequence
  source: /note="Description of Artificial Sequence: Synthetic peptide"
LTKTNQIYRI

SEQ ID NO: 14698 - protein, 10 aa, Artificial Sequence
  source: /note="Description of Artificial Sequence: Synthetic peptide"
KTNQIYRIFE

SEQ ID NO: 14699 - protein, 10 aa, Artificial Sequence
  source: /note="Description of Artificial Sequence: Synthetic peptide"
ALLTKTNQIY

SEQ ID NO: 14700 - protein, 10 aa, Artificial Sequence
  source: /note="Description of Artificial Sequence: Synthetic peptide"
LLTKTNQIYR

SEQ ID NO: 14701 - protein, 10 aa, Artificial Sequence
  source: /note="Description of Artificial Sequence: Synthetic peptide"
TKTNQIYRIF

SEQ ID NO: 14702 - protein, 9 aa, Artificial Sequence
  source: /note="Description of Artificial Sequence: Synthetic peptide"
VQKCKRSFK

SEQ ID NO: 14703 - protein, 9 aa, Artificial Sequence
  source: /note="Description of Artificial Sequence: Synthetic peptide"
KCKRSFKAV

SEQ ID NO: 14704 - protein, 9 aa, Artificial Sequence
  source: /note="Description of Artificial Sequence: Synthetic peptide"
CKRSFKAVV

SEQ ID NO: 14705 - protein, 10 aa, Artificial Sequence
  source: /note="Description of Artificial Sequence: Synthetic peptide"
NVQKCKRSFK

SEQ ID NO: 14706 - protein, 10 aa, Artificial Sequence
  source: /note="Description of Artificial Sequence: Synthetic peptide"
VQKCKRSFKA

SEQ ID NO: 14707 - protein, 10 aa, Artificial Sequence
  source: /note="Description of Artificial Sequence: Synthetic peptide"
KCKRSFKAVV

SEQ ID NO: 14708 - protein, 9 aa, Artificial Sequence
  source: /note="Description of Artificial Sequence: Synthetic peptide"
ALLLETEDV

SEQ ID NO: 14709 - protein, 9 aa, Artificial Sequence
  source: /note="Description of Artificial Sequence: Synthetic peptide"
IEPIYALLL

SEQ ID NO: 14710 - protein, 9 aa, Artificial Sequence
  source: /note="Description of Artificial Sequence: Synthetic peptide"
LETEDVNLA

SEQ ID NO: 14711 - protein, 10 aa, Artificial Sequence
  source: /note="Description of Artificial Sequence: Synthetic peptide"
LLLETEDVNL

SEQ ID NO: 14712 - protein, 10 aa, Artificial Sequence
  source: /note="Description of Artificial Sequence: Synthetic peptide"
LETEDVNLAY

SEQ ID NO: 14713 - protein, 10 aa, Artificial Sequence
  source: /note="Description of Artificial Sequence: Synthetic peptide"
EPIYALLLET

SEQ ID NO: 14714 - protein, 9 aa, Artificial Sequence
  source: /note="Description of Artificial Sequence: Synthetic peptide"
VVHDPDKNK

SEQ ID NO: 14715 - protein, 9 aa, Artificial Sequence
  source: /note="Description of Artificial Sequence: Synthetic peptide"
KNKMKLKVK

SEQ ID NO: 14716 - protein, 10 aa, Artificial Sequence
  source: /note="Description of Artificial Sequence: Synthetic peptide"
AVVHDPDKNK

SEQ ID NO: 14717 - protein, 10 aa, Artificial Sequence
  source: /note="Description of Artificial Sequence: Synthetic peptide"
KNKMKLKVKK

SEQ ID NO: 14718 - protein, 9 aa, Artificial Sequence
  source: /note="Description of Artificial Sequence: Synthetic peptide"
RMKKVIIKW

SEQ ID NO: 14719 - protein, 9 aa, Artificial Sequence
  source: /note="Description of Artificial Sequence: Synthetic peptide"
SGRMKKVII

SEQ ID NO: 14720 - protein, 10 aa, Artificial Sequence
  source: /note="Description of Artificial Sequence: Synthetic peptide"
RMKKVIIKWA

SEQ ID NO: 14721 - protein, 10 aa, Artificial Sequence
  source: /note="Description of Artificial Sequence: Synthetic peptide"
SGRMKKVIIK

SEQ ID NO: 14722 - protein, 9 aa, Artificial Sequence
  source: /note="Description of Artificial Sequence: Synthetic peptide"
AVESPIFGV

SEQ ID NO: 14723 - protein, 9 aa, Artificial Sequence
  source: /note="Description of Artificial Sequence: Synthetic peptide"
ALEKRLKAV

SEQ ID NO: 14724 - protein, 9 aa, Artificial Sequence
  source: /note="Description of Artificial Sequence: Synthetic peptide"
RLKAVESPI

SEQ ID NO: 14725 - protein, 9 aa, Artificial Sequence
  source: /note="Description of Artificial Sequence: Synthetic peptide"
SPIFGVLSF

SEQ ID NO: 14726 - protein, 9 aa, Artificial Sequence
  source: /note="Description of Artificial Sequence: Synthetic peptide"
LKAVESPIF

SEQ ID NO: 14727 - protein, 9 aa, Artificial Sequence
  source: /note="Description of Artificial Sequence: Synthetic peptide"
VESPIFGVL

SEQ ID NO: 14728 - protein, 10 aa, Artificial Sequence
  source: /note="Description of Artificial Sequence: Synthetic peptide"
FLQEALEKRL

SEQ ID NO: 14729 - protein, 10 aa, Artificial Sequence
  source: /note="Description of Artificial Sequence: Synthetic peptide"
KAVESPIFGV

SEQ ID NO: 14730 - protein, 10 aa, Artificial Sequence
  source: /note="Description of Artificial Sequence: Synthetic peptide"
RLKAVESPIF

SEQ ID NO: 14731 - protein, 10 aa, Artificial Sequence
  source: /note="Description of Artificial Sequence: Synthetic peptide"
EALEKRLKAV

SEQ ID NO: 14732 - protein, 10 aa, Artificial Sequence
  source: /note="Description of Artificial Sequence: Synthetic peptide"
KRLKAVESPI

SEQ ID NO: 14733 - protein, 10 aa, Artificial Sequence
  source: /note="Description of Artificial Sequence: Synthetic peptide"
VESPIFGVLS

SEQ ID NO: 14734 - protein, 10 aa, Artificial Sequence
  source: /note="Description of Artificial Sequence: Synthetic peptide"
QEALEKRLKA

SEQ ID NO: 14735 - protein, 9 aa, Artificial Sequence
  source: /note="Description of Artificial Sequence: Synthetic peptide"
NLTKFYCTV

SEQ ID NO: 14736 - protein, 9 aa, Artificial Sequence
  source: /note="Description of Artificial Sequence: Synthetic peptide"
LTKFYCTVK

SEQ ID NO: 14737 - protein, 9 aa, Artificial Sequence
  source: /note="Description of Artificial Sequence: Synthetic peptide"
TKFYCTVKL

SEQ ID NO: 14738 - protein, 10 aa, Artificial Sequence
  source: /note="Description of Artificial Sequence: Synthetic peptide"
FYCTVKLDTM

SEQ ID NO: 14739 - protein, 10 aa, Artificial Sequence
  source: /note="Description of Artificial Sequence: Synthetic peptide"
LTKFYCTVKL

SEQ ID NO: 14740 - protein, 10 aa, Artificial Sequence
  source: /note="Description of Artificial Sequence: Synthetic peptide"
YNLTKFYCTV

SEQ ID NO: 14741 - protein, 10 aa, Artificial Sequence
  source: /note="Description of Artificial Sequence: Synthetic peptide"
CTVKLDTMIF

SEQ ID NO: 14742 - protein, 9 aa, Artificial Sequence
  source: /note="Description of Artificial Sequence: Synthetic peptide"
RLNSYYSWY

SEQ ID NO: 14743 - protein, 9 aa, Artificial Sequence
  source: /note="Description of Artificial Sequence: Synthetic peptide"
IRLNSYYSW

SEQ ID NO: 14744 - protein, 9 aa, Artificial Sequence
  source: /note="Description of Artificial Sequence: Synthetic peptide"
VIRLNSYYS

SEQ ID NO: 14745 - protein, 9 aa, Artificial Sequence
  source: /note="Description of Artificial Sequence: Synthetic peptide"
DVIRLNSYY

SEQ ID NO: 14746 - protein, 9 aa, Artificial Sequence
  source: /note="Description of Artificial Sequence: Synthetic peptide"
APYVDVIRL

SEQ ID NO: 14747 - protein, 9 aa, Artificial Sequence
  source: /note="Description of Artificial Sequence: Synthetic peptide"
VDVIRLNSY

SEQ ID NO: 14748 - protein, 10 aa, Artificial Sequence
  source: /note="Description of Artificial Sequence: Synthetic peptide"
YVDVIRLNSY

SEQ ID NO: 14749 - protein, 10 aa, Artificial Sequence
  source: /note="Description of Artificial Sequence: Synthetic peptide"
RLNSYYSWYH

SEQ ID NO: 14750 - protein, 10 aa, Artificial Sequence
  source: /note="Description of Artificial Sequence: Synthetic peptide"
DVIRLNSYYS

SEQ ID NO: 14751 - protein, 10 aa, Artificial Sequence
  source: /note="Description of Artificial Sequence: Synthetic peptide"
VDVIRLNSYY

SEQ ID NO: 14752 - protein, 10 aa, Artificial Sequence
  source: /note="Description of Artificial Sequence: Synthetic peptide"
VIRLNSYYSW

SEQ ID NO: 14753 - protein, 10 aa, Artificial Sequence
  source: /note="Description of Artificial Sequence: Synthetic peptide"
IRLNSYYSWY

SEQ ID NO: 14754 - protein, 9 aa, Artificial Sequence
  source: /note="Description of Artificial Sequence: Synthetic peptide"
CVNSYYSWY

SEQ ID NO: 14755 - protein, 9 aa, Artificial Sequence
  source: /note="Description of Artificial Sequence: Synthetic peptide"
DVICVNSYY

SEQ ID NO: 14756 - protein, 9 aa, Artificial Sequence
  source: /note="Description of Artificial Sequence: Synthetic peptide"
VDVICVNSY

SEQ ID NO: 14757 - protein, 9 aa, Artificial Sequence
  source: /note="Description of Artificial Sequence: Synthetic peptide"
ICVNSYYSW

SEQ ID NO: 14758 - protein, 9 aa, Artificial Sequence
  source: /note="Description of Artificial Sequence: Synthetic peptide"
APYVDVICV

SEQ ID NO: 14759 - protein, 10 aa, Artificial Sequence
  source: /note="Description of Artificial Sequence: Synthetic peptide"
YVDVICVNSY

SEQ ID NO: 14760 - protein, 10 aa, Artificial Sequence
  source: /note="Description of Artificial Sequence: Synthetic peptide"
CVNSYYSWYH

SEQ ID NO: 14761 - protein, 10 aa, Artificial Sequence
  source: /note="Description of Artificial Sequence: Synthetic peptide"
DVICVNSYYS

SEQ ID NO: 14762 - protein, 10 aa, Artificial Sequence
  source: /note="Description of Artificial Sequence: Synthetic peptide"
VDVICVNSYY

SEQ ID NO: 14763 - protein, 10 aa, Artificial Sequence
  source: /note="Description of Artificial Sequence: Synthetic peptide"
ICVNSYYSWY

SEQ ID NO: 14764 - protein, 9 aa, Artificial Sequence
  source: /note="Description of Artificial Sequence: Synthetic peptide"
YVDTDILFF

SEQ ID NO: 14765 - protein, 10 aa, Artificial Sequence
  source: /note="Description of Artificial Sequence: Synthetic peptide"
YVDTDILFFT

SEQ ID NO: 14766 - protein, 10 aa, Artificial Sequence
  source: /note="Description of Artificial Sequence: Synthetic peptide"
LYVDTDILFF

SEQ ID NO: 14767 - protein, 9 aa, Artificial Sequence
  source: /note="Description of Artificial Sequence: Synthetic peptide"
APQARQGHA

SEQ ID NO: 14768 - protein, 9 aa, Artificial Sequence
  source: /note="Description of Artificial Sequence: Synthetic peptide"
ARQGHAGTF

SEQ ID NO: 14769 - protein, 9 aa, Artificial Sequence
  source: /note="Description of Artificial Sequence: Synthetic peptide"
GHAGTFQCW

SEQ ID NO: 14770 - protein, 9 aa, Artificial Sequence
  source: /note="Description of Artificial Sequence: Synthetic peptide"
HAGTFQCWW

SEQ ID NO: 14771 - protein, 10 aa, Artificial Sequence
  source: /note="Description of Artificial Sequence: Synthetic peptide"
EAKEGAPQAR

SEQ ID NO: 14772 - protein, 10 aa, Artificial Sequence
  source: /note="Description of Artificial Sequence: Synthetic peptide"
QARQGHAGTF

SEQ ID NO: 14773 - protein, 10 aa, Artificial Sequence
  source: /note="Description of Artificial Sequence: Synthetic peptide"
GEAKEGAPQA

SEQ ID NO: 14774 - protein, 10 aa, Artificial Sequence
  source: /note="Description of Artificial Sequence: Synthetic peptide"
RQGHAGTFQC

SEQ ID NO: 14775 - protein, 9 aa, Artificial Sequence
  source: /note="Description of Artificial Sequence: Synthetic peptide"
SLIGKKGQR

SEQ ID NO: 14776 - protein, 10 aa, Artificial Sequence
  source: /note="Description of Artificial Sequence: Synthetic peptide"
KSLIGKKGQR

SEQ ID NO: 14777 - protein, 9 aa, Artificial Sequence
  source: /note="Description of Artificial Sequence: Synthetic peptide"
GMDSPFCLL

SEQ ID NO: 14778 - protein, 9 aa, Artificial Sequence
  source: /note="Description of Artificial Sequence: Synthetic peptide"
RLPNHGRPK

SEQ ID NO: 14779 - protein, 9 aa, Artificial Sequence
  source: /note="Description of Artificial Sequence: Synthetic peptide"
LLRALFWDR

SEQ ID NO: 14780 - protein, 9 aa, Artificial Sequence
  source: /note="Description of Artificial Sequence: Synthetic peptide"
SPFCLLRAL

SEQ ID NO: 14781 - protein, 9 aa, Artificial Sequence
  source: /note="Description of Artificial Sequence: Synthetic peptide"
MGQGMDSPF

SEQ ID NO: 14782 - protein, 9 aa, Artificial Sequence
  source: /note="Description of Artificial Sequence: Synthetic peptide"
KKELQIPPL

SEQ ID NO: 14783 - protein, 10 aa, Artificial Sequence
  source: /note="Description of Artificial Sequence: Synthetic peptide"
KSPNQRTAIK

SEQ ID NO: 14784 - protein, 10 aa, Artificial Sequence
  source: /note="Description of Artificial Sequence: Synthetic peptide"
GMDSPFCLLR

SEQ ID NO: 14785 - protein, 10 aa, Artificial Sequence
  source: /note="Description of Artificial Sequence: Synthetic peptide"
KMGQGMDSPF

SEQ ID NO: 14786 - protein, 10 aa, Artificial Sequence
  source: /note="Description of Artificial Sequence: Synthetic peptide"
SGKKGGRNPR

SEQ ID NO: 14787 - protein, 10 aa, Artificial Sequence
  source: /note="Description of Artificial Sequence: Synthetic peptide"
GGRNPRLPNH

SEQ ID NO: 14788 - protein, 10 aa, Artificial Sequence
  source: /note="Description of Artificial Sequence: Synthetic peptide"
HGRPKSPNQR

SEQ ID NO: 14789 - protein, 10 aa, Artificial Sequence
  source: /note="Description of Artificial Sequence: Synthetic peptide"
RTAIKKELQI

SEQ ID NO: 14790 - protein, 10 aa, Artificial Sequence
  source: /note="Description of Artificial Sequence: Synthetic peptide"
CLLRALFWDR

SEQ ID NO: 14791 - protein, 10 aa, Artificial Sequence
  source: /note="Description of Artificial Sequence: Synthetic peptide"
RPKSPNQRTA

SEQ ID NO: 14792 - protein, 10 aa, Artificial Sequence
  source: /note="Description of Artificial Sequence: Synthetic peptide"
IPPLKMGQGM

SEQ ID NO: 14793 - protein, 10 aa, Artificial Sequence
  source: /note="Description of Artificial Sequence: Synthetic peptide"
SPFCLLRALF

SEQ ID NO: 14794 - protein, 10 aa, Artificial Sequence
  source: /note="Description of Artificial Sequence: Synthetic peptide"
NQRTAIKKEL

SEQ ID NO: 14795 - protein, 10 aa, Artificial Sequence
  source: /note="Description of Artificial Sequence: Synthetic peptide"
IKKELQIPPL

SEQ ID NO: 14796 - protein, 10 aa, Artificial Sequence
  source: /note="Description of Artificial Sequence: Synthetic peptide"
KELQIPPLKM

SEQ ID NO: 14797 - protein, 10 aa, Artificial Sequence
  source: /note="Description of Artificial Sequence: Synthetic peptide"
GQGMDSPFCL

SEQ ID NO: 14798 - protein, 9 aa, Artificial Sequence
  source: /note="Description of Artificial Sequence: Synthetic peptide"
LARRILGER

SEQ ID NO: 14799 - protein, 10 aa, Artificial Sequence
  source: /note="Description of Artificial Sequence: Synthetic peptide"
QLARRILGER

SEQ ID NO: 14800 - protein, 10 aa, Artificial Sequence
  source: /note="Description of Artificial Sequence: Synthetic peptide"
KDIQLARRIL

SEQ ID NO: 14801 - protein, 9 aa, Artificial Sequence
  source: /note="Description of Artificial Sequence: Synthetic peptide"
RLDDVCNRF

SEQ ID NO: 14802 - protein, 10 aa, Artificial Sequence
  source: /note="Description of Artificial Sequence: Synthetic peptide"
RLDDVCNRFK

SEQ ID NO: 14803 - protein, 9 aa, Artificial Sequence
  source: /note="Description of Artificial Sequence: Synthetic peptide"
CLTDFQANA

SEQ ID NO: 14804 - protein, 9 aa, Artificial Sequence
  source: /note="Description of Artificial Sequence: Synthetic peptide"
FQANAREQL

SEQ ID NO: 14805 - protein, 10 aa, Artificial Sequence
  source: /note="Description of Artificial Sequence: Synthetic peptide"
QANAREQLSK

SEQ ID NO: 14806 - protein, 10 aa, Artificial Sequence
  source: /note="Description of Artificial Sequence: Synthetic peptide"
CLTDFQANAR

SEQ ID NO: 14807 - protein, 9 aa, Artificial Sequence
  source: /note="Description of Artificial Sequence: Synthetic peptide"
IVQGHYREF

SEQ ID NO: 14808 - protein, 9 aa, Artificial Sequence
  source: /note="Description of Artificial Sequence: Synthetic peptide"
PTIVQGHYR

SEQ ID NO: 14809 - protein, 9 aa, Artificial Sequence
  source: /note="Description of Artificial Sequence: Synthetic peptide"
SPTIVQGHY

SEQ ID NO: 14810 - protein, 10 aa, Artificial Sequence
  source: /note="Description of Artificial Sequence: Synthetic peptide"
HYREFCQCDF

SEQ ID NO: 14811 - protein, 10 aa, Artificial Sequence
  source: /note="Description of Artificial Sequence: Synthetic peptide"
TIVQGHYREF

SEQ ID NO: 14812 - protein, 10 aa, Artificial Sequence
  source: /note="Description of Artificial Sequence: Synthetic peptide"
RESPTIVQGH

SEQ ID NO: 14813 - protein, 9 aa, Artificial Sequence
  source: /note="Description of Artificial Sequence: Synthetic peptide"
KVIHFKKSK

SEQ ID NO: 14814 - protein, 9 aa, Artificial Sequence
  source: /note="Description of Artificial Sequence: Synthetic peptide"
PAKKVIHFK

SEQ ID NO: 14815 - protein, 9 aa, Artificial Sequence
  source: /note="Description of Artificial Sequence: Synthetic peptide"
AKKVIHFKK

SEQ ID NO: 14816 - protein, 9 aa, Artificial Sequence
  source: /note="Description of Artificial Sequence: Synthetic peptide"
LPAKKVIHF

SEQ ID NO: 14817 - protein, 9 aa, Artificial Sequence
  source: /note="Description of Artificial Sequence: Synthetic peptide"
IHFKKSKII

SEQ ID NO: 14818 - protein, 10 aa, Artificial Sequence
  source: /note="Description of Artificial Sequence: Synthetic peptide"
SLPAKKVIHF

SEQ ID NO: 14819 - protein, 10 aa, Artificial Sequence
  source: /note="Description of Artificial Sequence: Synthetic peptide"
PAKKVIHFKK

SEQ ID NO: 14820 - protein, 10 aa, Artificial Sequence
  source: /note="Description of Artificial Sequence: Synthetic peptide"
KVIHFKKSKI

SEQ ID NO: 14821 - protein, 10 aa, Artificial Sequence
  source: /note="Description of Artificial Sequence: Synthetic peptide"
IHFKKSKIIW

SEQ ID NO: 14822 - protein, 9 aa, Artificial Sequence
  source: /note="Description of Artificial Sequence: Synthetic peptide"
VVYPWTQRL

SEQ ID NO: 14823 - protein, 9 aa, Artificial Sequence
  source: /note="Description of Artificial Sequence: Synthetic peptide"
RLFESFGDL

SEQ ID NO: 14824 - protein, 9 aa, Artificial Sequence
  source: /note="Description of Artificial Sequence: Synthetic peptide"
VYPWTQRLF

SEQ ID NO: 14825 - protein, 9 aa, Artificial Sequence
  source: /note="Description of Artificial Sequence: Synthetic peptide"
WTQRLFESF

SEQ ID NO: 14826 - protein, 10 aa, Artificial Sequence
  source: /note="Description of Artificial Sequence: Synthetic peptide"
RLFESFGDLS

SEQ ID NO: 14827 - protein, 10 aa, Artificial Sequence
  source: /note="Description of Artificial Sequence: Synthetic peptide"
VVYPWTQRLF

SEQ ID NO: 14828 - protein, 10 aa, Artificial Sequence
  source: /note="Description of Artificial Sequence: Synthetic peptide"
PWTQRLFESF

SEQ ID NO: 14829 - protein, 10 aa, Artificial Sequence
  source: /note="Description of Artificial Sequence: Synthetic peptide"
LVVYPWTQRL

SEQ ID NO: 14830 - protein, 10 aa, Artificial Sequence
  source: /note="Description of Artificial Sequence: Synthetic peptide"
YPWTQRLFES

SEQ ID NO: 14831 - protein, 9 aa, Artificial Sequence
  source: /note="Description of Artificial Sequence: Synthetic peptide"
NLKGTCATL

SEQ ID NO: 14832 - protein, 10 aa, Artificial Sequence
  source: /note="Description of Artificial Sequence: Synthetic peptide"
KGTCATLSEL

SEQ ID NO: 14833 - protein, 9 aa, Artificial Sequence
  source: /note="Description of Artificial Sequence: Synthetic peptide"
VFQPVDYII

SEQ ID NO: 14834 - protein, 9 aa, Artificial Sequence
  source: /note="Description of Artificial Sequence: Synthetic peptide"
EVFQPVDYI

SEQ ID NO: 14835 - protein, 9 aa, Artificial Sequence
  source: /note="Description of Artificial Sequence: Synthetic peptide"
LRFEVFQPV

SEQ ID NO: 14836 - protein, 9 aa, Artificial Sequence
  source: /note="Description of Artificial Sequence: Synthetic peptide"
FEVFQPVDY

SEQ ID NO: 14837 - protein, 10 aa, Artificial Sequence
  source: /note="Description of Artificial Sequence: Synthetic peptide"
KLRFEVFQPV

SEQ ID NO: 14838 - protein, 10 aa, Artificial Sequence
  source: /note="Description of Artificial Sequence: Synthetic peptide"
RFEVFQPVDY

SEQ ID NO: 14839 - protein, 10 aa, Artificial Sequence
  source: /note="Description of Artificial Sequence: Synthetic peptide"
VFQPVDYIIR

SEQ ID NO: 14840 - protein, 10 aa, Artificial Sequence
  source: /note="Description of Artificial Sequence: Synthetic peptide"
EVFQPVDYII

SEQ ID NO: 14841 - protein, 10 aa, Artificial Sequence
  source: /note="Description of Artificial Sequence: Synthetic peptide"
FEVFQPVDYI

SEQ ID NO: 14842 - protein, 9 aa, Artificial Sequence
  source: /note="Description of Artificial Sequence: Synthetic peptide"
LMRTQSPPV

SEQ ID NO: 14843 - protein, 9 aa, Artificial Sequence
  source: /note="Description of Artificial Sequence: Synthetic peptide"
TTTPTSLMR

SEQ ID NO: 14844 - protein, 9 aa, Artificial Sequence
  source: /note="Description of Artificial Sequence: Synthetic peptide"
STTTPTSLM

SEQ ID NO: 14845 - protein, 9 aa, Artificial Sequence
  source: /note="Description of Artificial Sequence: Synthetic peptide"
SSTTTPTSL

SEQ ID NO: 14846 - protein, 10 aa, Artificial Sequence
  source: /note="Description of Artificial Sequence: Synthetic peptide"
SLMRTQSPPV

SEQ ID NO: 14847 - protein, 10 aa, Artificial Sequence
  source: /note="Description of Artificial Sequence: Synthetic peptide"
STTTPTSLMR

SEQ ID NO: 14848 - protein, 10 aa, Artificial Sequence
  source: /note="Description of Artificial Sequence: Synthetic peptide"
LMRTQSPPVY

SEQ ID NO: 14849 - protein, 10 aa, Artificial Sequence
  source: /note="Description of Artificial Sequence: Synthetic peptide"
SSTTTPTSLM

SEQ ID NO: 14850 - protein, 9 aa, Artificial Sequence
  source: /note="Description of Artificial Sequence: Synthetic peptide"
ASRTFHYAS

SEQ ID NO: 14851 - protein, 9 aa, Artificial Sequence
  source: /note="Description of Artificial Sequence: Synthetic peptide"
PLASRTFHY

SEQ ID NO: 14852 - protein, 9 aa, Artificial Sequence
  source: /note="Description of Artificial Sequence: Synthetic peptide"
LASRTFHYA

SEQ ID NO: 14853 - protein, 9 aa, Artificial Sequence
  source: /note="Description of Artificial Sequence: Synthetic peptide"
VQSPLASRT

SEQ ID NO: 14854 - protein, 10 aa, Artificial Sequence
  source: /note="Description of Artificial Sequence: Synthetic peptide"
PLASRTFHYA

SEQ ID NO: 14855 - protein, 10 aa, Artificial Sequence
  source: /note="Description of Artificial Sequence: Synthetic peptide"
ASRTFHYASP

SEQ ID NO: 14856 - protein, 10 aa, Artificial Sequence
  source: /note="Description of Artificial Sequence: Synthetic peptide"
VQSPLASRTF

SEQ ID NO: 14857 - protein, 10 aa, Artificial Sequence
  source: /note="Description of Artificial Sequence: Synthetic peptide"
SPLASRTFHY

SEQ ID NO: 14858 - protein, 9 aa, Artificial Sequence
  source: /note="Description of Artificial Sequence: Synthetic peptide"
FISSIQVDY

SEQ ID NO: 14859 - protein, 9 aa, Artificial Sequence
  source: /note="Description of Artificial Sequence: Synthetic peptide"
QVDYIFLIV

SEQ ID NO: 14860 - protein, 9 aa, Artificial Sequence
  source: /note="Description of Artificial Sequence: Synthetic peptide"
IQVDYIFLI

SEQ ID NO: 14861 - protein, 9 aa, Artificial Sequence
  source: /note="Description of Artificial Sequence: Synthetic peptide"
SSIQVDYIF

SEQ ID NO: 14862 - protein, 10 aa, Artificial Sequence
  source: /note="Description of Artificial Sequence: Synthetic peptide"
VVDFISSIQV

SEQ ID NO: 14863 - protein, 10 aa, Artificial Sequence
  source: /note="Description of Artificial Sequence: Synthetic peptide"
FISSIQVDYI

SEQ ID NO: 14864 - protein, 10 aa, Artificial Sequence
  source: /note="Description of Artificial Sequence: Synthetic peptide"
SIQVDYIFLI

SEQ ID NO: 14865 - protein, 10 aa, Artificial Sequence
  source: /note="Description of Artificial Sequence: Synthetic peptide"
IQVDYIFLIV

SEQ ID NO: 14866 - protein, 10 aa, Artificial Sequence
  source: /note="Description of Artificial Sequence: Synthetic peptide"
SSIQVDYIFL

SEQ ID NO: 14867 - protein, 10 aa, Artificial Sequence
  source: /note="Description of Artificial Sequence: Synthetic peptide"
ISSIQVDYIF

SEQ ID NO: 14868 - protein, 9 aa, Artificial Sequence
  source: /note="Description of Artificial Sequence: Synthetic peptide"
FTPDCWVSL

SEQ ID NO: 14869 - protein, 10 aa, Artificial Sequence
  source: /note="Description of Artificial Sequence: Synthetic peptide"
FLVPLLQDFT

SEQ ID NO: 14870 - protein, 9 aa, Artificial Sequence
  source: /note="Description of Artificial Sequence: Synthetic peptide"
SLDSSRHQY

SEQ ID NO: 14871 - protein, 9 aa, Artificial Sequence
  source: /note="Description of Artificial Sequence: Synthetic peptide"
SSRHQYQEK

SEQ ID NO: 14872 - protein, 9 aa, Artificial Sequence
  source: /note="Description of Artificial Sequence: Synthetic peptide"
RHQYQEKYK

SEQ ID NO: 14873 - protein, 9 aa, Artificial Sequence
  source: /note="Description of Artificial Sequence: Synthetic peptide"
IQSLDSSRH

SEQ ID NO: 14874 - protein, 9 aa, Artificial Sequence
  source: /note="Description of Artificial Sequence: Synthetic peptide"
SRHQYQEKY

SEQ ID NO: 14875 - protein, 10 aa, Artificial Sequence
  source: /note="Description of Artificial Sequence: Synthetic peptide"
QSLDSSRHQY

SEQ ID NO: 14876 - protein, 10 aa, Artificial Sequence
  source: /note="Description of Artificial Sequence: Synthetic peptide"
SSRHQYQEKY

SEQ ID NO: 14877 - protein, 10 aa, Artificial Sequence
  source: /note="Description of Artificial Sequence: Synthetic peptide"
HQYQEKYKQV

SEQ ID NO: 14878 - protein, 9 aa, Artificial Sequence
  source: /note="Description of Artificial Sequence: Synthetic peptide"
DSPPLSQLV

SEQ ID NO: 14879 - protein, 9 aa, Artificial Sequence
  source: /note="Description of Artificial Sequence: Synthetic peptide"
SPPLSQLVI

SEQ ID NO: 14880 - protein, 9 aa, Artificial Sequence
  source: /note="Description of Artificial Sequence: Synthetic peptide"
TKLEDSPPL

SEQ ID NO: 14881 - protein, 10 aa, Artificial Sequence
  source: /note="Description of Artificial Sequence: Synthetic peptide"
LEDSPPLSQL

SEQ ID NO: 14882 - protein, 9 aa, Artificial Sequence
  source: /note="Description of Artificial Sequence: Synthetic peptide"
LVATGHLLR

SEQ ID NO: 14883 - protein, 9 aa, Artificial Sequence
  source: /note="Description of Artificial Sequence: Synthetic peptide"
SPLVATGHL

SEQ ID NO: 14884 - protein, 9 aa, Artificial Sequence
  source: /note="Description of Artificial Sequence: Synthetic peptide"
LEDSPLVAT

SEQ ID NO: 14885 - protein, 10 aa, Artificial Sequence
  source: /note="Description of Artificial Sequence: Synthetic peptide"
GTKLEDSPLV

SEQ ID NO: 14886 - protein, 10 aa, Artificial Sequence
  source: /note="Description of Artificial Sequence: Synthetic peptide"
SPLVATGHLL

SEQ ID NO: 14887 - protein, 9 aa, Artificial Sequence
  source: /note="Description of Artificial Sequence: Synthetic peptide"
FIVNLSLAY

SEQ ID NO: 14888 - protein, 9 aa, Artificial Sequence
  source: /note="Description of Artificial Sequence: Synthetic peptide"
IVNLSLAYV

SEQ ID NO: 14889 - protein, 9 aa, Artificial Sequence
  source: /note="Description of Artificial Sequence: Synthetic peptide"
NLSLAYVLV

SEQ ID NO: 14890 - protein, 9 aa, Artificial Sequence
  source: /note="Description of Artificial Sequence: Synthetic peptide"
SLAYVLVTI

SEQ ID NO: 14891 - protein, 9 aa, Artificial Sequence
  source: /note="Description of Artificial Sequence: Synthetic peptide"
YVLVTITCL

SEQ ID NO: 14892 - protein, 9 aa, Artificial Sequence
  source: /note="Description of Artificial Sequence: Synthetic peptide"
VNLSLAYVL

SEQ ID NO: 14893 - protein, 10 aa, Artificial Sequence
  source: /note="Description of Artificial Sequence: Synthetic peptide"
FIVNLSLAYV

SEQ ID NO: 14894 - protein, 10 aa, Artificial Sequence
  source: /note="Description of Artificial Sequence: Synthetic peptide"
SLAYVLVTIT

SEQ ID NO: 14895 - protein, 10 aa, Artificial Sequence
  source: /note="Description of Artificial Sequence: Synthetic peptide"
YFIVNLSLAY

SEQ ID NO: 14896 - protein, 10 aa, Artificial Sequence
  source: /note="Description of Artificial Sequence: Synthetic peptide"
AYVLVTITCL

SEQ ID NO: 14897 - protein, 10 aa, Artificial Sequence
  source: /note="Description of Artificial Sequence: Synthetic peptide"
IVNLSLAYVL

SEQ ID NO: 14898 - protein, 10 aa, Artificial Sequence
  source: /note="Description of Artificial Sequence: Synthetic peptide"
LSLAYVLVTI

SEQ ID NO: 14899 - protein, 9 aa, Artificial Sequence
  source: /note="Description of Artificial Sequence: Synthetic peptide"
GLDPPWETL

SEQ ID NO: 14900 - protein, 9 aa, Artificial Sequence
  source: /note="Description of Artificial Sequence: Synthetic peptide"
RMWCWCHQA

SEQ ID NO: 14901 - protein, 9 aa, Artificial Sequence
  source: /note="Description of Artificial Sequence: Synthetic peptide"
HQASMPWRA

SEQ ID NO: 14902 - protein, 9 aa, Artificial Sequence
  source: /note="Description of Artificial Sequence: Synthetic peptide"
ASLPRMWCW

SEQ ID NO: 14903 - protein, 9 aa, Artificial Sequence
  source: /note="Description of Artificial Sequence: Synthetic peptide"
RWSCRSPAS

SEQ ID NO: 14904 - protein, 9 aa, Artificial Sequence
  source: /note="Description of Artificial Sequence: Synthetic peptide"
RSPASLPRM

SEQ ID NO: 14905 - protein, 9 aa, Artificial Sequence
  source: /note="Description of Artificial Sequence: Synthetic peptide"
PWRATPPLL

SEQ ID NO: 14906 - protein, 9 aa, Artificial Sequence
  source: /note="Description of Artificial Sequence: Synthetic peptide"
LSTWRPSER

SEQ ID NO: 14907 - protein, 9 aa, Artificial Sequence
  source: /note="Description of Artificial Sequence: Synthetic peptide"
RPSERWSCR

SEQ ID NO: 14908 - protein, 9 aa, Artificial Sequence
  source: /note="Description of Artificial Sequence: Synthetic peptide"
MPWRATPPL

SEQ ID NO: 14909 - protein, 9 aa, Artificial Sequence
  source: /note="Description of Artificial Sequence: Synthetic peptide"
WSCRSPASL

SEQ ID NO: 14910 - protein, 9 aa, Artificial Sequence
  source: /note="Description of Artificial Sequence: Synthetic peptide"
WCWCHQASM

SEQ ID NO: 14911 - protein, 9 aa, Artificial Sequence
  source: /note="Description of Artificial Sequence: Synthetic peptide"
WCHQASMPW

SEQ ID NO: 14912 - protein, 9 aa, Artificial Sequence
  source: /note="Description of Artificial Sequence: Synthetic peptide"
FTGGLDPPW

SEQ ID NO: 14913 - protein, 9 aa, Artificial Sequence
  source: /note="Description of Artificial Sequence: Synthetic peptide"
PPWETLSTW

SEQ ID NO: 14914 - protein, 9 aa, Artificial Sequence
  source: /note="Description of Artificial Sequence: Synthetic peptide"
SPASLPRMW

SEQ ID NO: 14915 - protein, 10 aa, Artificial Sequence
  source: /note="Description of Artificial Sequence: Synthetic peptide"
RMWCWCHQAS

SEQ ID NO: 14916 - protein, 10 aa, Artificial Sequence
  source: /note="Description of Artificial Sequence: Synthetic peptide"
SMPWRATPPL

SEQ ID NO: 14917 - protein, 10 aa, Artificial Sequence
  source: /note="Description of Artificial Sequence: Synthetic peptide"
RWSCRSPASL

SEQ ID NO: 14918 - protein, 10 aa, Artificial Sequence
  source: /note="Description of Artificial Sequence: Synthetic peptide"
MWCWCHQASM

SEQ ID NO: 14919 - protein, 10 aa, Artificial Sequence
  source: /note="Description of Artificial Sequence: Synthetic peptide"
CWCHQASMPW

SEQ ID NO: 14920 - protein, 10 aa, Artificial Sequence
  source: /note="Description of Artificial Sequence: Synthetic peptide"
SCRSPASLPR

SEQ ID NO: 14921 - protein, 10 aa, Artificial Sequence
  source: /note="Description of Artificial Sequence: Synthetic peptide"
TLSTWRPSER

SEQ ID NO: 14922 - protein, 10 aa, Artificial Sequence
  source: /note="Description of Artificial Sequence: Synthetic peptide"
MPWRATPPLL

SEQ ID NO: 14923 - protein, 10 aa, Artificial Sequence
  source: /note="Description of Artificial Sequence: Synthetic peptide"
SERWSCRSPA

SEQ ID NO: 14924 - protein, 10 aa, Artificial Sequence
  source: /note="Description of Artificial Sequence: Synthetic peptide"
CRSPASLPRM

SEQ ID NO: 14925 - protein, 10 aa, Artificial Sequence
  source: /note="Description of Artificial Sequence: Synthetic peptide"
HQASMPWRAT

SEQ ID NO: 14926 - protein, 10 aa, Artificial Sequence
  source: /note="Description of Artificial Sequence: Synthetic peptide"
WETLSTWRPS

SEQ ID NO: 14927 - protein, 10 aa, Artificial Sequence
  source: /note="Description of Artificial Sequence: Synthetic peptide"
DPPWETLSTW

SEQ ID NO: 14928 - protein, 9 aa, Artificial Sequence
  source: /note="Description of Artificial Sequence: Synthetic peptide"
QQKPNINTV

SEQ ID NO: 14929 - protein, 9 aa, Artificial Sequence
  source: /note="Description of Artificial Sequence: Synthetic peptide"
NTVATLEKV

SEQ ID NO: 14930 - protein, 9 aa, Artificial Sequence
  source: /note="Description of Artificial Sequence: Synthetic peptide"
KPNINTVAT

SEQ ID NO: 14931 - protein, 10 aa, Artificial Sequence
  source: /note="Description of Artificial Sequence: Synthetic peptide"
LQQKPNINTV

SEQ ID NO: 14932 - protein, 10 aa, Artificial Sequence
  source: /note="Description of Artificial Sequence: Synthetic peptide"
NINTVATLEK

SEQ ID NO: 14933 - protein, 10 aa, Artificial Sequence
  source: /note="Description of Artificial Sequence: Synthetic peptide"
NTVATLEKVI

SEQ ID NO: 14934 - protein, 10 aa, Artificial Sequence
  source: /note="Description of Artificial Sequence: Synthetic peptide"
KPNINTVATL

SEQ ID NO: 14935 - protein, 10 aa, Artificial Sequence
  source: /note="Description of Artificial Sequence: Synthetic peptide"
QQKPNINTVA

SEQ ID NO: 14936 - protein, 9 aa, Artificial Sequence
  source: /note="Description of Artificial Sequence: Synthetic peptide"
LASCMENER

SEQ ID NO: 14937 - protein, 9 aa, Artificial Sequence
  source: /note="Description of Artificial Sequence: Synthetic peptide"
RELLELASC

SEQ ID NO: 14938 - protein, 9 aa, Artificial Sequence
  source: /note="Description of Artificial Sequence: Synthetic peptide"
LELASCMEN

SEQ ID NO: 14939 - protein, 10 aa, Artificial Sequence
  source: /note="Description of Artificial Sequence: Synthetic peptide"
ELASCMENER

SEQ ID NO: 14940 - protein, 10 aa, Artificial Sequence
  source: /note="Description of Artificial Sequence: Synthetic peptide"
RELLELASCM

SEQ ID NO: 14941 - protein, 9 aa, Artificial Sequence
  source: /note="Description of Artificial Sequence: Synthetic peptide"
ALEHVSSSL

SEQ ID NO: 14942 - protein, 9 aa, Artificial Sequence
  source: /note="Description of Artificial Sequence: Synthetic peptide"
HVSSSLRLR

SEQ ID NO: 14943 - protein, 9 aa, Artificial Sequence
  source: /note="Description of Artificial Sequence: Synthetic peptide"
SSSLRLRTR

SEQ ID NO: 14944 - protein, 9 aa, Artificial Sequence
  source: /note="Description of Artificial Sequence: Synthetic peptide"
SLRLRTRTR

SEQ ID NO: 14945 - protein, 9 aa, Artificial Sequence
  source: /note="Description of Artificial Sequence: Synthetic peptide"
LIGKGAAKF

SEQ ID NO: 14946 - protein, 9 aa, Artificial Sequence
  source: /note="Description of Artificial Sequence: Synthetic peptide"
AKFARCATA

SEQ ID NO: 14947 - protein, 9 aa, Artificial Sequence
  source: /note="Description of Artificial Sequence: Synthetic peptide"
KFARCATAL

SEQ ID NO: 14948 - protein, 10 aa, Artificial Sequence
  source: /note="Description of Artificial Sequence: Synthetic peptide"
FLIGKGAAKF

SEQ ID NO: 14949 - protein, 10 aa, Artificial Sequence
  source: /note="Description of Artificial Sequence: Synthetic peptide"
KFLIGKGAAK

SEQ ID NO: 14950 - protein, 10 aa, Artificial Sequence
  source: /note="Description of Artificial Sequence: Synthetic peptide"
KGAAKFARCA

SEQ ID NO: 14951 - protein, 10 aa, Artificial Sequence
  source: /note="Description of Artificial Sequence: Synthetic peptide"
AAKFARCATA

SEQ ID NO: 14952 - protein, 10 aa, Artificial Sequence
  source: /note="Description of Artificial Sequence: Synthetic peptide"
SSLRLRTRTR

SEQ ID NO: 14953 - protein, 10 aa, Artificial Sequence
  source: /note="Description of Artificial Sequence: Synthetic peptide"
VSSSLRLRTR

SEQ ID NO: 14954 - protein, 10 aa, Artificial Sequence
  source: /note="Description of Artificial Sequence: Synthetic peptide"
TALEHVSSSL

SEQ ID NO: 14955 - protein, 10 aa, Artificial Sequence
  source: /note="Description of Artificial Sequence: Synthetic peptide"
SLRLRTRTRT

SEQ ID NO: 14956 - protein, 10 aa, Artificial Sequence
  source: /note="Description of Artificial Sequence: Synthetic peptide"
FARCATALEH

SEQ ID NO: 14957 - protein, 10 aa, Artificial Sequence
  source: /note="Description of Artificial Sequence: Synthetic peptide"
HKFLIGKGAA

SEQ ID NO: 14958 - protein, 10 aa, Artificial Sequence
  source: /note="Description of Artificial Sequence: Synthetic peptide"
AKFARCATAL

SEQ ID NO: 14959 - protein, 10 aa, Artificial Sequence
  source: /note="Description of Artificial Sequence: Synthetic peptide"
LEHVSSSLRL

SEQ ID NO: 14960 - protein, 9 aa, Artificial Sequence
  source: /note="Description of Artificial Sequence: Synthetic peptide"
KTLWKALAK

SEQ ID NO: 14961 - protein, 9 aa, Artificial Sequence
  source: /note="Description of Artificial Sequence: Synthetic peptide"
TLWKALAKK

SEQ ID NO: 14962 - protein, 9 aa, Artificial Sequence
  source: /note="Description of Artificial Sequence: Synthetic peptide"
WKALAKKPA

SEQ ID NO: 14963 - protein, 10 aa, Artificial Sequence
  source: /note="Description of Artificial Sequence: Synthetic peptide"
KTLWKALAKK

SEQ ID NO: 14964 - protein, 10 aa, Artificial Sequence
  source: /note="Description of Artificial Sequence: Synthetic peptide"
LAKKPASSGK

SEQ ID NO: 14965 - protein, 10 aa, Artificial Sequence
  source: /note="Description of Artificial Sequence: Synthetic peptide"
AKKPASSGKL

SEQ ID NO: 14966 - protein, 9 aa, Artificial Sequence
  source: /note="Description of Artificial Sequence: Synthetic peptide"
AVHRGGTLR

SEQ ID NO: 14967 - protein, 9 aa, Artificial Sequence
  source: /note="Description of Artificial Sequence: Synthetic peptide"
RGGTLRHPR

SEQ ID NO: 14968 - protein, 9 aa, Artificial Sequence
  source: /note="Description of Artificial Sequence: Synthetic peptide"
GTLRHPRAV

SEQ ID NO: 14969 - protein, 9 aa, Artificial Sequence
  source: /note="Description of Artificial Sequence: Synthetic peptide"
RTPHSHPQA

SEQ ID NO: 14970 - protein, 9 aa, Artificial Sequence
  source: /note="Description of Artificial Sequence: Synthetic peptide"
HPRAVPSAA

SEQ ID NO: 14971 - protein, 9 aa, Artificial Sequence
  source: /note="Description of Artificial Sequence: Synthetic peptide"
LAVHRGGTL

SEQ ID NO: 14972 - protein, 10 aa, Artificial Sequence
  source: /note="Description of Artificial Sequence: Synthetic peptide"
GLAVHRGGTL

SEQ ID NO: 14973 - protein, 10 aa, Artificial Sequence
  source: /note="Description of Artificial Sequence: Synthetic peptide"
RGGTLRHPRA

SEQ ID NO: 14974 - protein, 10 aa, Artificial Sequence
  source: /note="Description of Artificial Sequence: Synthetic peptide"
LAVHRGGTLR

SEQ ID NO: 14975 - protein, 10 aa, Artificial Sequence
  source: /note="Description of Artificial Sequence: Synthetic peptide"
HPRAVPSAAG

SEQ ID NO: 14976 - protein, 10 aa, Artificial Sequence
  source: /note="Description of Artificial Sequence: Synthetic peptide"
RAVPSAAGPL

SEQ ID NO: 14977 - protein, 10 aa, Artificial Sequence
  source: /note="Description of Artificial Sequence: Synthetic peptide"
LRHPRAVPSA

SEQ ID NO: 14978 - protein, 10 aa, Artificial Sequence
  source: /note="Description of Artificial Sequence: Synthetic peptide"
SAAGPLRTPH

SEQ ID NO: 14979 - protein, 9 aa, Artificial Sequence
  source: /note="Description of Artificial Sequence: Synthetic peptide"
ATPLVVAAA

SEQ ID NO: 14980 - protein, 9 aa, Artificial Sequence
  source: /note="Description of Artificial Sequence: Synthetic peptide"
AAAAPEERK

SEQ ID NO: 14981 - protein, 9 aa, Artificial Sequence
  source: /note="Description of Artificial Sequence: Synthetic peptide"
TPLVVAAAA

SEQ ID NO: 14982 - protein, 10 aa, Artificial Sequence
  source: /note="Description of Artificial Sequence: Synthetic peptide"
VAAAAPEERK

SEQ ID NO: 14983 - protein, 10 aa, Artificial Sequence
  source: /note="Description of Artificial Sequence: Synthetic peptide"
ATPLVVAAAA

SEQ ID NO: 14984 - protein, 9 aa, Artificial Sequence
  source: /note="Description of Artificial Sequence: Synthetic peptide"
KNSSAPIFK

SEQ ID NO: 14985 - protein, 9 aa, Artificial Sequence
  source: /note="Description of Artificial Sequence: Synthetic peptide"
TVKNSSAPI

SEQ ID NO: 14986 - protein, 9 aa, Artificial Sequence
  source: /note="Description of Artificial Sequence: Synthetic peptide"
SSAPIFKSI

SEQ ID NO: 14987 - protein, 9 aa, Artificial Sequence
  source: /note="Description of Artificial Sequence: Synthetic peptide"
VKNSSAPIF

SEQ ID NO: 14988 - protein, 10 aa, Artificial Sequence
  source: /note="Description of Artificial Sequence: Synthetic peptide"
VTVKNSSAPI

SEQ ID NO: 14989 - protein, 10 aa, Artificial Sequence
  source: /note="Description of Artificial Sequence: Synthetic peptide"
NSSAPIFKSI

SEQ ID NO: 14990 - protein, 10 aa, Artificial Sequence
  source: /note="Description of Artificial Sequence: Synthetic peptide"
TVKNSSAPIF

SEQ ID NO: 14991 - protein, 9 aa, Artificial Sequence
  source: /note="Description of Artificial Sequence: Synthetic peptide"
HKQTGHHAT

SEQ ID NO: 14992 - protein, 9 aa, Artificial Sequence
  source: /note="Description of Artificial Sequence: Synthetic peptide"
KQTGHHATL

SEQ ID NO: 14993 - protein, 10 aa, Artificial Sequence
  source: /note="Description of Artificial Sequence: Synthetic peptide"
HKQTGHHATL

SEQ ID NO: 14994 - protein, 10 aa, Artificial Sequence
  source: /note="Description of Artificial Sequence: Synthetic peptide"
KQTGHHATLL

SEQ ID NO: 14995 - protein, 9 aa, Artificial Sequence
  source: /note="Description of Artificial Sequence: Synthetic peptide"
FAQGTSAPL

SEQ ID NO: 14996 - protein, 9 aa, Artificial Sequence
  source: /note="Description of Artificial Sequence: Synthetic peptide"
AQETDNERF

SEQ ID NO: 14997 - protein, 9 aa, Artificial Sequence
  source: /note="Description of Artificial Sequence: Synthetic peptide"
ERFAQGTSA

SEQ ID NO: 14998 - protein, 10 aa, Artificial Sequence
  source: /note="Description of Artificial Sequence: Synthetic peptide"
RFAQGTSAPL

SEQ ID NO: 14999 - protein, 10 aa, Artificial Sequence
  source: /note="Description of Artificial Sequence: Synthetic peptide"
GAQETDNERF

SEQ ID NO: 15000 - protein, 10 aa, Artificial Sequence
  source: /note="Description of Artificial Sequence: Synthetic peptide"
NERFAQGTSA

SEQ ID NO: 15001 - protein, 10 aa, Artificial Sequence
  source: /note="Description of Artificial Sequence: Synthetic peptide"
FAQGTSAPLL

SEQ ID NO: 15002 - protein, 9 aa, Artificial Sequence
  source: /note="Description of Artificial Sequence: Synthetic peptide"
TESAAGSTM

SEQ ID NO: 15003 - protein, 9 aa, Artificial Sequence
  source: /note="Description of Artificial Sequence: Synthetic peptide"
CPLVTESAA

SEQ ID NO: 15004 - protein, 10 aa, Artificial Sequence
  source: /note="Description of Artificial Sequence: Synthetic peptide"
VTESAAGSTM

SEQ ID NO: 15005 - protein, 9 aa, Artificial Sequence
  source: /note="Description of Artificial Sequence: Synthetic peptide"
GWRKTCPPA

SEQ ID NO: 15006 - protein, 9 aa, Artificial Sequence
  source: /note="Description of Artificial Sequence: Synthetic peptide"
IPWDYCPIY

SEQ ID NO: 15007 - protein, 10 aa, Artificial Sequence
  source: /note="Description of Artificial Sequence: Synthetic peptide"
LIPWDYCPIY

SEQ ID NO: 15008 - protein, 10 aa, Artificial Sequence
  source: /note="Description of Artificial Sequence: Synthetic peptide"
IPWDYCPIYR

SEQ ID NO: 15009 - protein, 9 aa, Artificial Sequence
  source: /note="Description of Artificial Sequence: Synthetic peptide"
KMRTVLGVI

SEQ ID NO: 15010 - protein, 9 aa, Artificial Sequence
  source: /note="Description of Artificial Sequence: Synthetic peptide"
EQHKMRTVL

SEQ ID NO: 15011 - protein, 9 aa, Artificial Sequence
  source: /note="Description of Artificial Sequence: Synthetic peptide"
HKMRTVLGV

SEQ ID NO: 15012 - protein, 9 aa, Artificial Sequence
  source: /note="Description of Artificial Sequence: Synthetic peptide"
CEQHKMRTV

SEQ ID NO: 15013 - protein, 10 aa, Artificial Sequence
  source: /note="Description of Artificial Sequence: Synthetic peptide"
KMRTVLGVIV

SEQ ID NO: 15014 - protein, 10 aa, Artificial Sequence
  source: /note="Description of Artificial Sequence: Synthetic peptide"
TVLGVIVPGR

SEQ ID NO: 15015 - protein, 10 aa, Artificial Sequence
  source: /note="Description of Artificial Sequence: Synthetic peptide"
CEQHKMRTVL

SEQ ID NO: 15016 - protein, 10 aa, Artificial Sequence
  source: /note="Description of Artificial Sequence: Synthetic peptide"
HKMRTVLGVI

SEQ ID NO: 15017 - protein, 9 aa, Artificial Sequence
  source: /note="Description of Artificial Sequence: Synthetic peptide"
GLMDHTESA

SEQ ID NO: 15018 - protein, 9 aa, Artificial Sequence
  source: /note="Description of Artificial Sequence: Synthetic peptide"
LMDHTESAK

SEQ ID NO: 15019 - protein, 10 aa, Artificial Sequence
  source: /note="Description of Artificial Sequence: Synthetic peptide"
LMDHTESAKI

SEQ ID NO: 15020 - protein, 10 aa, Artificial Sequence
  source: /note="Description of Artificial Sequence: Synthetic peptide"
GLMDHTESAK

SEQ ID NO: 15021 - protein, 10 aa, Artificial Sequence
  source: /note="Description of Artificial Sequence: Synthetic peptide"
HTESAKICQR

SEQ ID NO: 15022 - protein, 10 aa, Artificial Sequence
  source: /note="Description of Artificial Sequence: Synthetic peptide"
TESAKICQRW

SEQ ID NO: 15023 - protein, 9 aa, Artificial Sequence
  source: /note="Description of Artificial Sequence: Synthetic peptide"
VEVFAGGRW

SEQ ID NO: 15024 - protein, 10 aa, Artificial Sequence
  source: /note="Description of Artificial Sequence: Synthetic peptide"
EVFAGGRWGT

SEQ ID NO: 15025 - protein, 9 aa, Artificial Sequence
  source: /note="Description of Artificial Sequence: Synthetic peptide"
RMHRLCATG

SEQ ID NO: 15026 - protein, 9 aa, Artificial Sequence
  source: /note="Description of Artificial Sequence: Synthetic peptide"
LRMHRLCAT

SEQ ID NO: 15027 - protein, 9 aa, Artificial Sequence
  source: /note="Description of Artificial Sequence: Synthetic peptide"
HRLCATGEW

SEQ ID NO: 15028 - protein, 10 aa, Artificial Sequence
  source: /note="Description of Artificial Sequence: Synthetic peptide"
YLRMHRLCAT

SEQ ID NO: 15029 - protein, 10 aa, Artificial Sequence
  source: /note="Description of Artificial Sequence: Synthetic peptide"
MHRLCATGEW

SEQ ID NO: 15030 - protein, 9 aa, Artificial Sequence
  source: /note="Description of Artificial Sequence: Synthetic peptide"
QLQQASLGV

SEQ ID NO: 15031 - protein, 9 aa, Artificial Sequence
  source: /note="Description of Artificial Sequence: Synthetic peptide"
LAQLQQASL

SEQ ID NO: 15032 - protein, 9 aa, Artificial Sequence
  source: /note="Description of Artificial Sequence: Synthetic peptide"
LQQASLGVN

SEQ ID NO: 15033 - protein, 10 aa, Artificial Sequence
  source: /note="Description of Artificial Sequence: Synthetic peptide"
AQLQQASLGV

SEQ ID NO: 15034 - protein, 10 aa, Artificial Sequence
  source: /note="Description of Artificial Sequence: Synthetic peptide"
NLAQLQQASL

SEQ ID NO: 15035 - protein, 10 aa, Artificial Sequence
  source: /note="Description of Artificial Sequence: Synthetic peptide"
QQASLGVNQA

SEQ ID NO: 15036 - protein, 9 aa, Artificial Sequence
  source: /note="Description of Artificial Sequence: Synthetic peptide"
KVRPLEHRK

SEQ ID NO: 15037 - protein, 9 aa, Artificial Sequence
  source: /note="Description of Artificial Sequence: Synthetic peptide"
LEHRKYMLK

SEQ ID NO: 15038 - protein, 9 aa, Artificial Sequence
  source: /note="Description of Artificial Sequence: Synthetic peptide"
RPLEHRKYM

SEQ ID NO: 15039 - protein, 9 aa, Artificial Sequence
  source: /note="Description of Artificial Sequence: Synthetic peptide"
HRKYMLKSL

SEQ ID NO: 15040 - protein, 10 aa, Artificial Sequence
  source: /note="Description of Artificial Sequence: Synthetic peptide"
KVRPLEHRKY

SEQ ID NO: 15041 - protein, 10 aa, Artificial Sequence
  source: /note="Description of Artificial Sequence: Synthetic peptide"
ETKVRPLEHR

SEQ ID NO: 15042 - protein, 10 aa, Artificial Sequence
  source: /note="Description of Artificial Sequence: Synthetic peptide"
RPLEHRKYML

SEQ ID NO: 15043 - protein, 10 aa, Artificial Sequence
  source: /note="Description of Artificial Sequence: Synthetic peptide"
EHRKYMLKSL

SEQ ID NO: 15044 - protein, 9 aa, Artificial Sequence
  source: /note="Description of Artificial Sequence: Synthetic peptide"
ATNSPAKPK

SEQ ID NO: 15045 - protein, 9 aa, Artificial Sequence
  source: /note="Description of Artificial Sequence: Synthetic peptide"
KKATNSPAK

SEQ ID NO: 15046 - protein, 10 aa, Artificial Sequence
  source: /note="Description of Artificial Sequence: Synthetic peptide"
KATNSPAKPK

SEQ ID NO: 15047 - protein, 10 aa, Artificial Sequence
  source: /note="Description of Artificial Sequence: Synthetic peptide"
ATNSPAKPKA

SEQ ID NO: 15048 - protein, 10 aa, Artificial Sequence
  source: /note="Description of Artificial Sequence: Synthetic peptide"
KPKKATNSPA

SEQ ID NO: 15049 - protein, 9 aa, Artificial Sequence
  source: /note="Description of Artificial Sequence: Synthetic peptide"
ALKKVLAAA

SEQ ID NO: 15050 - protein, 9 aa, Artificial Sequence
  source: /note="Description of Artificial Sequence: Synthetic peptide"
VLAAAGYDV

SEQ ID NO: 15051 - protein, 9 aa, Artificial Sequence
  source: /note="Description of Artificial Sequence: Synthetic peptide"
AALKKVLAA

SEQ ID NO: 15052 - protein, 9 aa, Artificial Sequence
  source: /note="Description of Artificial Sequence: Synthetic peptide"
KKVLAAAGY

SEQ ID NO: 15053 - protein, 10 aa, Artificial Sequence
  source: /note="Description of Artificial Sequence: Synthetic peptide"
KVLAAAGYDV

SEQ ID NO: 15054 - protein, 10 aa, Artificial Sequence
  source: /note="Description of Artificial Sequence: Synthetic peptide"
SLAALKKVLA

SEQ ID NO: 15055 - protein, 10 aa, Artificial Sequence
  source: /note="Description of Artificial Sequence: Synthetic peptide"
LAALKKVLAA

SEQ ID NO: 15056 - protein, 10 aa, Artificial Sequence
  source: /note="Description of Artificial Sequence: Synthetic peptide"
LKKVLAAAGY

SEQ ID NO: 15057 - protein, 9 aa, Artificial Sequence
  source: /note="Description of Artificial Sequence: Synthetic peptide"
RMKLGLKSL

SEQ ID NO: 15058 - protein, 9 aa, Artificial Sequence
  source: /note="Description of Artificial Sequence: Synthetic peptide"
NSRMKLGLK

SEQ ID NO: 15059 - protein, 9 aa, Artificial Sequence
  source: /note="Description of Artificial Sequence: Synthetic peptide"
MKLGLKSLV

SEQ ID NO: 15060 - protein, 10 aa, Artificial Sequence
  source: /note="Description of Artificial Sequence: Synthetic peptide"
RMKLGLKSLV

SEQ ID NO: 15061 - protein, 10 aa, Artificial Sequence
  source: /note="Description of Artificial Sequence: Synthetic peptide"
YDVEKNNSRM

SEQ ID NO: 15062 - protein, 10 aa, Artificial Sequence
  source: /note="Description of Artificial Sequence: Synthetic peptide"
SRMKLGLKSL

SEQ ID NO: 15063 - protein, 9 aa, Artificial Sequence
  source: /note="Description of Artificial Sequence: Synthetic peptide"
AAAAKKPKK

SEQ ID NO: 15064 - protein, 9 aa, Artificial Sequence
  source: /note="Description of Artificial Sequence: Synthetic peptide"
AAKAKKPAA

SEQ ID NO: 15065 - protein, 9 aa, Artificial Sequence
  source: /note="Description of Artificial Sequence: Synthetic peptide"
AKKPAAAAK

SEQ ID NO: 15066 - protein, 10 aa, Artificial Sequence
  source: /note="Description of Artificial Sequence: Synthetic peptide"
KAKKPAAAAK

SEQ ID NO: 15067 - protein, 10 aa, Artificial Sequence
  source: /note="Description of Artificial Sequence: Synthetic peptide"
AAKAKKPAAA

SEQ ID NO: 15068 - protein, 10 aa, Artificial Sequence
  source: /note="Description of Artificial Sequence: Synthetic peptide"
AKAKKPAAAA

SEQ ID NO: 15069 - protein, 10 aa, Artificial Sequence
  source: /note="Description of Artificial Sequence: Synthetic peptide"
KTPVKKKAPK

SEQ ID NO: 15070 - protein, 10 aa, Artificial Sequence
  source: /note="Description of Artificial Sequence: Synthetic peptide"
KAPKSAGAAK

SEQ ID NO: 15071 - protein, 10 aa, Artificial Sequence
  source: /note="Description of Artificial Sequence: Synthetic peptide"
KKAPKSAGAA

SEQ ID NO: 15072 - protein, 9 aa, Artificial Sequence
  source: /note="Description of Artificial Sequence: Synthetic peptide"
GLQFPVGPV

SEQ ID NO: 15073 - protein, 9 aa, Artificial Sequence
  source: /note="Description of Artificial Sequence: Synthetic peptide"
FPVGPVHRL

SEQ ID NO: 15074 - protein, 9 aa, Artificial Sequence
  source: /note="Description of Artificial Sequence: Synthetic peptide"
LQFPVGPVH

SEQ ID NO: 15075 - protein, 10 aa, Artificial Sequence
  source: /note="Description of Artificial Sequence: Synthetic peptide"
QFPVGPVHRL

SEQ ID NO: 15076 - protein, 10 aa, Artificial Sequence
  source: /note="Description of Artificial Sequence: Synthetic peptide"
FPVGPVHRLL

SEQ ID NO: 15077 - protein, 9 aa, Artificial Sequence
  source: /note="Description of Artificial Sequence: Synthetic peptide"
RIAGKASRL

SEQ ID NO: 15078 - protein, 9 aa, Artificial Sequence
  source: /note="Description of Artificial Sequence: Synthetic peptide"
GKASRLAHY

SEQ ID NO: 15079 - protein, 9 aa, Artificial Sequence
  source: /note="Description of Artificial Sequence: Synthetic peptide"
DIFERIAGK

SEQ ID NO: 15080 - protein, 10 aa, Artificial Sequence
  source: /note="Description of Artificial Sequence: Synthetic peptide"
RIAGKASRLA

SEQ ID NO: 15081 - protein, 10 aa, Artificial Sequence
  source: /note="Description of Artificial Sequence: Synthetic peptide"
KASRLAHYNK

SEQ ID NO: 15082 - protein, 10 aa, Artificial Sequence
  source: /note="Description of Artificial Sequence: Synthetic peptide"
AGKASRLAHY

SEQ ID NO: 15083 - protein, 10 aa, Artificial Sequence
  source: /note="Description of Artificial Sequence: Synthetic peptide"
DIFERIAGKA

SEQ ID NO: 15084 - protein, 9 aa, Artificial Sequence
  source: /note="Description of Artificial Sequence: Synthetic peptide"
RGSKKAVTK

SEQ ID NO: 15085 - protein, 9 aa, Artificial Sequence
  source: /note="Description of Artificial Sequence: Synthetic peptide"
APAPKRGSK

SEQ ID NO: 15086 - protein, 10 aa, Artificial Sequence
  source: /note="Description of Artificial Sequence: Synthetic peptide"
SAPAPKRGSK

SEQ ID NO: 15087 - protein, 10 aa, Artificial Sequence
  source: /note="Description of Artificial Sequence: Synthetic peptide"
APKRGSKKAV

SEQ ID NO: 15088 - protein, 9 aa, Artificial Sequence
  source: /note="Description of Artificial Sequence: Synthetic peptide"
RYRPGTVSL

SEQ ID NO: 15089 - protein, 9 aa, Artificial Sequence
  source: /note="Description of Artificial Sequence: Synthetic peptide"
SLREIRRYQ

SEQ ID NO: 15090 - protein, 9 aa, Artificial Sequence
  source: /note="Description of Artificial Sequence: Synthetic peptide"
VSLREIRRY

SEQ ID NO: 15091 - protein, 9 aa, Artificial Sequence
  source: /note="Description of Artificial Sequence: Synthetic peptide"
TVSLREIRR

SEQ ID NO: 15092 - protein, 9 aa, Artificial Sequence
  source: /note="Description of Artificial Sequence: Synthetic peptide"
HRYRPGTVS

SEQ ID NO: 15093 - protein, 10 aa, Artificial Sequence
  source: /note="Description of Artificial Sequence: Synthetic peptide"
SLREIRRYQK

SEQ ID NO: 15094 - protein, 10 aa, Artificial Sequence
  source: /note="Description of Artificial Sequence: Synthetic peptide"
GTVSLREIRR

SEQ ID NO: 15095 - protein, 10 aa, Artificial Sequence
  source: /note="Description of Artificial Sequence: Synthetic peptide"
RYRPGTVSLR

SEQ ID NO: 15096 - protein, 10 aa, Artificial Sequence
  source: /note="Description of Artificial Sequence: Synthetic peptide"
TVSLREIRRY

SEQ ID NO: 15097 - protein, 10 aa, Artificial Sequence
  source: /note="Description of Artificial Sequence: Synthetic peptide"
RPGTVSLREI

SEQ ID NO: 15098 - protein, 10 aa, Artificial Sequence
  source: /note="Description of Artificial Sequence: Synthetic peptide"
HRYRPGTVSL

SEQ ID NO: 15099 - protein, 9 aa, Artificial Sequence
  source: /note="Description of Artificial Sequence: Synthetic peptide"
LVRKIAQDF

SEQ ID NO: 15100 - protein, 9 aa, Artificial Sequence
  source: /note="Description of Artificial Sequence: Synthetic peptide"
FQRLVRKIA

SEQ ID NO: 15101 - protein, 10 aa, Artificial Sequence
  source: /note="Description of Artificial Sequence: Synthetic peptide"
KLPFQRLVRK

SEQ ID NO: 15102 - protein, 10 aa, Artificial Sequence
  source: /note="Description of Artificial Sequence: Synthetic peptide"
LVRKIAQDFK

SEQ ID NO: 15103 - protein, 10 aa, Artificial Sequence
  source: /note="Description of Artificial Sequence: Synthetic peptide"
LPFQRLVRKI

SEQ ID NO: 15104 - protein, 10 aa, Artificial Sequence
  source: /note="Description of Artificial Sequence: Synthetic peptide"
RLVRKIAQDF

SEQ ID NO: 15105 - protein, 9 aa, Artificial Sequence
  source: /note="Description of Artificial Sequence: Synthetic peptide"
GVMKPHRYR

SEQ ID NO: 15106 - protein, 9 aa, Artificial Sequence
  source: /note="Description of Artificial Sequence: Synthetic peptide"
VMKPHRYRP

SEQ ID NO: 15107 - protein, 10 aa, Artificial Sequence
  source: /note="Description of Artificial Sequence: Synthetic peptide"
KSAPATGGVM

SEQ ID NO: 15108 - protein, 10 aa, Artificial Sequence
  source: /note="Description of Artificial Sequence: Synthetic peptide"
VMKPHRYRPG

SEQ ID NO: 15109 - protein, 9 aa, Artificial Sequence
  source: /note="Description of Artificial Sequence: Synthetic peptide"
FLENVIPDA

SEQ ID NO: 15110 - protein, 9 aa, Artificial Sequence
  source: /note="Description of Artificial Sequence: Synthetic peptide"
VIPDAVTYT

SEQ ID NO: 15111 - protein, 9 aa, Artificial Sequence
  source: /note="Description of Artificial Sequence: Synthetic peptide"
NVIPDAVTY

SEQ ID NO: 15112 - protein, 9 aa, Artificial Sequence
  source: /note="Description of Artificial Sequence: Synthetic peptide"
LENVIPDAV

SEQ ID NO: 15113 - protein, 10 aa, Artificial Sequence
  source: /note="Description of Artificial Sequence: Synthetic peptide"
FLENVIPDAV

SEQ ID NO: 15114 - protein, 10 aa, Artificial Sequence
  source: /note="Description of Artificial Sequence: Synthetic peptide"
NVIPDAVTYT

SEQ ID NO: 15115 - protein, 10 aa, Artificial Sequence
  source: /note="Description of Artificial Sequence: Synthetic peptide"
IPDAVTYTEH

SEQ ID NO: 15116 - protein, 10 aa, Artificial Sequence
  source: /note="Description of Artificial Sequence: Synthetic peptide"
LENVIPDAVT

SEQ ID NO: 15117 - protein, 9 aa, Artificial Sequence
  source: /note="Description of Artificial Sequence: Synthetic peptide"
GLQFPVGPV

SEQ ID NO: 15118 - protein, 9 aa, Artificial Sequence
  source: /note="Description of Artificial Sequence: Synthetic peptide"
FPVGPVHRL

SEQ ID NO: 15119 - protein, 9 aa, Artificial Sequence
  source: /note="Description of Artificial Sequence: Synthetic peptide"
LQFPVGPVH

SEQ ID NO: 15120 - protein, 10 aa, Artificial Sequence
  source: /note="Description of Artificial Sequence: Synthetic peptide"
QFPVGPVHRL

SEQ ID NO: 15121 - protein, 10 aa, Artificial Sequence
  source: /note="Description of Artificial Sequence: Synthetic peptide"
FPVGPVHRLL

SEQ ID NO: 15122 - protein, 9 aa, Artificial Sequence
  source: /note="Description of Artificial Sequence: Synthetic peptide"
KQVHPDTDI

SEQ ID NO: 15123 - protein, 10 aa, Artificial Sequence
  source: /note="Description of Artificial Sequence: Synthetic peptide"
LQHPPSTAPL

SEQ ID NO: 15124 - protein, 10 aa, Artificial Sequence
  source: /note="Description of Artificial Sequence: Synthetic peptide"
HPPSTAPLCL

SEQ ID NO: 15125 - protein, 9 aa, Artificial Sequence
  source: /note="Description of Artificial Sequence: Synthetic peptide"
SMTISPTPK

SEQ ID NO: 15126 - protein, 9 aa, Artificial Sequence
  source: /note="Description of Artificial Sequence: Synthetic peptide"
STPTTPSEV

SEQ ID NO: 15127 - protein, 9 aa, Artificial Sequence
  source: /note="Description of Artificial Sequence: Synthetic peptide"
EVATPSMTI

SEQ ID NO: 15128 - protein, 9 aa, Artificial Sequence
  source: /note="Description of Artificial Sequence: Synthetic peptide"
TPSMTISPT

SEQ ID NO: 15129 - protein, 9 aa, Artificial Sequence
  source: /note="Description of Artificial Sequence: Synthetic peptide"
TPSEVATPS

SEQ ID NO: 15130 - protein, 9 aa, Artificial Sequence
  source: /note="Description of Artificial Sequence: Synthetic peptide"
SEVATPSMT

SEQ ID NO: 15131 - protein, 10 aa, Artificial Sequence
  source: /note="Description of Artificial Sequence: Synthetic peptide"
PSMTISPTPK

SEQ ID NO: 15132 - protein, 10 aa, Artificial Sequence
  source: /note="Description of Artificial Sequence: Synthetic peptide"
TPSEVATPSM

SEQ ID NO: 15133 - protein, 10 aa, Artificial Sequence
  source: /note="Description of Artificial Sequence: Synthetic peptide"
SEVATPSMTI

SEQ ID NO: 15134 - protein, 9 aa, Artificial Sequence
  source: /note="Description of Artificial Sequence: Synthetic peptide"
WIEREGPEY

SEQ ID NO: 15135 - protein, 9 aa, Artificial Sequence
  source: /note="Description of Artificial Sequence: Synthetic peptide"
IEREGPEYW

SEQ ID NO: 15136 - protein, 10 aa, Artificial Sequence
  source: /note="Description of Artificial Sequence: Synthetic peptide"
PWIEREGPEY

SEQ ID NO: 15137 - protein, 9 aa, Artificial Sequence
  source: /note="Description of Artificial Sequence: Synthetic peptide"
QTDRESLRK

SEQ ID NO: 15138 - protein, 9 aa, Artificial Sequence
  source: /note="Description of Artificial Sequence: Synthetic peptide"
SLRKLRGYY

SEQ ID NO: 15139 - protein, 9 aa, Artificial Sequence
  source: /note="Description of Artificial Sequence: Synthetic peptide"
KLRGYYNQS

SEQ ID NO: 15140 - protein, 10 aa, Artificial Sequence
  source: /note="Description of Artificial Sequence: Synthetic peptide"
SLRKLRGYYN

SEQ ID NO: 15141 - protein, 10 aa, Artificial Sequence
  source: /note="Description of Artificial Sequence: Synthetic peptide"
KLRGYYNQSE

SEQ ID NO: 15142 - protein, 10 aa, Artificial Sequence
  source: /note="Description of Artificial Sequence: Synthetic peptide"
RESLRKLRGY

SEQ ID NO: 15143 - protein, 10 aa, Artificial Sequence
  source: /note="Description of Artificial Sequence: Synthetic peptide"
ESLRKLRGYY

SEQ ID NO: 15144 - protein, 9 aa, Artificial Sequence
  source: /note="Description of Artificial Sequence: Synthetic peptide"
RLPKFADWA

SEQ ID NO: 15145 - protein, 9 aa, Artificial Sequence
  source: /note="Description of Artificial Sequence: Synthetic peptide"
NTRVPRLPK

SEQ ID NO: 15146 - protein, 9 aa, Artificial Sequence
  source: /note="Description of Artificial Sequence: Synthetic peptide"
RVPRLPKFA

SEQ ID NO: 15147 - protein, 9 aa, Artificial Sequence
  source: /note="Description of Artificial Sequence: Synthetic peptide"
TRVPRLPKF

SEQ ID NO: 15148 - protein, 9 aa, Artificial Sequence
  source: /note="Description of Artificial Sequence: Synthetic peptide"
HLLPEALLR

SEQ ID NO: 15149 - protein, 9 aa, Artificial Sequence
  source: /note="Description of Artificial Sequence: Synthetic peptide"
RGHCSHHLL

SEQ ID NO: 15150 - protein, 9 aa, Artificial Sequence
  source: /note="Description of Artificial Sequence: Synthetic peptide"
SHHLLPEAL

SEQ ID NO: 15151 - protein, 10 aa, Artificial Sequence
  source: /note="Description of Artificial Sequence: Synthetic peptide"
LENVLCGVGL

SEQ ID NO: 15152 - protein, 10 aa, Artificial Sequence
  source: /note="Description of Artificial Sequence: Synthetic peptide"
HHRGHCSHHL

SEQ ID NO: 15153 - protein, 10 aa, Artificial Sequence
  source: /note="Description of Artificial Sequence: Synthetic peptide"
CSHHLLPEAL

SEQ ID NO: 15154 - protein, 9 aa, Artificial Sequence
  source: /note="Description of Artificial Sequence: Synthetic peptide"
ELGEAHDPA

SEQ ID NO: 15155 - protein, 9 aa, Artificial Sequence
  source: /note="Description of Artificial Sequence: Synthetic peptide"
HNYELGEAH

SEQ ID NO: 15156 - protein, 10 aa, Artificial Sequence
  source: /note="Description of Artificial Sequence: Synthetic peptide"
RHNYELGEAH

SEQ ID NO: 15157 - protein, 10 aa, Artificial Sequence
  source: /note="Description of Artificial Sequence: Synthetic peptide"
YELGEAHDPA

SEQ ID NO: 15158 - protein, 9 aa, Artificial Sequence
  source: /note="Description of Artificial Sequence: Synthetic peptide"
LIIHHRGQK

SEQ ID NO: 15159 - protein, 10 aa, Artificial Sequence
  source: /note="Description of Artificial Sequence: Synthetic peptide"
GLIIHHRGQK

SEQ ID NO: 15160 - protein, 9 aa, Artificial Sequence
  source: /note="Description of Artificial Sequence: Synthetic peptide"
LIIRHRSQK

SEQ ID NO: 15161 - protein, 9 aa, Artificial Sequence
  source: /note="Description of Artificial Sequence: Synthetic peptide"
RHRSQKGPR

SEQ ID NO: 15162 - protein, 10 aa, Artificial Sequence
  source: /note="Description of Artificial Sequence: Synthetic peptide"
GLIIRHRSQK

SEQ ID NO: 15163 - protein, 9 aa, Artificial Sequence
  source: /note="Description of Artificial Sequence: Synthetic peptide"
KSSNFRRYK

SEQ ID NO: 15164 - protein, 9 aa, Artificial Sequence
  source: /note="Description of Artificial Sequence: Synthetic peptide"
RYKVLREIL

SEQ ID NO: 15165 - protein, 9 aa, Artificial Sequence
  source: /note="Description of Artificial Sequence: Synthetic peptide"
SSNFRRYKV

SEQ ID NO: 15166 - protein, 9 aa, Artificial Sequence
  source: /note="Description of Artificial Sequence: Synthetic peptide"
NFRRYKVLR

SEQ ID NO: 15167 - protein, 9 aa, Artificial Sequence
  source: /note="Description of Artificial Sequence: Synthetic peptide"
SNFRRYKVL

SEQ ID NO: 15168 - protein, 9 aa, Artificial Sequence
  source: /note="Description of Artificial Sequence: Synthetic peptide"
RRYKVLREI

SEQ ID NO: 15169 - protein, 10 aa, Artificial Sequence
  source: /note="Description of Artificial Sequence: Synthetic peptide"
KVLREILTTL

SEQ ID NO: 15170 - protein, 10 aa, Artificial Sequence
  source: /note="Description of Artificial Sequence: Synthetic peptide"
KSSNFRRYKV

SEQ ID NO: 15171 - protein, 10 aa, Artificial Sequence
  source: /note="Description of Artificial Sequence: Synthetic peptide"
SSNFRRYKVL

SEQ ID NO: 15172 - protein, 10 aa, Artificial Sequence
  source: /note="Description of Artificial Sequence: Synthetic peptide"
SNFRRYKVLR

SEQ ID NO: 15173 - protein, 10 aa, Artificial Sequence
  source: /note="Description of Artificial Sequence: Synthetic peptide"
RYKVLREILT

SEQ ID NO: 15174 - protein, 10 aa, Artificial Sequence
  source: /note="Description of Artificial Sequence: Synthetic peptide"
FRRYKVLREI

SEQ ID NO: 15175 - protein, 10 aa, Artificial Sequence
  source: /note="Description of Artificial Sequence: Synthetic peptide"
RRYKVLREIL

SEQ ID NO: 15176 - protein, 9 aa, Artificial Sequence
  source: /note="Description of Artificial Sequence: Synthetic peptide"
ATNFSLWSA

SEQ ID NO: 15177 - protein, 9 aa, Artificial Sequence
  source: /note="Description of Artificial Sequence: Synthetic peptide"
PFYATNFSL

SEQ ID NO: 15178 - protein, 9 aa, Artificial Sequence
  source: /note="Description of Artificial Sequence: Synthetic peptide"
FYATNFSLW

SEQ ID NO: 15179 - protein, 9 aa, Artificial Sequence
  source: /note="Description of Artificial Sequence: Synthetic peptide"
LAPFYATNF

SEQ ID NO: 15180 - protein, 9 aa, Artificial Sequence
  source: /note="Description of Artificial Sequence: Synthetic peptide"
TNFSLWSAA

SEQ ID NO: 15181 - protein, 10 aa, Artificial Sequence
  source: /note="Description of Artificial Sequence: Synthetic peptide"
GLAPFYATNF

SEQ ID NO: 15182 - protein, 10 aa, Artificial Sequence
  source: /note="Description of Artificial Sequence: Synthetic peptide"
PFYATNFSLW

SEQ ID NO: 15183 - protein, 10 aa, Artificial Sequence
  source: /note="Description of Artificial Sequence: Synthetic peptide"
ATNFSLWSAA

SEQ ID NO: 15184 - protein, 10 aa, Artificial Sequence
  source: /note="Description of Artificial Sequence: Synthetic peptide"
TNFSLWSAAY

SEQ ID NO: 15185 - protein, 10 aa, Artificial Sequence
  source: /note="Description of Artificial Sequence: Synthetic peptide"
YATNFSLWSA

SEQ ID NO: 15186 - protein, 10 aa, Artificial Sequence
  source: /note="Description of Artificial Sequence: Synthetic peptide"
APFYATNFSL

SEQ ID NO: 15187 - protein, 9 aa, Artificial Sequence
  source: /note="Description of Artificial Sequence: Synthetic peptide"
KEASAILSP

SEQ ID NO: 15188 - protein, 9 aa, Artificial Sequence
  source: /note="Description of Artificial Sequence: Synthetic peptide"
DPIKEASAI

SEQ ID NO: 15189 - protein, 10 aa, Artificial Sequence
  source: /note="Description of Artificial Sequence: Synthetic peptide"
QFFASLDPIK

SEQ ID NO: 15190 - protein, 10 aa, Artificial Sequence
  source: /note="Description of Artificial Sequence: Synthetic peptide"
KEASAILSPL

SEQ ID NO: 15191 - protein, 10 aa, Artificial Sequence
  source: /note="Description of Artificial Sequence: Synthetic peptide"
DPIKEASAIL

SEQ ID NO: 15192 - protein, 9 aa, Artificial Sequence
  source: /note="Description of Artificial Sequence: Synthetic peptide"
YLPGSFIYV

SEQ ID NO: 15193 - protein, 9 aa, Artificial Sequence
  source: /note="Description of Artificial Sequence: Synthetic peptide"
IYLPGSFIY

SEQ ID NO: 15194 - protein, 9 aa, Artificial Sequence
  source: /note="Description of Artificial Sequence: Synthetic peptide"
AIKIALEIY

SEQ ID NO: 15195 - protein, 9 aa, Artificial Sequence
  source: /note="Description of Artificial Sequence: Synthetic peptide"
EIYLPGSFI

SEQ ID NO: 15196 - protein, 9 aa, Artificial Sequence
  source: /note="Description of Artificial Sequence: Synthetic peptide"
LEIYLPGSF

SEQ ID NO: 15197 - protein, 9 aa, Artificial Sequence
  source: /note="Description of Artificial Sequence: Synthetic peptide"
IKIALEIYL

SEQ ID NO: 15198 - protein, 10 aa, Artificial Sequence
  source: /note="Description of Artificial Sequence: Synthetic peptide"
YLPGSFIYVF

SEQ ID NO: 15199 - protein, 10 aa, Artificial Sequence
  source: /note="Description of Artificial Sequence: Synthetic peptide"
IYLPGSFIYV

SEQ ID NO: 15200 - protein, 10 aa, Artificial Sequence
  source: /note="Description of Artificial Sequence: Synthetic peptide"
AIKIALEIYL

SEQ ID NO: 15201 - protein, 10 aa, Artificial Sequence
  source: /note="Description of Artificial Sequence: Synthetic peptide"
GAIKIALEIY

SEQ ID NO: 15202 - protein, 10 aa, Artificial Sequence
  source: /note="Description of Artificial Sequence: Synthetic peptide"
EIYLPGSFIY

SEQ ID NO: 15203 - protein, 10 aa, Artificial Sequence
  source: /note="Description of Artificial Sequence: Synthetic peptide"
ALEIYLPGSF

SEQ ID NO: 15204 - protein, 10 aa, Artificial Sequence
  source: /note="Description of Artificial Sequence: Synthetic peptide"
LEIYLPGSFI

SEQ ID NO: 15205 - protein, 9 aa, Artificial Sequence
  source: /note="Description of Artificial Sequence: Synthetic peptide"
MEFEDRNAA

SEQ ID NO: 15206 - protein, 10 aa, Artificial Sequence
  source: /note="Description of Artificial Sequence: Synthetic peptide"
MEFEDRNAAL

SEQ ID NO: 15207 - protein, 9 aa, Artificial Sequence
  source: /note="Description of Artificial Sequence: Synthetic peptide"
GLPPVSTLM

SEQ ID NO: 15208 - protein, 9 aa, Artificial Sequence
  source: /note="Description of Artificial Sequence: Synthetic peptide"
STLMNIHSL

SEQ ID NO: 15209 - protein, 9 aa, Artificial Sequence
  source: /note="Description of Artificial Sequence: Synthetic peptide"
LMNIHSLSH

SEQ ID NO: 15210 - protein, 9 aa, Artificial Sequence
  source: /note="Description of Artificial Sequence: Synthetic peptide"
MNIHSLSHH

SEQ ID NO: 15211 - protein, 9 aa, Artificial Sequence
  source: /note="Description of Artificial Sequence: Synthetic peptide"
PPVSTLMNI

SEQ ID NO: 15212 - protein, 10 aa, Artificial Sequence
  source: /note="Description of Artificial Sequence: Synthetic peptide"
TLMNIHSLSH

SEQ ID NO: 15213 - protein, 10 aa, Artificial Sequence
  source: /note="Description of Artificial Sequence: Synthetic peptide"
LMNIHSLSHH

SEQ ID NO: 15214 - protein, 10 aa, Artificial Sequence
  source: /note="Description of Artificial Sequence: Synthetic peptide"
GGLPPVSTLM

SEQ ID NO: 15215 - protein, 10 aa, Artificial Sequence
  source: /note="Description of Artificial Sequence: Synthetic peptide"
LPPVSTLMNI

SEQ ID NO: 15216 - protein, 9 aa, Artificial Sequence
  source: /note="Description of Artificial Sequence: Synthetic peptide"
RVYNWFAKR

SEQ ID NO: 15217 - protein, 9 aa, Artificial Sequence
  source: /note="Description of Artificial Sequence: Synthetic peptide"
VYNWFAKRR

SEQ ID NO: 15218 - protein, 9 aa, Artificial Sequence
  source: /note="Description of Artificial Sequence: Synthetic peptide"
FAKRRKEEA

SEQ ID NO: 15219 - protein, 9 aa, Artificial Sequence
  source: /note="Description of Artificial Sequence: Synthetic peptide"
AKRRKEEAF

SEQ ID NO: 15220 - protein, 10 aa, Artificial Sequence
  source: /note="Description of Artificial Sequence: Synthetic peptide"
RVYNWFAKRR

SEQ ID NO: 15221 - protein, 10 aa, Artificial Sequence
  source: /note="Description of Artificial Sequence: Synthetic peptide"
EVRVYNWFAK

SEQ ID NO: 15222 - protein, 10 aa, Artificial Sequence
  source: /note="Description of Artificial Sequence: Synthetic peptide"
WFAKRRKEEA

SEQ ID NO: 15223 - protein, 10 aa, Artificial Sequence
  source: /note="Description of Artificial Sequence: Synthetic peptide"
FAKRRKEEAF

SEQ ID NO: 15224 - protein, 9 aa, Artificial Sequence
  source: /note="Description of Artificial Sequence: Synthetic peptide"
LEEELKKQM

SEQ ID NO: 15225 - protein, 9 aa, Artificial Sequence
  source: /note="Description of Artificial Sequence: Synthetic peptide"
LKKQMQHVH

SEQ ID NO: 15226 - protein, 10 aa, Artificial Sequence
  source: /note="Description of Artificial Sequence: Synthetic peptide"
EELKKQMQHV

SEQ ID NO: 15227 - protein, 9 aa, Artificial Sequence
  source: /note="Description of Artificial Sequence: Synthetic peptide"
FVNSFCCRY

SEQ ID NO: 15228 - protein, 9 aa, Artificial Sequence
  source: /note="Description of Artificial Sequence: Synthetic peptide"
CRYPNGPDY

SEQ ID NO: 15229 - protein, 9 aa, Artificial Sequence
  source: /note="Description of Artificial Sequence: Synthetic peptide"
YFVNSFCCR

SEQ ID NO: 15230 - protein, 10 aa, Artificial Sequence
  source: /note="Description of Artificial Sequence: Synthetic peptide"
YFVNSFCCRY

SEQ ID NO: 15231 - protein, 10 aa, Artificial Sequence
  source: /note="Description of Artificial Sequence: Synthetic peptide"
CCRYPNGPDY

SEQ ID NO: 15232 - protein, 10 aa, Artificial Sequence
  source: /note="Description of Artificial Sequence: Synthetic peptide"
SYFVNSFCCR

SEQ ID NO: 15233 - protein, 9 aa, Artificial Sequence
  source: /note="Description of Artificial Sequence: Synthetic peptide"
CFRLSQTYA

SEQ ID NO: 15234 - protein, 9 aa, Artificial Sequence
  source: /note="Description of Artificial Sequence: Synthetic peptide"
EVPVPGCFR

SEQ ID NO: 15235 - protein, 9 aa, Artificial Sequence
  source: /note="Description of Artificial Sequence: Synthetic peptide"
VPVPGCFRL

SEQ ID NO: 15236 - protein, 9 aa, Artificial Sequence
  source: /note="Description of Artificial Sequence: Synthetic peptide"
GCFRLSQTY

SEQ ID NO: 15237 - protein, 10 aa, Artificial Sequence
  source: /note="Description of Artificial Sequence: Synthetic peptide"
EVPVPGCFRL

SEQ ID NO: 15238 - protein, 10 aa, Artificial Sequence
  source: /note="Description of Artificial Sequence: Synthetic peptide"
NPEVPVPGCF

SEQ ID NO: 15239 - protein, 9 aa, Artificial Sequence
  source: /note="Description of Artificial Sequence: Synthetic peptide"
FPHAPPHAH

SEQ ID NO: 15240 - protein, 9 aa, Artificial Sequence
  source: /note="Description of Artificial Sequence: Synthetic peptide"
AGFPHAPPH

SEQ ID NO: 15241 - protein, 10 aa, Artificial Sequence
  source: /note="Description of Artificial Sequence: Synthetic peptide"
AGFPHAPPHA

SEQ ID NO: 15242 - protein, 10 aa, Artificial Sequence
  source: /note="Description of Artificial Sequence: Synthetic peptide"
FPHAPPHAHA

SEQ ID NO: 15243 - protein, 9 aa, Artificial Sequence
  source: /note="Description of Artificial Sequence: Synthetic peptide"
FTDTITYRD

SEQ ID NO: 15244 - protein, 9 aa, Artificial Sequence
  source: /note="Description of Artificial Sequence: Synthetic peptide"
RSFTDTITY

SEQ ID NO: 15245 - protein, 9 aa, Artificial Sequence
  source: /note="Description of Artificial Sequence: Synthetic peptide"
KRPSWYNIL

SEQ ID NO: 15246 - protein, 9 aa, Artificial Sequence
  source: /note="Description of Artificial Sequence: Synthetic peptide"
ITYRDSRFL

SEQ ID NO: 15247 - protein, 9 aa, Artificial Sequence
  source: /note="Description of Artificial Sequence: Synthetic peptide"
TYRDSRFLR

SEQ ID NO: 15248 - protein, 9 aa, Artificial Sequence
  source: /note="Description of Artificial Sequence: Synthetic peptide"
DSRFLRPSK

SEQ ID NO: 15249 - protein, 9 aa, Artificial Sequence
  source: /note="Description of Artificial Sequence: Synthetic peptide"
SFTDTITYR

SEQ ID NO: 15250 - protein, 9 aa, Artificial Sequence
  source: /note="Description of Artificial Sequence: Synthetic peptide"
DTITYRDSR

SEQ ID NO: 15251 - protein, 9 aa, Artificial Sequence
  source: /note="Description of Artificial Sequence: Synthetic peptide"
WYNILTVNR

SEQ ID NO: 15252 - protein, 9 aa, Artificial Sequence
  source: /note="Description of Artificial Sequence: Synthetic peptide"
NILTVNRPV

SEQ ID NO: 15253 - protein, 9 aa, Artificial Sequence
  source: /note="Description of Artificial Sequence: Synthetic peptide"
TVNRPVVIL

SEQ ID NO: 15254 - protein, 9 aa, Artificial Sequence
  source: /note="Description of Artificial Sequence: Synthetic peptide"
SPRSFTDTI

SEQ ID NO: 15255 - protein, 9 aa, Artificial Sequence
  source: /note="Description of Artificial Sequence: Synthetic peptide"
RPSKRPSWY

SEQ ID NO: 15256 - protein, 9 aa, Artificial Sequence
  source: /note="Description of Artificial Sequence: Synthetic peptide"
SKRPSWYNI

SEQ ID NO: 15257 - protein, 10 aa, Artificial Sequence
  source: /note="Description of Artificial Sequence: Synthetic peptide"
RSFTDTITYR

SEQ ID NO: 15258 - protein, 10 aa, Artificial Sequence
  source: /note="Description of Artificial Sequence: Synthetic peptide"
ITYRDSRFLR

SEQ ID NO: 15259 - protein, 10 aa, Artificial Sequence
  source: /note="Description of Artificial Sequence: Synthetic peptide"
RDSRFLRPSK

SEQ ID NO: 15260 - protein, 10 aa, Artificial Sequence
  source: /note="Description of Artificial Sequence: Synthetic peptide"
RFLRPSKRPS

SEQ ID NO: 15261 - protein, 10 aa, Artificial Sequence
  source: /note="Description of Artificial Sequence: Synthetic peptide"
VNRPVVILAR

SEQ ID NO: 15262 - protein, 10 aa, Artificial Sequence
  source: /note="Description of Artificial Sequence: Synthetic peptide"
DSRFLRPSKR

SEQ ID NO: 15263 - protein, 10 aa, Artificial Sequence
  source: /note="Description of Artificial Sequence: Synthetic peptide"
SWYNILTVNR

SEQ ID NO: 15264 - protein, 10 aa, Artificial Sequence
  source: /note="Description of Artificial Sequence: Synthetic peptide"
TVNRPVVILA

SEQ ID NO: 15265 - protein, 10 aa, Artificial Sequence
  source: /note="Description of Artificial Sequence: Synthetic peptide"
LPVTGSPRSF

SEQ ID NO: 15266 - protein, 10 aa, Artificial Sequence
  source: /note="Description of Artificial Sequence: Synthetic peptide"
SPRSFTDTIT

SEQ ID NO: 15267 - protein, 10 aa, Artificial Sequence
  source: /note="Description of Artificial Sequence: Synthetic peptide"
RPSWYNILTV

SEQ ID NO: 15268 - protein, 10 aa, Artificial Sequence
  source: /note="Description of Artificial Sequence: Synthetic peptide"
FLRPSKRPSW

SEQ ID NO: 15269 - protein, 10 aa, Artificial Sequence
  source: /note="Description of Artificial Sequence: Synthetic peptide"
SKRPSWYNIL

SEQ ID NO: 15270 - protein, 10 aa, Artificial Sequence
  source: /note="Description of Artificial Sequence: Synthetic peptide"
YNILTVNRPV

SEQ ID NO: 15271 - protein, 9 aa, Artificial Sequence
  source: /note="Description of Artificial Sequence: Synthetic peptide"
GVLICSLHV

SEQ ID NO: 15272 - protein, 9 aa, Artificial Sequence
  source: /note="Description of Artificial Sequence: Synthetic peptide"
VLICSLHVL

SEQ ID NO: 15273 - protein, 9 aa, Artificial Sequence
  source: /note="Description of Artificial Sequence: Synthetic peptide"
SLHVLQTTA

SEQ ID NO: 15274 - protein, 9 aa, Artificial Sequence
  source: /note="Description of Artificial Sequence: Synthetic peptide"
VLQTTAGEA

SEQ ID NO: 15275 - protein, 9 aa, Artificial Sequence
  source: /note="Description of Artificial Sequence: Synthetic peptide"
HLRERPGVL

SEQ ID NO: 15276 - protein, 9 aa, Artificial Sequence
  source: /note="Description of Artificial Sequence: Synthetic peptide"
RPGVLICSL

SEQ ID NO: 15277 - protein, 9 aa, Artificial Sequence
  source: /note="Description of Artificial Sequence: Synthetic peptide"
RERPGVLIC

SEQ ID NO: 15278 - protein, 10 aa, Artificial Sequence
  source: /note="Description of Artificial Sequence: Synthetic peptide"
HLRERPGVLI

SEQ ID NO: 15279 - protein, 10 aa, Artificial Sequence
  source: /note="Description of Artificial Sequence: Synthetic peptide"
RHLRERPGVL

SEQ ID NO: 15280 - protein, 10 aa, Artificial Sequence
  source: /note="Description of Artificial Sequence: Synthetic peptide"
RERPGVLICS

SEQ ID NO: 15281 - protein, 9 aa, Artificial Sequence
  source: /note="Description of Artificial Sequence: Synthetic peptide"
LLLRKDTSV

SEQ ID NO: 15282 - protein, 9 aa, Artificial Sequence
  source: /note="Description of Artificial Sequence: Synthetic peptide"
LLRKDTSVK

SEQ ID NO: 15283 - protein, 9 aa, Artificial Sequence
  source: /note="Description of Artificial Sequence: Synthetic peptide"
RQSPKRLLL

SEQ ID NO: 15284 - protein, 10 aa, Artificial Sequence
  source: /note="Description of Artificial Sequence: Synthetic peptide"
RLLLRKDTSV

SEQ ID NO: 15285 - protein, 10 aa, Artificial Sequence
  source: /note="Description of Artificial Sequence: Synthetic peptide"
LLRKDTSVKI

SEQ ID NO: 15286 - protein, 10 aa, Artificial Sequence
  source: /note="Description of Artificial Sequence: Synthetic peptide"
LLLRKDTSVK

SEQ ID NO: 15287 - protein, 10 aa, Artificial Sequence
  source: /note="Description of Artificial Sequence: Synthetic peptide"
RQSPKRLLLR

SEQ ID NO: 15288 - protein, 10 aa, Artificial Sequence
  source: /note="Description of Artificial Sequence: Synthetic peptide"
QSPKRLLLRK

SEQ ID NO: 15289 - protein, 10 aa, Artificial Sequence
  source: /note="Description of Artificial Sequence: Synthetic peptide"
RRQSPKRLLL

SEQ ID NO: 15290 - protein, 9 aa, Artificial Sequence
  source: /note="Description of Artificial Sequence: Synthetic peptide"
QYIWRLSNR

SEQ ID NO: 15291 - protein, 9 aa, Artificial Sequence
  source: /note="Description of Artificial Sequence: Synthetic peptide"
SQYIWRLSN

SEQ ID NO: 15292 - protein, 10 aa, Artificial Sequence
  source: /note="Description of Artificial Sequence: Synthetic peptide"
SQYIWRLSNR

SEQ ID NO: 15293 - protein, 10 aa, Artificial Sequence
  source: /note="Description of Artificial Sequence: Synthetic peptide"
NRQPPDTTPL

SEQ ID NO: 15294 - protein, 9 aa, Artificial Sequence
  source: /note="Description of Artificial Sequence: Synthetic peptide"
GLKENTLIL

SEQ ID NO: 15295 - protein, 9 aa, Artificial Sequence
  source: /note="Description of Artificial Sequence: Synthetic peptide"
LKENTLILL

SEQ ID NO: 15296 - protein, 10 aa, Artificial Sequence
  source: /note="Description of Artificial Sequence: Synthetic peptide"
GLKENTLILL

SEQ ID NO: 15297 - protein, 10 aa, Artificial Sequence
  source: /note="Description of Artificial Sequence: Synthetic peptide"
RAAGLKENTL

SEQ ID NO: 15298 - protein, 10 aa, Artificial Sequence
  source: /note="Description of Artificial Sequence: Synthetic peptide"
KENTLILLDV

SEQ ID NO: 15299 - protein, 9 aa, Artificial Sequence
  source: /note="Description of Artificial Sequence: Synthetic peptide"
LDTAGKEEY

SEQ ID NO: 15300 - protein, 9 aa, Artificial Sequence
  source: /note="Description of Artificial Sequence: Synthetic peptide"
AGKEEYSAM

SEQ ID NO: 15301 - protein, 10 aa, Artificial Sequence
  source: /note="Description of Artificial Sequence: Synthetic peptide"
ILDTAGKEEY

SEQ ID NO: 15302 - protein, 10 aa, Artificial Sequence
  source: /note="Description of Artificial Sequence: Synthetic peptide"
DTAGKEEYSA

SEQ ID NO: 15303 - protein, 9 aa, Artificial Sequence
  source: /note="Description of Artificial Sequence: Synthetic peptide"
LDTAGREEY

SEQ ID NO: 15304 - protein, 9 aa, Artificial Sequence
  source: /note="Description of Artificial Sequence: Synthetic peptide"
AGREEYSAM

SEQ ID NO: 15305 - protein, 10 aa, Artificial Sequence
  source: /note="Description of Artificial Sequence: Synthetic peptide"
ILDTAGREEY

SEQ ID NO: 15306 - protein, 10 aa, Artificial Sequence
  source: /note="Description of Artificial Sequence: Synthetic peptide"
AGREEYSAMR

SEQ ID NO: 15307 - protein, 10 aa, Artificial Sequence
  source: /note="Description of Artificial Sequence: Synthetic peptide"
DTAGREEYSA

SEQ ID NO: 15308 - protein, 9 aa, Artificial Sequence
  source: /note="Description of Artificial Sequence: Synthetic peptide"
LVVVGASGV

SEQ ID NO: 15309 - protein, 10 aa, Artificial Sequence
  source: /note="Description of Artificial Sequence: Synthetic peptide"
KLVVVGASGV

SEQ ID NO: 15310 - protein, 10 aa, Artificial Sequence
  source: /note="Description of Artificial Sequence: Synthetic peptide"
YKLVVVGASG

SEQ ID NO: 15311 - protein, 9 aa, Artificial Sequence
  source: /note="Description of Artificial Sequence: Synthetic peptide"
LVVVGADGV

SEQ ID NO: 15312 - protein, 9 aa, Artificial Sequence
  source: /note="Description of Artificial Sequence: Synthetic peptide"
VVGADGVGK

SEQ ID NO: 15313 - protein, 10 aa, Artificial Sequence
  source: /note="Description of Artificial Sequence: Synthetic peptide"
KLVVVGADGV

SEQ ID NO: 15314 - protein, 10 aa, Artificial Sequence
  source: /note="Description of Artificial Sequence: Synthetic peptide"
VVVGADGVGK

SEQ ID NO: 15315 - protein, 9 aa, Artificial Sequence
  source: /note="Description of Artificial Sequence: Synthetic peptide"
LVVVGAAGV

SEQ ID NO: 15316 - protein, 9 aa, Artificial Sequence
  source: /note="Description of Artificial Sequence: Synthetic peptide"
VVGAAGVGK

SEQ ID NO: 15317 - protein, 9 aa, Artificial Sequence
  source: /note="Description of Artificial Sequence: Synthetic peptide"
YKLVVVGAA

SEQ ID NO: 15318 - protein, 10 aa, Artificial Sequence
  source: /note="Description of Artificial Sequence: Synthetic peptide"
KLVVVGAAGV

SEQ ID NO: 15319 - protein, 10 aa, Artificial Sequence
  source: /note="Description of Artificial Sequence: Synthetic peptide"
VVVGAAGVGK

SEQ ID NO: 15320 - protein, 10 aa, Artificial Sequence
  source: /note="Description of Artificial Sequence: Synthetic peptide"
YKLVVVGAAG

SEQ ID NO: 15321 - protein, 10 aa, Artificial Sequence
  source: /note="Description of Artificial Sequence: Synthetic peptide"
GAAGVGKSAL

SEQ ID NO: 15322 - protein, 9 aa, Artificial Sequence
  source: /note="Description of Artificial Sequence: Synthetic peptide"
KLVVVGAGV

SEQ ID NO: 15323 - protein, 9 aa, Artificial Sequence
  source: /note="Description of Artificial Sequence: Synthetic peptide"
VVGAGVVGK

SEQ ID NO: 15324 - protein, 10 aa, Artificial Sequence
  source: /note="Description of Artificial Sequence: Synthetic peptide"
KLVVVGAGVV

SEQ ID NO: 15325 - protein, 10 aa, Artificial Sequence
  source: /note="Description of Artificial Sequence: Synthetic peptide"
VVVGAGVVGK

SEQ ID NO: 15326 - protein, 10 aa, Artificial Sequence
  source: /note="Description of Artificial Sequence: Synthetic peptide"
YKLVVVGAGV

SEQ ID NO: 15327 - protein, 9 aa, Artificial Sequence
  source: /note="Description of Artificial Sequence: Synthetic peptide"
HQAPQPQAK

SEQ ID NO: 15328 - protein, 9 aa, Artificial Sequence
  source: /note="Description of Artificial Sequence: Synthetic peptide"
AELGHQAPQ

SEQ ID NO: 15329 - protein, 9 aa, Artificial Sequence
  source: /note="Description of Artificial Sequence: Synthetic peptide"
GLHHHHPPR

SEQ ID NO: 15330 - protein, 9 aa, Artificial Sequence
  source: /note="Description of Artificial Sequence: Synthetic peptide"
PPRHTPHHL

SEQ ID NO: 15331 - protein, 10 aa, Artificial Sequence
  source: /note="Description of Artificial Sequence: Synthetic peptide"
VGLHHHHPPR

SEQ ID NO: 15332 - protein, 10 aa, Artificial Sequence
  source: /note="Description of Artificial Sequence: Synthetic peptide"
HPPRHTPHHL

SEQ ID NO: 15333 - protein, 10 aa, Artificial Sequence
  source: /note="Description of Artificial Sequence: Synthetic peptide"
HHHPPRHTPH

SEQ ID NO: 15334 - protein, 9 aa, Artificial Sequence
  source: /note="Description of Artificial Sequence: Synthetic peptide"
NMPPSMGSM

SEQ ID NO: 15335 - protein, 9 aa, Artificial Sequence
  source: /note="Description of Artificial Sequence: Synthetic peptide"
SYKASSLSS

SEQ ID NO: 15336 - protein, 9 aa, Artificial Sequence
  source: /note="Description of Artificial Sequence: Synthetic peptide"
KASSLSSMF

SEQ ID NO: 15337 - protein, 9 aa, Artificial Sequence
  source: /note="Description of Artificial Sequence: Synthetic peptide"
MPPSMGSMI

SEQ ID NO: 15338 - protein, 9 aa, Artificial Sequence
  source: /note="Description of Artificial Sequence: Synthetic peptide"
LNSYKASSL

SEQ ID NO: 15339 - protein, 9 aa, Artificial Sequence
  source: /note="Description of Artificial Sequence: Synthetic peptide"
YKASSLSSM

SEQ ID NO: 15340 - protein, 9 aa, Artificial Sequence
  source: /note="Description of Artificial Sequence: Synthetic peptide"
LSSMFSTNM

SEQ ID NO: 15341 - protein, 9 aa, Artificial Sequence
  source: /note="Description of Artificial Sequence: Synthetic peptide"
FSTNMPPSM

SEQ ID NO: 15342 - protein, 9 aa, Artificial Sequence
  source: /note="Description of Artificial Sequence: Synthetic peptide"
SMFSTNMPP

SEQ ID NO: 15343 - protein, 10 aa, Artificial Sequence
  source: /note="Description of Artificial Sequence: Synthetic peptide"
SLSSMFSTNM

SEQ ID NO: 15344 - protein, 10 aa, Artificial Sequence
  source: /note="Description of Artificial Sequence: Synthetic peptide"
CLNSYKASSL

SEQ ID NO: 15345 - protein, 10 aa, Artificial Sequence
  source: /note="Description of Artificial Sequence: Synthetic peptide"
SMFSTNMPPS

SEQ ID NO: 15346 - protein, 10 aa, Artificial Sequence
  source: /note="Description of Artificial Sequence: Synthetic peptide"
NMPPSMGSMI

SEQ ID NO: 15347 - protein, 10 aa, Artificial Sequence
  source: /note="Description of Artificial Sequence: Synthetic peptide"
SYKASSLSSM

SEQ ID NO: 15348 - protein, 10 aa, Artificial Sequence
  source: /note="Description of Artificial Sequence: Synthetic peptide"
KASSLSSMFS

SEQ ID NO: 15349 - protein, 10 aa, Artificial Sequence
  source: /note="Description of Artificial Sequence: Synthetic peptide"
YKASSLSSMF

SEQ ID NO: 15350 - protein, 10 aa, Artificial Sequence
  source: /note="Description of Artificial Sequence: Synthetic peptide"
MFSTNMPPSM

SEQ ID NO: 15351 - protein, 10 aa, Artificial Sequence
  source: /note="Description of Artificial Sequence: Synthetic peptide"
TNMPPSMGSM

SEQ ID NO: 15352 - protein, 9 aa, Artificial Sequence
  source: /note="Description of Artificial Sequence: Synthetic peptide"
HSQRGSGSR

SEQ ID NO: 15353 - protein, 9 aa, Artificial Sequence
  source: /note="Description of Artificial Sequence: Synthetic peptide"
SQIEIEAVA

SEQ ID NO: 15354 - protein, 9 aa, Artificial Sequence
  source: /note="Description of Artificial Sequence: Synthetic peptide"
LPKGSQIEI

SEQ ID NO: 15355 - protein, 9 aa, Artificial Sequence
  source: /note="Description of Artificial Sequence: Synthetic peptide"
AALPKGSQI

SEQ ID NO: 15356 - protein, 10 aa, Artificial Sequence
  source: /note="Description of Artificial Sequence: Synthetic peptide"
SQIEIEAVAI

SEQ ID NO: 15357 - protein, 10 aa, Artificial Sequence
  source: /note="Description of Artificial Sequence: Synthetic peptide"
ALPKGSQIEI

SEQ ID NO: 15358 - protein, 9 aa, Artificial Sequence
  source: /note="Description of Artificial Sequence: Synthetic peptide"
KLLNKLHKY

SEQ ID NO: 15359 - protein, 9 aa, Artificial Sequence
  source: /note="Description of Artificial Sequence: Synthetic peptide"
HKYFHEPNK

SEQ ID NO: 15360 - protein, 9 aa, Artificial Sequence
  source: /note="Description of Artificial Sequence: Synthetic peptide"
LLNKLHKYF

SEQ ID NO: 15361 - protein, 10 aa, Artificial Sequence
  source: /note="Description of Artificial Sequence: Synthetic peptide"
KLLNKLHKYF

SEQ ID NO: 15362 - protein, 10 aa, Artificial Sequence
  source: /note="Description of Artificial Sequence: Synthetic peptide"
KYFHEPNKKF

SEQ ID NO: 15363 - protein, 10 aa, Artificial Sequence
  source: /note="Description of Artificial Sequence: Synthetic peptide"
LHKYFHEPNK

SEQ ID NO: 15364 - protein, 9 aa, Artificial Sequence
  source: /note="Description of Artificial Sequence: Synthetic peptide"
FYQMTWHDF

SEQ ID NO: 15365 - protein, 9 aa, Artificial Sequence
  source: /note="Description of Artificial Sequence: Synthetic peptide"
NLKFYQMTW

SEQ ID NO: 15366 - protein, 9 aa, Artificial Sequence
  source: /note="Description of Artificial Sequence: Synthetic peptide"
LKFYQMTWH

SEQ ID NO: 15367 - protein, 9 aa, Artificial Sequence
  source: /note="Description of Artificial Sequence: Synthetic peptide"
YQMTWHDFG

SEQ ID NO: 15368 - protein, 9 aa, Artificial Sequence
  source: /note="Description of Artificial Sequence: Synthetic peptide"
QMTWHDFGW

SEQ ID NO: 15369 - protein, 10 aa, Artificial Sequence
  source: /note="Description of Artificial Sequence: Synthetic peptide"
FNLKFYQMTW

SEQ ID NO: 15370 - protein, 10 aa, Artificial Sequence
  source: /note="Description of Artificial Sequence: Synthetic peptide"
KFYQMTWHDF

SEQ ID NO: 15371 - protein, 10 aa, Artificial Sequence
  source: /note="Description of Artificial Sequence: Synthetic peptide"
YQMTWHDFGW

SEQ ID NO: 15372 - protein, 9 aa, Artificial Sequence
  source: /note="Description of Artificial Sequence: Synthetic peptide"
AEDEAGRSA

SEQ ID NO: 15373 - protein, 9 aa, Artificial Sequence
  source: /note="Description of Artificial Sequence: Synthetic peptide"
RSAVGDPEL

SEQ ID NO: 15374 - protein, 10 aa, Artificial Sequence
  source: /note="Description of Artificial Sequence: Synthetic peptide"
AEDEAGRSAV

SEQ ID NO: 15375 - protein, 10 aa, Artificial Sequence
  source: /note="Description of Artificial Sequence: Synthetic peptide"
GRSAVGDPEL

SEQ ID NO: 15376 - protein, 9 aa, Artificial Sequence
  source: /note="Description of Artificial Sequence: Synthetic peptide"
YLRTGMTNM

SEQ ID NO: 15377 - protein, 9 aa, Artificial Sequence
  source: /note="Description of Artificial Sequence: Synthetic peptide"
SIVEPGYLR

SEQ ID NO: 15378 - protein, 10 aa, Artificial Sequence
  source: /note="Description of Artificial Sequence: Synthetic peptide"
YLRTGMTNMT

SEQ ID NO: 15379 - protein, 10 aa, Artificial Sequence
  source: /note="Description of Artificial Sequence: Synthetic peptide"
ISIVEPGYLR

SEQ ID NO: 15380 - protein, 10 aa, Artificial Sequence
  source: /note="Description of Artificial Sequence: Synthetic peptide"
GYLRTGMTNM

SEQ ID NO: 15381 - protein, 10 aa, Artificial Sequence
  source: /note="Description of Artificial Sequence: Synthetic peptide"
VEPGYLRTGM

SEQ ID NO: 15382 - protein, 9 aa, Artificial Sequence
  source: /note="Description of Artificial Sequence: Synthetic peptide"
ILWWEVVTL

SEQ ID NO: 15383 - protein, 9 aa, Artificial Sequence
  source: /note="Description of Artificial Sequence: Synthetic peptide"
RQQNEILWW

SEQ ID NO: 15384 - protein, 9 aa, Artificial Sequence
  source: /note="Description of Artificial Sequence: Synthetic peptide"
LWWEVVTLR

SEQ ID NO: 15385 - protein, 9 aa, Artificial Sequence
  source: /note="Description of Artificial Sequence: Synthetic peptide"
NEILWWEVV

SEQ ID NO: 15386 - protein, 9 aa, Artificial Sequence
  source: /note="Description of Artificial Sequence: Synthetic peptide"
WEVVTLRQS

SEQ ID NO: 15387 - protein, 10 aa, Artificial Sequence
  source: /note="Description of Artificial Sequence: Synthetic peptide"
QQNEILWWEV

SEQ ID NO: 15388 - protein, 10 aa, Artificial Sequence
  source: /note="Description of Artificial Sequence: Synthetic peptide"
ILWWEVVTLR

SEQ ID NO: 15389 - protein, 10 aa, Artificial Sequence
  source: /note="Description of Artificial Sequence: Synthetic peptide"
EILWWEVVTL

SEQ ID NO: 15390 - protein, 10 aa, Artificial Sequence
  source: /note="Description of Artificial Sequence: Synthetic peptide"
WEVVTLRQSH

SEQ ID NO: 15391 - protein, 10 aa, Artificial Sequence
  source: /note="Description of Artificial Sequence: Synthetic peptide"
NEILWWEVVT

SEQ ID NO: 15392 - protein, 9 aa, Artificial Sequence
  source: /note="Description of Artificial Sequence: Synthetic peptide"
DVYVGYESL

SEQ ID NO: 15393 - protein, 10 aa, Artificial Sequence
  source: /note="Description of Artificial Sequence: Synthetic peptide"
YVGYESLELA

SEQ ID NO: 15394 - protein, 10 aa, Artificial Sequence
  source: /note="Description of Artificial Sequence: Synthetic peptide"
VYVGYESLEL

SEQ ID NO: 15395 - protein, 9 aa, Artificial Sequence
  source: /note="Description of Artificial Sequence: Synthetic peptide"
KVKVKVCVN

SEQ ID NO: 15396 - protein, 9 aa, Artificial Sequence
  source: /note="Description of Artificial Sequence: Synthetic peptide"
KVKVCVNIH

SEQ ID NO: 15397 - protein, 9 aa, Artificial Sequence
  source: /note="Description of Artificial Sequence: Synthetic peptide"
VCVNIHGIF

SEQ ID NO: 15398 - protein, 10 aa, Artificial Sequence
  source: /note="Description of Artificial Sequence: Synthetic peptide"
CVNIHGIFSV

SEQ ID NO: 15399 - protein, 10 aa, Artificial Sequence
  source: /note="Description of Artificial Sequence: Synthetic peptide"
SSKVKVKVCV

SEQ ID NO: 15400 - protein, 10 aa, Artificial Sequence
  source: /note="Description of Artificial Sequence: Synthetic peptide"
KVKVKVCVNI

SEQ ID NO: 15401 - protein, 10 aa, Artificial Sequence
  source: /note="Description of Artificial Sequence: Synthetic peptide"
KVKVCVNIHG

SEQ ID NO: 15402 - protein, 10 aa, Artificial Sequence
  source: /note="Description of Artificial Sequence: Synthetic peptide"
VKVCVNIHGI

SEQ ID NO: 15403 - protein, 10 aa, Artificial Sequence
  source: /note="Description of Artificial Sequence: Synthetic peptide"
KVCVNIHGIF

SEQ ID NO: 15404 - protein, 9 aa, Artificial Sequence
  source: /note="Description of Artificial Sequence: Synthetic peptide"
HLALVEEAI

SEQ ID NO: 15405 - protein, 9 aa, Artificial Sequence
  source: /note="Description of Artificial Sequence: Synthetic peptide"
LEEDHLALV

SEQ ID NO: 15406 - protein, 10 aa, Artificial Sequence
  source: /note="Description of Artificial Sequence: Synthetic peptide"
ALVEEAITRM

SEQ ID NO: 15407 - protein, 10 aa, Artificial Sequence
  source: /note="Description of Artificial Sequence: Synthetic peptide"
IELEEDHLAL

SEQ ID NO: 15408 - protein, 9 aa, Artificial Sequence
  source: /note="Description of Artificial Sequence: Synthetic peptide"
LQDDLKVFK

SEQ ID NO: 15409 - protein, 9 aa, Artificial Sequence
  source: /note="Description of Artificial Sequence: Synthetic peptide"
GLQDDLKVF

SEQ ID NO: 15410 - protein, 10 aa, Artificial Sequence
  source: /note="Description of Artificial Sequence: Synthetic peptide"
PVFGLQDDLK

SEQ ID NO: 15411 - protein, 10 aa, Artificial Sequence
  source: /note="Description of Artificial Sequence: Synthetic peptide"
GLQDDLKVFK

SEQ ID NO: 15412 - protein, 10 aa, Artificial Sequence
  source: /note="Description of Artificial Sequence: Synthetic peptide"
IPVFGLQDDL

SEQ ID NO: 15413 - protein, 10 aa, Artificial Sequence
  source: /note="Description of Artificial Sequence: Synthetic peptide"
FGLQDDLKVF

SEQ ID NO: 15414 - protein, 10 aa, Artificial Sequence
  source: /note="Description of Artificial Sequence: Synthetic peptide"
LKVFKEGSCL

SEQ ID NO: 15415 - protein, 9 aa, Artificial Sequence
  source: /note="Description of Artificial Sequence: Synthetic peptide"
VVMCRHPLV

SEQ ID NO: 15416 - protein, 9 aa, Artificial Sequence
  source: /note="Description of Artificial Sequence: Synthetic peptide"
IQFNVVMCR

SEQ ID NO: 15417 - protein, 9 aa, Artificial Sequence
  source: /note="Description of Artificial Sequence: Synthetic peptide"
VMCRHPLVY

SEQ ID NO: 15418 - protein, 9 aa, Artificial Sequence
  source: /note="Description of Artificial Sequence: Synthetic peptide"
MCRHPLVYV

SEQ ID NO: 15419 - protein, 9 aa, Artificial Sequence
  source: /note="Description of Artificial Sequence: Synthetic peptide"
NVVMCRHPL

SEQ ID NO: 15420 - protein, 10 aa, Artificial Sequence
  source: /note="Description of Artificial Sequence: Synthetic peptide"
VMCRHPLVYV

SEQ ID NO: 15421 - protein, 10 aa, Artificial Sequence
  source: /note="Description of Artificial Sequence: Synthetic peptide"
VVMCRHPLVY

SEQ ID NO: 15422 - protein, 10 aa, Artificial Sequence
  source: /note="Description of Artificial Sequence: Synthetic peptide"
QIQFNVVMCR

SEQ ID NO: 15423 - protein, 10 aa, Artificial Sequence
  source: /note="Description of Artificial Sequence: Synthetic peptide"
NVVMCRHPLV

SEQ ID NO: 15424 - protein, 10 aa, Artificial Sequence
  source: /note="Description of Artificial Sequence: Synthetic peptide"
AQIQFNVVMC

SEQ ID NO: 15425 - protein, 10 aa, Artificial Sequence
  source: /note="Description of Artificial Sequence: Synthetic peptide"
IQFNVVMCRH

SEQ ID NO: 15426 - protein, 10 aa, Artificial Sequence
  source: /note="Description of Artificial Sequence: Synthetic peptide"
FNVVMCRHPL

SEQ ID NO: 15427 - protein, 9 aa, Artificial Sequence
  source: /note="Description of Artificial Sequence: Synthetic peptide"
CTRKCVSNV

SEQ ID NO: 15428 - protein, 9 aa, Artificial Sequence
  source: /note="Description of Artificial Sequence: Synthetic peptide"
HMEYTLCTR

SEQ ID NO: 15429 - protein, 9 aa, Artificial Sequence
  source: /note="Description of Artificial Sequence: Synthetic peptide"
YTLCTRKCV

SEQ ID NO: 15430 - protein, 9 aa, Artificial Sequence
  source: /note="Description of Artificial Sequence: Synthetic peptide"
RHMEYTLCT

SEQ ID NO: 15431 - protein, 10 aa, Artificial Sequence
  source: /note="Description of Artificial Sequence: Synthetic peptide"
HMEYTLCTRK

SEQ ID NO: 15432 - protein, 10 aa, Artificial Sequence
  source: /note="Description of Artificial Sequence: Synthetic peptide"
CTRKCVSNVM

SEQ ID NO: 15433 - protein, 10 aa, Artificial Sequence
  source: /note="Description of Artificial Sequence: Synthetic peptide"
MEYTLCTRKC

SEQ ID NO: 15434 - protein, 9 aa, Artificial Sequence
  source: /note="Description of Artificial Sequence: Synthetic peptide"
VLCCIPFFL

SEQ ID NO: 15435 - protein, 9 aa, Artificial Sequence
  source: /note="Description of Artificial Sequence: Synthetic peptide"
CIPFFLTEL

SEQ ID NO: 15436 - protein, 9 aa, Artificial Sequence
  source: /note="Description of Artificial Sequence: Synthetic peptide"
VFVLCCIPF

SEQ ID NO: 15437 - protein, 9 aa, Artificial Sequence
  source: /note="Description of Artificial Sequence: Synthetic peptide"
FVLCCIPFF

SEQ ID NO: 15438 - protein, 10 aa, Artificial Sequence
  source: /note="Description of Artificial Sequence: Synthetic peptide"
FVLCCIPFFL

SEQ ID NO: 15439 - protein, 10 aa, Artificial Sequence
  source: /note="Description of Artificial Sequence: Synthetic peptide"
CIPFFLTELI

SEQ ID NO: 15440 - protein, 10 aa, Artificial Sequence
  source: /note="Description of Artificial Sequence: Synthetic peptide"
VFVLCCIPFF

SEQ ID NO: 15441 - protein, 10 aa, Artificial Sequence
  source: /note="Description of Artificial Sequence: Synthetic peptide"
GVFVLCCIPF

SEQ ID NO: 15442 - protein, 10 aa, Artificial Sequence
  source: /note="Description of Artificial Sequence: Synthetic peptide"
GIRDGDIIVK

SEQ ID NO: 15443 - protein, 9 aa, Artificial Sequence
  source: /note="Description of Artificial Sequence: Synthetic peptide"
YLYPNCHNY

SEQ ID NO: 15444 - protein, 9 aa, Artificial Sequence
  source: /note="Description of Artificial Sequence: Synthetic peptide"
YPNCHNYNV

SEQ ID NO: 15445 - protein, 10 aa, Artificial Sequence
  source: /note="Description of Artificial Sequence: Synthetic peptide"
GLWGYYLYPN

SEQ ID NO: 15446 - protein, 10 aa, Artificial Sequence
  source: /note="Description of Artificial Sequence: Synthetic peptide"
YLYPNCHNYN

SEQ ID NO: 15447 - protein, 10 aa, Artificial Sequence
  source: /note="Description of Artificial Sequence: Synthetic peptide"
YYLYPNCHNY

SEQ ID NO: 15448 - protein, 10 aa, Artificial Sequence
  source: /note="Description of Artificial Sequence: Synthetic peptide"
LYPNCHNYNV

SEQ ID NO: 15449 - protein, 10 aa, Artificial Sequence
  source: /note="Description of Artificial Sequence: Synthetic peptide"
YPNCHNYNVY

SEQ ID NO: 15450 - protein, 9 aa, Artificial Sequence
  source: /note="Description of Artificial Sequence: Synthetic peptide"
EIRLPLQIK

SEQ ID NO: 15451 - protein, 9 aa, Artificial Sequence
  source: /note="Description of Artificial Sequence: Synthetic peptide"
REIRLPLQI

SEQ ID NO: 15452 - protein, 10 aa, Artificial Sequence
  source: /note="Description of Artificial Sequence: Synthetic peptide"
QIKGEGMGPK

SEQ ID NO: 15453 - protein, 10 aa, Artificial Sequence
  source: /note="Description of Artificial Sequence: Synthetic peptide"
LPLQIKGEGM

SEQ ID NO: 15454 - protein, 9 aa, Artificial Sequence
  source: /note="Description of Artificial Sequence: Synthetic peptide"
RQIQQLFWM

SEQ ID NO: 15455 - protein, 9 aa, Artificial Sequence
  source: /note="Description of Artificial Sequence: Synthetic peptide"
KLINKGRQI

SEQ ID NO: 15456 - protein, 9 aa, Artificial Sequence
  source: /note="Description of Artificial Sequence: Synthetic peptide"
KGRQIQQLF

SEQ ID NO: 15457 - protein, 10 aa, Artificial Sequence
  source: /note="Description of Artificial Sequence: Synthetic peptide"
KGRQIQQLFW

SEQ ID NO: 15458 - protein, 10 aa, Artificial Sequence
  source: /note="Description of Artificial Sequence: Synthetic peptide"
FKLINKGRQI

SEQ ID NO: 15459 - protein, 10 aa, Artificial Sequence
  source: /note="Description of Artificial Sequence: Synthetic peptide"
NKGRQIQQLF

SEQ ID NO: 15460 - protein, 10 aa, Artificial Sequence
  source: /note="Description of Artificial Sequence: Synthetic peptide"
RQIQQLFWMN

SEQ ID NO: 15461 - protein, 9 aa, Artificial Sequence
  source: /note="Description of Artificial Sequence: Synthetic peptide"
LNDTELICY

SEQ ID NO: 15462 - protein, 9 aa, Artificial Sequence
  source: /note="Description of Artificial Sequence: Synthetic peptide"
TELICYVTI

SEQ ID NO: 15463 - protein, 10 aa, Artificial Sequence
  source: /note="Description of Artificial Sequence: Synthetic peptide"
ILNDTELICY

SEQ ID NO: 15464 - protein, 10 aa, Artificial Sequence
  source: /note="Description of Artificial Sequence: Synthetic peptide"
DTELICYVTI

SEQ ID NO: 15465 - protein, 10 aa, Artificial Sequence
  source: /note="Description of Artificial Sequence: Synthetic peptide"
TELICYVTIT

SEQ ID NO: 15466 - protein, 9 aa, Artificial Sequence
  source: /note="Description of Artificial Sequence: Synthetic peptide"
MVLNYSCSL

SEQ ID NO: 15467 - protein, 9 aa, Artificial Sequence
  source: /note="Description of Artificial Sequence: Synthetic peptide"
VLNYSCSLA

SEQ ID NO: 15468 - protein, 9 aa, Artificial Sequence
  source: /note="Description of Artificial Sequence: Synthetic peptide"
YSCSLAEDF

SEQ ID NO: 15469 - protein, 10 aa, Artificial Sequence
  source: /note="Description of Artificial Sequence: Synthetic peptide"
GMVLNYSCSL

SEQ ID NO: 15470 - protein, 10 aa, Artificial Sequence
  source: /note="Description of Artificial Sequence: Synthetic peptide"
MVLNYSCSLA

SEQ ID NO: 15471 - protein, 10 aa, Artificial Sequence
  source: /note="Description of Artificial Sequence: Synthetic peptide"
NYSCSLAEDF

SEQ ID NO: 15472 - protein, 9 aa, Artificial Sequence
  source: /note="Description of Artificial Sequence: Synthetic peptide"
VIVCSFAPI

SEQ ID NO: 15473 - protein, 9 aa, Artificial Sequence
  source: /note="Description of Artificial Sequence: Synthetic peptide"
CSFAPILPH

SEQ ID NO: 15474 - protein, 9 aa, Artificial Sequence
  source: /note="Description of Artificial Sequence: Synthetic peptide"
ILDVIVCSF

SEQ ID NO: 15475 - protein, 10 aa, Artificial Sequence
  source: /note="Description of Artificial Sequence: Synthetic peptide"
ILDVIVCSFA

SEQ ID NO: 15476 - protein, 10 aa, Artificial Sequence
  source: /note="Description of Artificial Sequence: Synthetic peptide"
VIVCSFAPIL

SEQ ID NO: 15477 - protein, 10 aa, Artificial Sequence
  source: /note="Description of Artificial Sequence: Synthetic peptide"
DVIVCSFAPI

SEQ ID NO: 15478 - protein, 10 aa, Artificial Sequence
  source: /note="Description of Artificial Sequence: Synthetic peptide"
EILDVIVCSF

SEQ ID NO: 15479 - protein, 10 aa, Artificial Sequence
  source: /note="Description of Artificial Sequence: Synthetic peptide"
CSFAPILPHL

SEQ ID NO: 15480 - protein, 9 aa, Artificial Sequence
  source: /note="Description of Artificial Sequence: Synthetic peptide"
FLLECDRSV

SEQ ID NO: 15481 - protein, 9 aa, Artificial Sequence
  source: /note="Description of Artificial Sequence: Synthetic peptide"
RSVQGALQK

SEQ ID NO: 15482 - protein, 10 aa, Artificial Sequence
  source: /note="Description of Artificial Sequence: Synthetic peptide"
LECDRSVQGA

SEQ ID NO: 15483 - protein, 9 aa, Artificial Sequence
  source: /note="Description of Artificial Sequence: Synthetic peptide"
FLLEEKSLL

SEQ ID NO: 15484 - protein, 9 aa, Artificial Sequence
  source: /note="Description of Artificial Sequence: Synthetic peptide"
LLEEKSLLL

SEQ ID NO: 15485 - protein, 9 aa, Artificial Sequence
  source: /note="Description of Artificial Sequence: Synthetic peptide"
SLLLAIVQA

SEQ ID NO: 15486 - protein, 9 aa, Artificial Sequence
  source: /note="Description of Artificial Sequence: Synthetic peptide"
LLLAIVQAI

SEQ ID NO: 15487 - protein, 9 aa, Artificial Sequence
  source: /note="Description of Artificial Sequence: Synthetic peptide"
AIMSKKFLL

SEQ ID NO: 15488 - protein, 9 aa, Artificial Sequence
  source: /note="Description of Artificial Sequence: Synthetic peptide"
FLLKELKIL

SEQ ID NO: 15489 - protein, 9 aa, Artificial Sequence
  source: /note="Description of Artificial Sequence: Synthetic peptide"
KLSDALPMV

SEQ ID NO: 15490 - protein, 9 aa, Artificial Sequence
  source: /note="Description of Artificial Sequence: Synthetic peptide"
LLAIVQAIM

SEQ ID NO: 15491 - protein, 9 aa, Artificial Sequence
  source: /note="Description of Artificial Sequence: Synthetic peptide"
AIVQAIMSK

SEQ ID NO: 15492 - protein, 9 aa, Artificial Sequence
  source: /note="Description of Artificial Sequence: Synthetic peptide"
IVQAIMSKK

SEQ ID NO: 15493 - protein, 9 aa, Artificial Sequence
  source: /note="Description of Artificial Sequence: Synthetic peptide"
IMSKKFLLK

SEQ ID NO: 15494 - protein, 9 aa, Artificial Sequence
  source: /note="Description of Artificial Sequence: Synthetic peptide"
KFLLKELKI

SEQ ID NO: 15495 - protein, 9 aa, Artificial Sequence
  source: /note="Description of Artificial Sequence: Synthetic peptide"
ATIFQIYHF

SEQ ID NO: 15496 - protein, 9 aa, Artificial Sequence
  source: /note="Description of Artificial Sequence: Synthetic peptide"
ELKILRHQK

SEQ ID NO: 15497 - protein, 9 aa, Artificial Sequence
  source: /note="Description of Artificial Sequence: Synthetic peptide"
LLKELKILR

SEQ ID NO: 15498 - protein, 9 aa, Artificial Sequence
  source: /note="Description of Artificial Sequence: Synthetic peptide"
VPQDQKATI

SEQ ID NO: 15499 - protein, 9 aa, Artificial Sequence
  source: /note="Description of Artificial Sequence: Synthetic peptide"
VQAIMSKKF

SEQ ID NO: 15500 - protein, 9 aa, Artificial Sequence
  source: /note="Description of Artificial Sequence: Synthetic peptide"
SKKFLLKEL

SEQ ID NO: 15501 - protein, 9 aa, Artificial Sequence
  source: /note="Description of Artificial Sequence: Synthetic peptide"
LKILRHQKL

SEQ ID NO: 15502 - protein, 9 aa, Artificial Sequence
  source: /note="Description of Artificial Sequence: Synthetic peptide"
RHQKLSDAL

SEQ ID NO: 15503 - protein, 9 aa, Artificial Sequence
  source: /note="Description of Artificial Sequence: Synthetic peptide"
QKLSDALPM

SEQ ID NO: 15504 - protein, 9 aa, Artificial Sequence
  source: /note="Description of Artificial Sequence: Synthetic peptide"
QKATIFQIY

SEQ ID NO: 15505 - protein, 9 aa, Artificial Sequence
  source: /note="Description of Artificial Sequence: Synthetic peptide"
EEKSLLLAI

SEQ ID NO: 15506 - protein, 9 aa, Artificial Sequence
  source: /note="Description of Artificial Sequence: Synthetic peptide"
LEEKSLLLA

SEQ ID NO: 15507 - protein, 10 aa, Artificial Sequence
  source: /note="Description of Artificial Sequence: Synthetic peptide"
FLLEEKSLLL

SEQ ID NO: 15508 - protein, 10 aa, Artificial Sequence
  source: /note="Description of Artificial Sequence: Synthetic peptide"
SLLLAIVQAI

SEQ ID NO: 15509 - protein, 10 aa, Artificial Sequence
  source: /note="Description of Artificial Sequence: Synthetic peptide"
LLLAIVQAIM

SEQ ID NO: 15510 - protein, 10 aa, Artificial Sequence
  source: /note="Description of Artificial Sequence: Synthetic peptide"
LLEEKSLLLA

SEQ ID NO: 15511 - protein, 10 aa, Artificial Sequence
  source: /note="Description of Artificial Sequence: Synthetic peptide"
AIVQAIMSKK

SEQ ID NO: 15512 - protein, 10 aa, Artificial Sequence
  source: /note="Description of Artificial Sequence: Synthetic peptide"
AIMSKKFLLK

SEQ ID NO: 15513 - protein, 10 aa, Artificial Sequence
  source: /note="Description of Artificial Sequence: Synthetic peptide"
LAIVQAIMSK

SEQ ID NO: 15514 - protein, 10 aa, Artificial Sequence
  source: /note="Description of Artificial Sequence: Synthetic peptide"
IVQAIMSKKF

SEQ ID NO: 15515 - protein, 10 aa, Artificial Sequence
  source: /note="Description of Artificial Sequence: Synthetic peptide"
KATIFQIYHF

SEQ ID NO: 15516 - protein, 10 aa, Artificial Sequence
  source: /note="Description of Artificial Sequence: Synthetic peptide"
KSLLLAIVQA

SEQ ID NO: 15517 - protein, 10 aa, Artificial Sequence
  source: /note="Description of Artificial Sequence: Synthetic peptide"
MSKKFLLKEL

SEQ ID NO: 15518 - protein, 10 aa, Artificial Sequence
  source: /note="Description of Artificial Sequence: Synthetic peptide"
DQKATIFQIY

SEQ ID NO: 15519 - protein, 10 aa, Artificial Sequence
  source: /note="Description of Artificial Sequence: Synthetic peptide"
VPQDQKATIF

SEQ ID NO: 15520 - protein, 10 aa, Artificial Sequence
  source: /note="Description of Artificial Sequence: Synthetic peptide"
ELKILRHQKL

SEQ ID NO: 15521 - protein, 10 aa, Artificial Sequence
  source: /note="Description of Artificial Sequence: Synthetic peptide"
HQKLSDALPM

SEQ ID NO: 15522 - protein, 10 aa, Artificial Sequence
  source: /note="Description of Artificial Sequence: Synthetic peptide"
RDFLLEEKSL

SEQ ID NO: 15523 - protein, 10 aa, Artificial Sequence
  source: /note="Description of Artificial Sequence: Synthetic peptide"
LEEKSLLLAI

SEQ ID NO: 15524 - protein, 10 aa, Artificial Sequence
  source: /note="Description of Artificial Sequence: Synthetic peptide"
VQAIMSKKFL

SEQ ID NO: 15525 - protein, 10 aa, Artificial Sequence
  source: /note="Description of Artificial Sequence: Synthetic peptide"
KKFLLKELKI

SEQ ID NO: 15526 - protein, 10 aa, Artificial Sequence
  source: /note="Description of Artificial Sequence: Synthetic peptide"
LRHQKLSDAL

SEQ ID NO: 15527 - protein, 10 aa, Artificial Sequence
  source: /note="Description of Artificial Sequence: Synthetic peptide"
EEKSLLLAIV

SEQ ID NO: 15528 - protein, 10 aa, Artificial Sequence
  source: /note="Description of Artificial Sequence: Synthetic peptide"
LPMVPQDQKA

SEQ ID NO: 15529 - protein, 9 aa, Artificial Sequence
  source: /note="Description of Artificial Sequence: Synthetic peptide"
GFQKRLTAK

SEQ ID NO: 15530 - protein, 10 aa, Artificial Sequence
  source: /note="Description of Artificial Sequence: Synthetic peptide"
CGFQKRLTAK

SEQ ID NO: 15531 - protein, 9 aa, Artificial Sequence
  source: /note="Description of Artificial Sequence: Synthetic peptide"
PIIIGGHAY

SEQ ID NO: 15532 - protein, 9 aa, Artificial Sequence
  source: /note="Description of Artificial Sequence: Synthetic peptide"
GGHAYGDQY

SEQ ID NO: 15533 - protein, 10 aa, Artificial Sequence
  source: /note="Description of Artificial Sequence: Synthetic peptide"
KPIIIGGHAY

SEQ ID NO: 15534 - protein, 10 aa, Artificial Sequence
  source: /note="Description of Artificial Sequence: Synthetic peptide"
IGGHAYGDQY

SEQ ID NO: 15535 - protein, 9 aa, Artificial Sequence
  source: /note="Description of Artificial Sequence: Synthetic peptide"
PIIIGCHAY

SEQ ID NO: 15536 - protein, 9 aa, Artificial Sequence
  source: /note="Description of Artificial Sequence: Synthetic peptide"
GCHAYGDQY

SEQ ID NO: 15537 - protein, 10 aa, Artificial Sequence
  source: /note="Description of Artificial Sequence: Synthetic peptide"
KPIIIGCHAY

SEQ ID NO: 15538 - protein, 10 aa, Artificial Sequence
  source: /note="Description of Artificial Sequence: Synthetic peptide"
IGCHAYGDQY

SEQ ID NO: 15539 - protein, 9 aa, Artificial Sequence
  source: /note="Description of Artificial Sequence: Synthetic peptide"
PIIIGHHAY

SEQ ID NO: 15540 - protein, 9 aa, Artificial Sequence
  source: /note="Description of Artificial Sequence: Synthetic peptide"
GHHAYGDQY

SEQ ID NO: 15541 - protein, 10 aa, Artificial Sequence
  source: /note="Description of Artificial Sequence: Synthetic peptide"
KPIIIGHHAY

SEQ ID NO: 15542 - protein, 10 aa, Artificial Sequence
  source: /note="Description of Artificial Sequence: Synthetic peptide"
IGHHAYGDQY

SEQ ID NO: 15543 - protein, 9 aa, Artificial Sequence
  source: /note="Description of Artificial Sequence: Synthetic peptide"
IQNILGGTV

SEQ ID NO: 15544 - protein, 9 aa, Artificial Sequence
  source: /note="Description of Artificial Sequence: Synthetic peptide"
QNILGGTVF

SEQ ID NO: 15545 - protein, 9 aa, Artificial Sequence
  source: /note="Description of Artificial Sequence: Synthetic peptide"
SPNGTIQNI

SEQ ID NO: 15546 - protein, 10 aa, Artificial Sequence
  source: /note="Description of Artificial Sequence: Synthetic peptide"
TIQNILGGTV

SEQ ID NO: 15547 - protein, 10 aa, Artificial Sequence
  source: /note="Description of Artificial Sequence: Synthetic peptide"
SPNGTIQNIL

SEQ ID NO: 15548 - protein, 10 aa, Artificial Sequence
  source: /note="Description of Artificial Sequence: Synthetic peptide"
IQNILGGTVF

SEQ ID NO: 15549 - protein, 9 aa, Artificial Sequence
  source: /note="Description of Artificial Sequence: Synthetic peptide"
WTKPITIGK

SEQ ID NO: 15550 - protein, 9 aa, Artificial Sequence
  source: /note="Description of Artificial Sequence: Synthetic peptide"
KHAHGDQYK

SEQ ID NO: 15551 - protein, 9 aa, Artificial Sequence
  source: /note="Description of Artificial Sequence: Synthetic peptide"
GKHAHGDQY

SEQ ID NO: 15552 - protein, 10 aa, Artificial Sequence
  source: /note="Description of Artificial Sequence: Synthetic peptide"
IGKHAHGDQY

SEQ ID NO: 15553 - protein, 9 aa, Artificial Sequence
  source: /note="Description of Artificial Sequence: Synthetic peptide"
NPRPPHVQL

SEQ ID NO: 15554 - protein, 9 aa, Artificial Sequence
  source: /note="Description of Artificial Sequence: Synthetic peptide"
FQVNNPRPP

SEQ ID NO: 15555 - protein, 10 aa, Artificial Sequence
  source: /note="Description of Artificial Sequence: Synthetic peptide"
TARFQVNNPR

SEQ ID NO: 15556 - protein, 10 aa, Artificial Sequence
  source: /note="Description of Artificial Sequence: Synthetic peptide"
QVNNPRPPHV

SEQ ID NO: 15557 - protein, 10 aa, Artificial Sequence
  source: /note="Description of Artificial Sequence: Synthetic peptide"
NPRPPHVQLL

SEQ ID NO: 15558 - protein, 10 aa, Artificial Sequence
  source: /note="Description of Artificial Sequence: Synthetic peptide"
FQVNNPRPPH

SEQ ID NO: 15559 - protein, 9 aa, Artificial Sequence
  source: /note="Description of Artificial Sequence: Synthetic peptide"
HLVQVDAAR

SEQ ID NO: 15560 - protein, 9 aa, Artificial Sequence
  source: /note="Description of Artificial Sequence: Synthetic peptide"
VQVDAARAL

SEQ ID NO: 15561 - protein, 9 aa, Artificial Sequence
  source: /note="Description of Artificial Sequence: Synthetic peptide"
AEAPHLVQV

SEQ ID NO: 15562 - protein, 10 aa, Artificial Sequence
  source: /note="Description of Artificial Sequence: Synthetic peptide"
HLVQVDAARA

SEQ ID NO: 15563 - protein, 10 aa, Artificial Sequence
  source: /note="Description of Artificial Sequence: Synthetic peptide"
APHLVQVDAA

SEQ ID NO: 15564 - protein, 10 aa, Artificial Sequence
  source: /note="Description of Artificial Sequence: Synthetic peptide"
VQVDAARALW

SEQ ID NO: 15565 - protein, 9 aa, Artificial Sequence
  source: /note="Description of Artificial Sequence: Synthetic peptide"
TPAATPGAA

SEQ ID NO: 15566 - protein, 10 aa, Artificial Sequence
  source: /note="Description of Artificial Sequence: Synthetic peptide"
TPAATPGAAC

SEQ ID NO: 15567 - protein, 9 aa, Artificial Sequence
  source: /note="Description of Artificial Sequence: Synthetic peptide"
ALHEMIQQT

SEQ ID NO: 15568 - protein, 9 aa, Artificial Sequence
  source: /note="Description of Artificial Sequence: Synthetic peptide"
AISALHEMI

SEQ ID NO: 15569 - protein, 9 aa, Artificial Sequence
  source: /note="Description of Artificial Sequence: Synthetic peptide"
KAQAISALH

SEQ ID NO: 15570 - protein, 9 aa, Artificial Sequence
  source: /note="Description of Artificial Sequence: Synthetic peptide"
QAISALHEM

SEQ ID NO: 15571 - protein, 9 aa, Artificial Sequence
  source: /note="Description of Artificial Sequence: Synthetic peptide"
QKAQAISAL

SEQ ID NO: 15572 - protein, 10 aa, Artificial Sequence
  source: /note="Description of Artificial Sequence: Synthetic peptide"
FQKAQAISAL

SEQ ID NO: 15573 - protein, 10 aa, Artificial Sequence
  source: /note="Description of Artificial Sequence: Synthetic peptide"
QAISALHEMI

SEQ ID NO: 15574 - protein, 10 aa, Artificial Sequence
  source: /note="Description of Artificial Sequence: Synthetic peptide"
AQAISALHEM

SEQ ID NO: 15575 - protein, 10 aa, Artificial Sequence
  source: /note="Description of Artificial Sequence: Synthetic peptide"
ALHEMIQQTF

SEQ ID NO: 15576 - protein, 9 aa, Artificial Sequence
  source: /note="Description of Artificial Sequence: Synthetic peptide"
KAQAISVFH

SEQ ID NO: 15577 - protein, 9 aa, Artificial Sequence
  source: /note="Description of Artificial Sequence: Synthetic peptide"
QAISVFHEM

SEQ ID NO: 15578 - protein, 9 aa, Artificial Sequence
  source: /note="Description of Artificial Sequence: Synthetic peptide"
QKAQAISVF

SEQ ID NO: 15579 - protein, 10 aa, Artificial Sequence
  source: /note="Description of Artificial Sequence: Synthetic peptide"
AQAISVFHEM

SEQ ID NO: 15580 - protein, 10 aa, Artificial Sequence
  source: /note="Description of Artificial Sequence: Synthetic peptide"
VFHEMIQQTF

SEQ ID NO: 15581 - protein, 10 aa, Artificial Sequence
  source: /note="Description of Artificial Sequence: Synthetic peptide"
QAISVFHEMI

SEQ ID NO: 15582 - protein, 10 aa, Artificial Sequence
  source: /note="Description of Artificial Sequence: Synthetic peptide"
FQKAQAISVF

SEQ ID NO: 15583 - protein, 10 aa, Artificial Sequence
  source: /note="Description of Artificial Sequence: Synthetic peptide"
QSEPRLFVCK

SEQ ID NO: 15584 - protein, 10 aa, Artificial Sequence
  source: /note="Description of Artificial Sequence: Synthetic peptide"
EPRLFVCKAV

SEQ ID NO: 15585 - protein, 10 aa, Artificial Sequence
  source: /note="Description of Artificial Sequence: Synthetic peptide"
SEPRLFVCKA

SEQ ID NO: 15586 - protein, 9 aa, Artificial Sequence
  source: /note="Description of Artificial Sequence: Synthetic peptide"
CYRKGNTFM

SEQ ID NO: 15587 - protein, 9 aa, Artificial Sequence
  source: /note="Description of Artificial Sequence: Synthetic peptide"
KGNTFMKAV

SEQ ID NO: 15588 - protein, 9 aa, Artificial Sequence
  source: /note="Description of Artificial Sequence: Synthetic peptide"
NTFMKAVEL

SEQ ID NO: 15589 - protein, 10 aa, Artificial Sequence
  source: /note="Description of Artificial Sequence: Synthetic peptide"
CYRKGNTFMK

SEQ ID NO: 15590 - protein, 10 aa, Artificial Sequence
  source: /note="Description of Artificial Sequence: Synthetic peptide"
TFMKAVELAR

SEQ ID NO: 15591 - protein, 10 aa, Artificial Sequence
  source: /note="Description of Artificial Sequence: Synthetic peptide"
NTFMKAVELA

SEQ ID NO: 15592 - protein, 10 aa, Artificial Sequence
  source: /note="Description of Artificial Sequence: Synthetic peptide"
LECYRKGNTF

SEQ ID NO: 15593 - protein, 10 aa, Artificial Sequence
  source: /note="Description of Artificial Sequence: Synthetic peptide"
RKGNTFMKAV

SEQ ID NO: 15594 - protein, 9 aa, Artificial Sequence
  source: /note="Description of Artificial Sequence: Synthetic peptide"
RTKDVIDMY

SEQ ID NO: 15595 - protein, 9 aa, Artificial Sequence
  source: /note="Description of Artificial Sequence: Synthetic peptide"
DVIDMYTQA

SEQ ID NO: 15596 - protein, 10 aa, Artificial Sequence
  source: /note="Description of Artificial Sequence: Synthetic peptide"
RTKDVIDMYT

SEQ ID NO: 15597 - protein, 9 aa, Artificial Sequence
  source: /note="Description of Artificial Sequence: Synthetic peptide"
SSQARQIDF

SEQ ID NO: 15598 - protein, 10 aa, Artificial Sequence
  source: /note="Description of Artificial Sequence: Synthetic peptide"
GSSQARQIDF

SEQ ID NO: 15599 - protein, 9 aa, Artificial Sequence
  source: /note="Description of Artificial Sequence: Synthetic peptide"
KMNFTGGGH

SEQ ID NO: 15600 - protein, 9 aa, Artificial Sequence
  source: /note="Description of Artificial Sequence: Synthetic peptide"
MNFTGGGHL

SEQ ID NO: 15601 - protein, 10 aa, Artificial Sequence
  source: /note="Description of Artificial Sequence: Synthetic peptide"
KMNFTGGGHL

SEQ ID NO: 15602 - protein, 10 aa, Artificial Sequence
  source: /note="Description of Artificial Sequence: Synthetic peptide"
LKMNFTGGGH

SEQ ID NO: 15603 - protein, 9 aa, Artificial Sequence
  source: /note="Description of Artificial Sequence: Synthetic peptide"
AVICDSSTV

SEQ ID NO: 15604 - protein, 9 aa, Artificial Sequence
  source: /note="Description of Artificial Sequence: Synthetic peptide"
STVNNHAFL

SEQ ID NO: 15605 - protein, 9 aa, Artificial Sequence
  source: /note="Description of Artificial Sequence: Synthetic peptide"
SSTVNNHAF

SEQ ID NO: 15606 - protein, 10 aa, Artificial Sequence
  source: /note="Description of Artificial Sequence: Synthetic peptide"
STVNNHAFLK

SEQ ID NO: 15607 - protein, 10 aa, Artificial Sequence
  source: /note="Description of Artificial Sequence: Synthetic peptide"
DSSTVNNHAF

SEQ ID NO: 15608 - protein, 9 aa, Artificial Sequence
  source: /note="Description of Artificial Sequence: Synthetic peptide"
QIIVPLNNR

SEQ ID NO: 15609 - protein, 9 aa, Artificial Sequence
  source: /note="Description of Artificial Sequence: Synthetic peptide"
DIVERNIQI

SEQ ID NO: 15610 - protein, 9 aa, Artificial Sequence
  source: /note="Description of Artificial Sequence: Synthetic peptide"
VERNIQIIV

SEQ ID NO: 15611 - protein, 9 aa, Artificial Sequence
  source: /note="Description of Artificial Sequence: Synthetic peptide"
RNIQIIVPL

SEQ ID NO: 15612 - protein, 9 aa, Artificial Sequence
  source: /note="Description of Artificial Sequence: Synthetic peptide"
EIERERASR

SEQ ID NO: 15613 - protein, 9 aa, Artificial Sequence
  source: /note="Description of Artificial Sequence: Synthetic peptide"
REVPGSCQG

SEQ ID NO: 15614 - protein, 9 aa, Artificial Sequence
  source: /note="Description of Artificial Sequence: Synthetic peptide"
TERWSEQRL

SEQ ID NO: 15615 - protein, 10 aa, Artificial Sequence
  source: /note="Description of Artificial Sequence: Synthetic peptide"
RQQEIERERA

SEQ ID NO: 15616 - protein, 10 aa, Artificial Sequence
  source: /note="Description of Artificial Sequence: Synthetic peptide"
IERERASREV

SEQ ID NO: 15617 - protein, 10 aa, Artificial Sequence
  source: /note="Description of Artificial Sequence: Synthetic peptide"
REVPGSCQGT

SEQ ID NO: 15618 - protein, 9 aa, Artificial Sequence
  source: /note="Description of Artificial Sequence: Synthetic peptide"
KGNLRRHIK

SEQ ID NO: 15619 - protein, 9 aa, Artificial Sequence
  source: /note="Description of Artificial Sequence: Synthetic peptide"
SFTQKGNLR

SEQ ID NO: 15620 - protein, 9 aa, Artificial Sequence
  source: /note="Description of Artificial Sequence: Synthetic peptide"
FTQKGNLRR

SEQ ID NO: 15621 - protein, 10 aa, Artificial Sequence
  source: /note="Description of Artificial Sequence: Synthetic peptide"
ASFTQKGNLR

SEQ ID NO: 15622 - protein, 10 aa, Artificial Sequence
  source: /note="Description of Artificial Sequence: Synthetic peptide"
KGNLRRHIKL

SEQ ID NO: 15623 - protein, 10 aa, Artificial Sequence
  source: /note="Description of Artificial Sequence: Synthetic peptide"
SFTQKGNLRR

SEQ ID NO: 15624 - protein, 10 aa, Artificial Sequence
  source: /note="Description of Artificial Sequence: Synthetic peptide"
NLRRHIKLHT

SEQ ID NO: 15625 - protein, 10 aa, Artificial Sequence
  source: /note="Description of Artificial Sequence: Synthetic peptide"
TQKGNLRRHI

SEQ ID NO: 15626 - protein, 9 aa, Artificial Sequence
  source: /note="Description of Artificial Sequence: Synthetic peptide"
GQGWPGPLA

SEQ ID NO: 15627 - protein, 10 aa, Artificial Sequence
  source: /note="Description of Artificial Sequence: Synthetic peptide"
RKGQGWPGPL

SEQ ID NO: 15628 - protein, 10 aa, Artificial Sequence
  source: /note="Description of Artificial Sequence: Synthetic peptide"
WPGPLAPGPH

SEQ ID NO: 15629 - protein, 9 aa, Artificial Sequence
  source: /note="Description of Artificial Sequence: Synthetic peptide"
GLGHDGVRV

SEQ ID NO: 15630 - protein, 9 aa, Artificial Sequence
  source: /note="Description of Artificial Sequence: Synthetic peptide"
RAAPQGPPR

SEQ ID NO: 15631 - protein, 9 aa, Artificial Sequence
  source: /note="Description of Artificial Sequence: Synthetic peptide"
RGGRGAGPR

SEQ ID NO: 15632 - protein, 9 aa, Artificial Sequence
  source: /note="Description of Artificial Sequence: Synthetic peptide"
RVRGAQCMR

SEQ ID NO: 15633 - protein, 9 aa, Artificial Sequence
  source: /note="Description of Artificial Sequence: Synthetic peptide"
GPREAGPAT

SEQ ID NO: 15634 - protein, 9 aa, Artificial Sequence
  source: /note="Description of Artificial Sequence: Synthetic peptide"
VRVRGAQCM

SEQ ID NO: 15635 - protein, 9 aa, Artificial Sequence
  source: /note="Description of Artificial Sequence: Synthetic peptide"
EEPPAAAAF

SEQ ID NO: 15636 - protein, 9 aa, Artificial Sequence
  source: /note="Description of Artificial Sequence: Synthetic peptide"
REAGPATLS

SEQ ID NO: 15637 - protein, 10 aa, Artificial Sequence
  source: /note="Description of Artificial Sequence: Synthetic peptide"
ISRSSPQPPR

SEQ ID NO: 15638 - protein, 10 aa, Artificial Sequence
  source: /note="Description of Artificial Sequence: Synthetic peptide"
GVRVRGAQCM

SEQ ID NO: 15639 - protein, 10 aa, Artificial Sequence
  source: /note="Description of Artificial Sequence: Synthetic peptide"
RVRGAQCMRA

SEQ ID NO: 15640 - protein, 10 aa, Artificial Sequence
  source: /note="Description of Artificial Sequence: Synthetic peptide"
GPREAGPATL

SEQ ID NO: 15641 - protein, 10 aa, Artificial Sequence
  source: /note="Description of Artificial Sequence: Synthetic peptide"
APQGPPRSQL

SEQ ID NO: 15642 - protein, 10 aa, Artificial Sequence
  source: /note="Description of Artificial Sequence: Synthetic peptide"
AAFPPAAEEL

SEQ ID NO: 15643 - protein, 10 aa, Artificial Sequence
  source: /note="Description of Artificial Sequence: Synthetic peptide"
EELGLGHDGV

SEQ ID NO: 15644 - protein, 9 aa, Artificial Sequence
  source: /note="Description of Artificial Sequence: Synthetic peptide"
RLSILSQVK

SEQ ID NO: 15645 - protein, 9 aa, Artificial Sequence
  source: /note="Description of Artificial Sequence: Synthetic peptide"
QTVQTQNWK

SEQ ID NO: 15646 - protein, 9 aa, Artificial Sequence
  source: /note="Description of Artificial Sequence: Synthetic peptide"
KSRWSDCAM

SEQ ID NO: 15647 - protein, 9 aa, Artificial Sequence
  source: /note="Description of Artificial Sequence: Synthetic peptide"
MASSSRLSI

SEQ ID NO: 15648 - protein, 9 aa, Artificial Sequence
  source: /note="Description of Artificial Sequence: Synthetic peptide"
AQTVQTQNW

SEQ ID NO: 15649 - protein, 9 aa, Artificial Sequence
  source: /note="Description of Artificial Sequence: Synthetic peptide"
CAMASSSRL

SEQ ID NO: 15650 - protein, 9 aa, Artificial Sequence
  source: /note="Description of Artificial Sequence: Synthetic peptide"
ASSSRLSIL

SEQ ID NO: 15651 - protein, 9 aa, Artificial Sequence
  source: /note="Description of Artificial Sequence: Synthetic peptide"
SRLSILSQV

SEQ ID NO: 15652 - protein, 10 aa, Artificial Sequence
  source: /note="Description of Artificial Sequence: Synthetic peptide"
FLVLGGNMDA

SEQ ID NO: 15653 - protein, 10 aa, Artificial Sequence
  source: /note="Description of Artificial Sequence: Synthetic peptide"
AMASSSRLSI

SEQ ID NO: 15654 - protein, 10 aa, Artificial Sequence
  source: /note="Description of Artificial Sequence: Synthetic peptide"
KSRWSDCAMA

SEQ ID NO: 15655 - protein, 10 aa, Artificial Sequence
  source: /note="Description of Artificial Sequence: Synthetic peptide"
SSRLSILSQV

SEQ ID NO: 15656 - protein, 10 aa, Artificial Sequence
  source: /note="Description of Artificial Sequence: Synthetic peptide"
TVQTQNWKSR

SEQ ID NO: 15657 - protein, 10 aa, Artificial Sequence
  source: /note="Description of Artificial Sequence: Synthetic peptide"
MASSSRLSIL

SEQ ID NO: 15658 - protein, 10 aa, Artificial Sequence
  source: /note="Description of Artificial Sequence: Synthetic peptide"
LAFLVLGGNM

SEQ ID NO: 15659 - protein, 10 aa, Artificial Sequence
  source: /note="Description of Artificial Sequence: Synthetic peptide"
VQTQNWKSRW

SEQ ID NO: 15660 - protein, 10 aa, Artificial Sequence
  source: /note="Description of Artificial Sequence: Synthetic peptide"
WKSRWSDCAM

SEQ ID NO: 15661 - protein, 10 aa, Artificial Sequence
  source: /note="Description of Artificial Sequence: Synthetic peptide"
DAQTVQTQNW

SEQ ID NO: 15662 - protein, 9 aa, Artificial Sequence
  source: /note="Description of Artificial Sequence: Synthetic peptide"
RIKCPLCEH

SEQ ID NO: 15663 - protein, 9 aa, Artificial Sequence
  source: /note="Description of Artificial Sequence: Synthetic peptide"
IKCPLCEHF

SEQ ID NO: 15664 - protein, 9 aa, Artificial Sequence
  source: /note="Description of Artificial Sequence: Synthetic peptide"
CEHFLKFNY

SEQ ID NO: 15665 - protein, 10 aa, Artificial Sequence
  source: /note="Description of Artificial Sequence: Synthetic peptide"
RIKCPLCEHF

SEQ ID NO: 15666 - protein, 10 aa, Artificial Sequence
  source: /note="Description of Artificial Sequence: Synthetic peptide"
CPLCEHFLKF

SEQ ID NO: 15667 - protein, 10 aa, Artificial Sequence
  source: /note="Description of Artificial Sequence: Synthetic peptide"
CEHFLKFNYS

SEQ ID NO: 15668 - protein, 9 aa, Artificial Sequence
  source: /note="Description of Artificial Sequence: Synthetic peptide"
MLLNGQLPL

SEQ ID NO: 15669 - protein, 9 aa, Artificial Sequence
  source: /note="Description of Artificial Sequence: Synthetic peptide"
TYCNLPLML

SEQ ID NO: 15670 - protein, 9 aa, Artificial Sequence
  source: /note="Description of Artificial Sequence: Synthetic peptide"
HTYCNLPLM

SEQ ID NO: 15671 - protein, 10 aa, Artificial Sequence
  source: /note="Description of Artificial Sequence: Synthetic peptide"
LMLLNGQLPL

SEQ ID NO: 15672 - protein, 10 aa, Artificial Sequence
  source: /note="Description of Artificial Sequence: Synthetic peptide"
HTYCNLPLML

SEQ ID NO: 15673 - protein, 10 aa, Artificial Sequence
  source: /note="Description of Artificial Sequence: Synthetic peptide"
TYCNLPLMLL

SEQ ID NO: 15674 - protein, 10 aa, Artificial Sequence
  source: /note="Description of Artificial Sequence: Synthetic peptide"
LPLMLLNGQL

SEQ ID NO: 15675 - protein, 10 aa, Artificial Sequence
  source: /note="Description of Artificial Sequence: Synthetic peptide"
HHTYCNLPLM

SEQ ID NO: 15676 - protein, 9 aa, Artificial Sequence
  source: /note="Description of Artificial Sequence: Synthetic peptide"
RPMDLISNI

SEQ ID NO: 15677 - protein, 9 aa, Artificial Sequence
  source: /note="Description of Artificial Sequence: Synthetic peptide"
NFHLRPMDL

SEQ ID NO: 15678 - protein, 9 aa, Artificial Sequence
  source: /note="Description of Artificial Sequence: Synthetic peptide"
SKNFHLRPM

SEQ ID NO: 15679 - protein, 10 aa, Artificial Sequence
  source: /note="Description of Artificial Sequence: Synthetic peptide"
QSKNFHLRPM

SEQ ID NO: 15680 - protein, 10 aa, Artificial Sequence
  source: /note="Description of Artificial Sequence: Synthetic peptide"
KNFHLRPMDL

SEQ ID NO: 15681 - protein, 10 aa, Artificial Sequence
  source: /note="Description of Artificial Sequence: Synthetic peptide"
MDLISNINVI

SEQ ID NO: 15682 - protein, 9 aa, Artificial Sequence
  source: /note="Description of Artificial Sequence: Synthetic peptide"
AGGWSLFGK

SEQ ID NO: 15683 - protein, 9 aa, Artificial Sequence
  source: /note="Description of Artificial Sequence: Synthetic peptide"
SLFGKPGAR

SEQ ID NO: 15684 - protein, 9 aa, Artificial Sequence
  source: /note="Description of Artificial Sequence: Synthetic peptide"
GPAGGWSLF

SEQ ID NO: 15685 - protein, 9 aa, Artificial Sequence
  source: /note="Description of Artificial Sequence: Synthetic peptide"
HEGPGCPDA

SEQ ID NO: 15686 - protein, 10 aa, Artificial Sequence
  source: /note="Description of Artificial Sequence: Synthetic peptide"
SLACVCAAPC

SEQ ID NO: 15687 - protein, 10 aa, Artificial Sequence
  source: /note="Description of Artificial Sequence: Synthetic peptide"
RVSLACVCAA

SEQ ID NO: 15688 - protein, 10 aa, Artificial Sequence
  source: /note="Description of Artificial Sequence: Synthetic peptide"
WSLFGKPGAR

SEQ ID NO: 15689 - protein, 10 aa, Artificial Sequence
  source: /note="Description of Artificial Sequence: Synthetic peptide"
GPGCPDAWPL

SEQ ID NO: 15690 - protein, 10 aa, Artificial Sequence
  source: /note="Description of Artificial Sequence: Synthetic peptide"
LAGPAGGWSL

SEQ ID NO: 15691 - protein, 10 aa, Artificial Sequence
  source: /note="Description of Artificial Sequence: Synthetic peptide"
HEGPGCPDAW

SEQ ID NO: 15692 - protein, 9 aa, Artificial Sequence
  source: /note="Description of Artificial Sequence: Synthetic peptide"
TSAIESILK

SEQ ID NO: 15693 - protein, 9 aa, Artificial Sequence
  source: /note="Description of Artificial Sequence: Synthetic peptide"
KSLQNTSAI

SEQ ID NO: 15694 - protein, 9 aa, Artificial Sequence
  source: /note="Description of Artificial Sequence: Synthetic peptide"
NTSAIESIL

SEQ ID NO: 15695 - protein, 10 aa, Artificial Sequence
  source: /note="Description of Artificial Sequence: Synthetic peptide"
LQNTSAIESI

SEQ ID NO: 15696 - protein, 10 aa, Artificial Sequence
  source: /note="Description of Artificial Sequence: Synthetic peptide"
NTSAIESILK

SEQ ID NO: 15697 - protein, 10 aa, Artificial Sequence
  source: /note="Description of Artificial Sequence: Synthetic peptide"
AVKSLQNTSA

SEQ ID NO: 15698 - protein, 10 aa, Artificial Sequence
  source: /note="Description of Artificial Sequence: Synthetic peptide"
VKSLQNTSAI

SEQ ID NO: 15699 - protein, 9 aa, Artificial Sequence
  source: /note="Description of Artificial Sequence: Synthetic peptide"
SYGATRGDK

SEQ ID NO: 15700 - protein, 9 aa, Artificial Sequence
  source: /note="Description of Artificial Sequence: Synthetic peptide"
SFQSYGATR

SEQ ID NO: 15701 - protein, 9 aa, Artificial Sequence
  source: /note="Description of Artificial Sequence: Synthetic peptide"
SSFQSYGAT

SEQ ID NO: 15702 - protein, 9 aa, Artificial Sequence
  source: /note="Description of Artificial Sequence: Synthetic peptide"
FQSYGATRG

SEQ ID NO: 15703 - protein, 10 aa, Artificial Sequence
  source: /note="Description of Artificial Sequence: Synthetic peptide"
SSFQSYGATR

SEQ ID NO: 15704 - protein, 10 aa, Artificial Sequence
  source: /note="Description of Artificial Sequence: Synthetic peptide"
QSYGATRGDK

SEQ ID NO: 15705 - protein, 9 aa, Artificial Sequence
  source: /note="Description of Artificial Sequence: Synthetic peptide"
APRGEQGGA

SEQ ID NO: 15706 - protein, 9 aa, Artificial Sequence
  source: /note="Description of Artificial Sequence: Synthetic peptide"
GLAQVILQW

SEQ ID NO: 15707 - protein, 10 aa, Artificial Sequence
  source: /note="Description of Artificial Sequence: Synthetic peptide"
GLAQVILQWK

SEQ ID NO: 15708 - protein, 10 aa, Artificial Sequence
  source: /note="Description of Artificial Sequence: Synthetic peptide"
IKVTGLAQVI

SEQ ID NO: 15709 - protein, 10 aa, Artificial Sequence
  source: /note="Description of Artificial Sequence: Synthetic peptide"
TGLAQVILQW

SEQ ID NO: 15710 - protein, 9 aa, Artificial Sequence
  source: /note="Description of Artificial Sequence: Synthetic peptide"
TSDHINFDH

SEQ ID NO: 15711 - protein, 9 aa, Artificial Sequence
  source: /note="Description of Artificial Sequence: Synthetic peptide"
HINFDHVYK

SEQ ID NO: 15712 - protein, 9 aa, Artificial Sequence
  source: /note="Description of Artificial Sequence: Synthetic peptide"
DHINFDHVY

SEQ ID NO: 15713 - protein, 10 aa, Artificial Sequence
  source: /note="Description of Artificial Sequence: Synthetic peptide"
TSDHINFDHV

SEQ ID NO: 15714 - protein, 10 aa, Artificial Sequence
  source: /note="Description of Artificial Sequence: Synthetic peptide"
HINFDHVYKV

SEQ ID NO: 15715 - protein, 10 aa, Artificial Sequence
  source: /note="Description of Artificial Sequence: Synthetic peptide"
SDHINFDHVY

SEQ ID NO: 15716 - protein, 9 aa, Artificial Sequence
  source: /note="Description of Artificial Sequence: Synthetic peptide"
EVNGSQHLL

SEQ ID NO: 15717 - protein, 9 aa, Artificial Sequence
  source: /note="Description of Artificial Sequence: Synthetic peptide"
SQHLLTCAF

SEQ ID NO: 15718 - protein, 9 aa, Artificial Sequence
  source: /note="Description of Artificial Sequence: Synthetic peptide"
LEVNGSQHL

SEQ ID NO: 15719 - protein, 10 aa, Artificial Sequence
  source: /note="Description of Artificial Sequence: Synthetic peptide"
GSQHLLTCAF

SEQ ID NO: 15720 - protein, 10 aa, Artificial Sequence
  source: /note="Description of Artificial Sequence: Synthetic peptide"
LEVNGSQHLL

SEQ ID NO: 15721 - protein, 9 aa, Artificial Sequence
  source: /note="Description of Artificial Sequence: Synthetic peptide"
SSKGEDSAK

SEQ ID NO: 15722 - protein, 9 aa, Artificial Sequence
  source: /note="Description of Artificial Sequence: Synthetic peptide"
KETEAKPAV

SEQ ID NO: 15723 - protein, 10 aa, Artificial Sequence
  source: /note="Description of Artificial Sequence: Synthetic peptide"
KETEAKPAVV

SEQ ID NO: 15724 - protein, 10 aa, Artificial Sequence
  source: /note="Description of Artificial Sequence: Synthetic peptide"
GEDSAKETEA

SEQ ID NO: 15725 - protein, 9 aa, Artificial Sequence
  source: /note="Description of Artificial Sequence: Synthetic peptide"
FPVPSSSAS

SEQ ID NO: 15726 - protein, 9 aa, Artificial Sequence
  source: /note="Description of Artificial Sequence: Synthetic peptide"
VPSSSASSI

SEQ ID NO: 15727 - protein, 10 aa, Artificial Sequence
  source: /note="Description of Artificial Sequence: Synthetic peptide"
TPFPVPSSSA

SEQ ID NO: 15728 - protein, 10 aa, Artificial Sequence
  source: /note="Description of Artificial Sequence: Synthetic peptide"
FPVPSSSASS

SEQ ID NO: 15729 - protein, 9 aa, Artificial Sequence
  source: /note="Description of Artificial Sequence: Synthetic peptide"
SWPRWTMAW

SEQ ID NO: 15730 - protein, 9 aa, Artificial Sequence
  source: /note="Description of Artificial Sequence: Synthetic peptide"
AWRRSSWPR

SEQ ID NO: 15731 - protein, 9 aa, Artificial Sequence
  source: /note="Description of Artificial Sequence: Synthetic peptide"
RSSWPRWTM

SEQ ID NO: 15732 - protein, 9 aa, Artificial Sequence
  source: /note="Description of Artificial Sequence: Synthetic peptide"
SSWPRWTMA

SEQ ID NO: 15733 - protein, 9 aa, Artificial Sequence
  source: /note="Description of Artificial Sequence: Synthetic peptide"
WPRWTMAWA

SEQ ID NO: 15734 - protein, 9 aa, Artificial Sequence
  source: /note="Description of Artificial Sequence: Synthetic peptide"
WAQHGSPAI

SEQ ID NO: 15735 - protein, 9 aa, Artificial Sequence
  source: /note="Description of Artificial Sequence: Synthetic peptide"
REAWRRSSW

SEQ ID NO: 15736 - protein, 9 aa, Artificial Sequence
  source: /note="Description of Artificial Sequence: Synthetic peptide"
WRRSSWPRW

SEQ ID NO: 15737 - protein, 9 aa, Artificial Sequence
  source: /note="Description of Artificial Sequence: Synthetic peptide"
AWAQHGSPA

SEQ ID NO: 15738 - protein, 9 aa, Artificial Sequence
  source: /note="Description of Artificial Sequence: Synthetic peptide"
AQHGSPAIG

SEQ ID NO: 15739 - protein, 9 aa, Artificial Sequence
  source: /note="Description of Artificial Sequence: Synthetic peptide"
LPCTCSPPW

SEQ ID NO: 15740 - protein, 10 aa, Artificial Sequence
  source: /note="Description of Artificial Sequence: Synthetic peptide"
AWRRSSWPRW

SEQ ID NO: 15741 - protein, 10 aa, Artificial Sequence
  source: /note="Description of Artificial Sequence: Synthetic peptide"
SSWPRWTMAW

SEQ ID NO: 15742 - protein, 10 aa, Artificial Sequence
  source: /note="Description of Artificial Sequence: Synthetic peptide"
RSSWPRWTMA

SEQ ID NO: 15743 - protein, 10 aa, Artificial Sequence
  source: /note="Description of Artificial Sequence: Synthetic peptide"
MAWAQHGSPA

SEQ ID NO: 15744 - protein, 10 aa, Artificial Sequence
  source: /note="Description of Artificial Sequence: Synthetic peptide"
CSPPWREAWR

SEQ ID NO: 15745 - protein, 10 aa, Artificial Sequence
  source: /note="Description of Artificial Sequence: Synthetic peptide"
EAWRRSSWPR

SEQ ID NO: 15746 - protein, 10 aa, Artificial Sequence
  source: /note="Description of Artificial Sequence: Synthetic peptide"
WTMAWAQHGS

SEQ ID NO: 15747 - protein, 10 aa, Artificial Sequence
  source: /note="Description of Artificial Sequence: Synthetic peptide"
WPRWTMAWAQ

SEQ ID NO: 15748 - protein, 10 aa, Artificial Sequence
  source: /note="Description of Artificial Sequence: Synthetic peptide"
LLPCTCSPPW

SEQ ID NO: 15749 - protein, 10 aa, Artificial Sequence
  source: /note="Description of Artificial Sequence: Synthetic peptide"
WREAWRRSSW

SEQ ID NO: 15750 - protein, 10 aa, Artificial Sequence
  source: /note="Description of Artificial Sequence: Synthetic peptide"
RRSSWPRWTM

SEQ ID NO: 15751 - protein, 10 aa, Artificial Sequence
  source: /note="Description of Artificial Sequence: Synthetic peptide"
AWAQHGSPAI

SEQ ID NO: 15752 - protein, 9 aa, Artificial Sequence
  source: /note="Description of Artificial Sequence: Synthetic peptide"
MLHCVQRSL

SEQ ID NO: 15753 - protein, 9 aa, Artificial Sequence
  source: /note="Description of Artificial Sequence: Synthetic peptide"
RSLIRSQEL

SEQ ID NO: 15754 - protein, 9 aa, Artificial Sequence
  source: /note="Description of Artificial Sequence: Synthetic peptide"
RMLHCVQRS

SEQ ID NO: 15755 - protein, 10 aa, Artificial Sequence
  source: /note="Description of Artificial Sequence: Synthetic peptide"
RMLHCVQRSL

SEQ ID NO: 15756 - protein, 10 aa, Artificial Sequence
  source: /note="Description of Artificial Sequence: Synthetic peptide"
MLHCVQRSLI

SEQ ID NO: 15757 - protein, 10 aa, Artificial Sequence
  source: /note="Description of Artificial Sequence: Synthetic peptide"
RSLIRSQELG

SEQ ID NO: 15758 - protein, 9 aa, Artificial Sequence
  source: /note="Description of Artificial Sequence: Synthetic peptide"
LQVDTLIDI

SEQ ID NO: 15759 - protein, 10 aa, Artificial Sequence
  source: /note="Description of Artificial Sequence: Synthetic peptide"
GLQVDTLIDI

SEQ ID NO: 15760 - protein, 10 aa, Artificial Sequence
  source: /note="Description of Artificial Sequence: Synthetic peptide"
KTFGPGGLQV

SEQ ID NO: 15761 - protein, 9 aa, Artificial Sequence
  source: /note="Description of Artificial Sequence: Synthetic peptide"
EFFCVALEK

SEQ ID NO: 15762 - protein, 9 aa, Artificial Sequence
  source: /note="Description of Artificial Sequence: Synthetic peptide"
YMVGKREFF

SEQ ID NO: 15763 - protein, 9 aa, Artificial Sequence
  source: /note="Description of Artificial Sequence: Synthetic peptide"
GKREFFCVA

SEQ ID NO: 15764 - protein, 9 aa, Artificial Sequence
  source: /note="Description of Artificial Sequence: Synthetic peptide"
KREFFCVAL

SEQ ID NO: 15765 - protein, 9 aa, Artificial Sequence
  source: /note="Description of Artificial Sequence: Synthetic peptide"
REFFCVALE

SEQ ID NO: 15766 - protein, 10 aa, Artificial Sequence
  source: /note="Description of Artificial Sequence: Synthetic peptide"
MVGKREFFCV

SEQ ID NO: 15767 - protein, 10 aa, Artificial Sequence
  source: /note="Description of Artificial Sequence: Synthetic peptide"
YMVGKREFFC

SEQ ID NO: 15768 - protein, 10 aa, Artificial Sequence
  source: /note="Description of Artificial Sequence: Synthetic peptide"
SYMVGKREFF

SEQ ID NO: 15769 - protein, 10 aa, Artificial Sequence
  source: /note="Description of Artificial Sequence: Synthetic peptide"
GKREFFCVAL

SEQ ID NO: 15770 - protein, 10 aa, Artificial Sequence
  source: /note="Description of Artificial Sequence: Synthetic peptide"
REFFCVALEK

SEQ ID NO: 15771 - protein, 9 aa, Artificial Sequence
  source: /note="Description of Artificial Sequence: Synthetic peptide"
RQNQNYMNI

SEQ ID NO: 15772 - protein, 9 aa, Artificial Sequence
  source: /note="Description of Artificial Sequence: Synthetic peptide"
KLRQNQNYM

SEQ ID NO: 15773 - protein, 9 aa, Artificial Sequence
  source: /note="Description of Artificial Sequence: Synthetic peptide"
KKLRQNQNY

SEQ ID NO: 15774 - protein, 10 aa, Artificial Sequence
  source: /note="Description of Artificial Sequence: Synthetic peptide"
KLRQNQNYMN

SEQ ID NO: 15775 - protein, 10 aa, Artificial Sequence
  source: /note="Description of Artificial Sequence: Synthetic peptide"
RQNQNYMNIL

SEQ ID NO: 15776 - protein, 10 aa, Artificial Sequence
  source: /note="Description of Artificial Sequence: Synthetic peptide"
KKLRQNQNYM

SEQ ID NO: 15777 - protein, 9 aa, Artificial Sequence
  source: /note="Description of Artificial Sequence: Synthetic peptide"
KCKPAWTDR

SEQ ID NO: 15778 - protein, 9 aa, Artificial Sequence
  source: /note="Description of Artificial Sequence: Synthetic peptide"
SEKKCKPAW

SEQ ID NO: 15779 - protein, 9 aa, Artificial Sequence
  source: /note="Description of Artificial Sequence: Synthetic peptide"
LMDLDYRPI

SEQ ID NO: 15780 - protein, 9 aa, Artificial Sequence
  source: /note="Description of Artificial Sequence: Synthetic peptide"
LKELMDLDY

SEQ ID NO: 15781 - protein, 10 aa, Artificial Sequence
  source: /note="Description of Artificial Sequence: Synthetic peptide"
ELMDLDYRPI

SEQ ID NO: 15782 - protein, 10 aa, Artificial Sequence
  source: /note="Description of Artificial Sequence: Synthetic peptide"
GLKELMDLDY

SEQ ID NO: 15783 - protein, 10 aa, Artificial Sequence
  source: /note="Description of Artificial Sequence: Synthetic peptide"
LLRGGLKELM

SEQ ID NO: 15784 - protein, 10 aa, Artificial Sequence
  source: /note="Description of Artificial Sequence: Synthetic peptide"
MDLDYRPIAM

SEQ ID NO: 15785 - protein, 9 aa, Artificial Sequence
  source: /note="Description of Artificial Sequence: Synthetic peptide"
RLPGPLSHL

SEQ ID NO: 15786 - protein, 9 aa, Artificial Sequence
  source: /note="Description of Artificial Sequence: Synthetic peptide"
SLGTTGTLV

SEQ ID NO: 15787 - protein, 9 aa, Artificial Sequence
  source: /note="Description of Artificial Sequence: Synthetic peptide"
YQGQWSGAV

SEQ ID NO: 15788 - protein, 9 aa, Artificial Sequence
  source: /note="Description of Artificial Sequence: Synthetic peptide"
ALSWGKWPV

SEQ ID NO: 15789 - protein, 9 aa, Artificial Sequence
  source: /note="Description of Artificial Sequence: Synthetic peptide"
VLQMRSLEA

SEQ ID NO: 15790 - protein, 9 aa, Artificial Sequence
  source: /note="Description of Artificial Sequence: Synthetic peptide"
GLRPVAHHL

SEQ ID NO: 15791 - protein, 9 aa, Artificial Sequence
  source: /note="Description of Artificial Sequence: Synthetic peptide"
HLPRPIQGL

SEQ ID NO: 15792 - protein, 9 aa, Artificial Sequence
  source: /note="Description of Artificial Sequence: Synthetic peptide"
ITLPTTSLK

SEQ ID NO: 15793 - protein, 9 aa, Artificial Sequence
  source: /note="Description of Artificial Sequence: Synthetic peptide"
LSHLPPRTK

SEQ ID NO: 15794 - protein, 9 aa, Artificial Sequence
  source: /note="Description of Artificial Sequence: Synthetic peptide"
TTGTLVWER

SEQ ID NO: 15795 - protein, 9 aa, Artificial Sequence
  source: /note="Description of Artificial Sequence: Synthetic peptide"
QTFHLHHCR

SEQ ID NO: 15796 - protein, 9 aa, Artificial Sequence
  source: /note="Description of Artificial Sequence: Synthetic peptide"
HQPALSWGK

SEQ ID NO: 15797 - protein, 9 aa, Artificial Sequence
  source: /note="Description of Artificial Sequence: Synthetic peptide"
MTGPARCCR

SEQ ID NO: 15798 - protein, 9 aa, Artificial Sequence
  source: /note="Description of Artificial Sequence: Synthetic peptide"
AWILYQGQW

SEQ ID NO: 15799 - protein, 9 aa, Artificial Sequence
  source: /note="Description of Artificial Sequence: Synthetic peptide"
SWGKWPVGM

SEQ ID NO: 15800 - protein, 9 aa, Artificial Sequence
  source: /note="Description of Artificial Sequence: Synthetic peptide"
RTASITLPT

SEQ ID NO: 15801 - protein, 9 aa, Artificial Sequence
  source: /note="Description of Artificial Sequence: Synthetic peptide"
GSRTSCCPR

SEQ ID NO: 15802 - protein, 9 aa, Artificial Sequence
  source: /note="Description of Artificial Sequence: Synthetic peptide"
RTSCCPRSH

SEQ ID NO: 15803 - protein, 9 aa, Artificial Sequence
  source: /note="Description of Artificial Sequence: Synthetic peptide"
RSHPRLPGP

SEQ ID NO: 15804 - protein, 9 aa, Artificial Sequence
  source: /note="Description of Artificial Sequence: Synthetic peptide"
RTKWPLQCL

SEQ ID NO: 15805 - protein, 9 aa, Artificial Sequence
  source: /note="Description of Artificial Sequence: Synthetic peptide"
RSLEAHCPL

SEQ ID NO: 15806 - protein, 9 aa, Artificial Sequence
  source: /note="Description of Artificial Sequence: Synthetic peptide"
RPVAHHLPR

SEQ ID NO: 15807 - protein, 9 aa, Artificial Sequence
  source: /note="Description of Artificial Sequence: Synthetic peptide"
PARCCRWPR

SEQ ID NO: 15808 - protein, 9 aa, Artificial Sequence
  source: /note="Description of Artificial Sequence: Synthetic peptide"
SCPPAWILY

SEQ ID NO: 15809 - protein, 9 aa, Artificial Sequence
  source: /note="Description of Artificial Sequence: Synthetic peptide"
EGVAAPHPR

SEQ ID NO: 15810 - protein, 9 aa, Artificial Sequence
  source: /note="Description of Artificial Sequence: Synthetic peptide"
SCCPRSHPR

SEQ ID NO: 15811 - protein, 9 aa, Artificial Sequence
  source: /note="Description of Artificial Sequence: Synthetic peptide"
WSGAVVGLR

SEQ ID NO: 15812 - protein, 9 aa, Artificial Sequence
  source: /note="Description of Artificial Sequence: Synthetic peptide"
APHPRTASI

SEQ ID NO: 15813 - protein, 9 aa, Artificial Sequence
  source: /note="Description of Artificial Sequence: Synthetic peptide"
HPRTASITL

SEQ ID NO: 15814 - protein, 9 aa, Artificial Sequence
  source: /note="Description of Artificial Sequence: Synthetic peptide"
HPRLPGPLS

SEQ ID NO: 15815 - protein, 9 aa, Artificial Sequence
  source: /note="Description of Artificial Sequence: Synthetic peptide"
LPPRTKWPL

SEQ ID NO: 15816 - protein, 9 aa, Artificial Sequence
  source: /note="Description of Artificial Sequence: Synthetic peptide"
CPQAPHQPA

SEQ ID NO: 15817 - protein, 9 aa, Artificial Sequence
  source: /note="Description of Artificial Sequence: Synthetic peptide"
APHQPALSW

SEQ ID NO: 15818 - protein, 9 aa, Artificial Sequence
  source: /note="Description of Artificial Sequence: Synthetic peptide"
WPVGMTGPA

SEQ ID NO: 15819 - protein, 9 aa, Artificial Sequence
  source: /note="Description of Artificial Sequence: Synthetic peptide"
LQMRSLEAH

SEQ ID NO: 15820 - protein, 9 aa, Artificial Sequence
  source: /note="Description of Artificial Sequence: Synthetic peptide"
EAHCPLQTF

SEQ ID NO: 15821 - protein, 9 aa, Artificial Sequence
  source: /note="Description of Artificial Sequence: Synthetic peptide"
SHLPPRTKW

SEQ ID NO: 15822 - protein, 9 aa, Artificial Sequence
  source: /note="Description of Artificial Sequence: Synthetic peptide"
TKWPLQCLL

SEQ ID NO: 15823 - protein, 9 aa, Artificial Sequence
  source: /note="Description of Artificial Sequence: Synthetic peptide"
LLHSLGTTG

SEQ ID NO: 15824 - protein, 9 aa, Artificial Sequence
  source: /note="Description of Artificial Sequence: Synthetic peptide"
HSLGTTGTL

SEQ ID NO: 15825 - protein, 9 aa, Artificial Sequence
  source: /note="Description of Artificial Sequence: Synthetic peptide"
LGTTGTLVW

SEQ ID NO: 15826 - protein, 9 aa, Artificial Sequence
  source: /note="Description of Artificial Sequence: Synthetic peptide"
RGVLQMRSL

SEQ ID NO: 15827 - protein, 9 aa, Artificial Sequence
  source: /note="Description of Artificial Sequence: Synthetic peptide"
TQPSSCPPA

SEQ ID NO: 15828 - protein, 9 aa, Artificial Sequence
  source: /note="Description of Artificial Sequence: Synthetic peptide"
SSCPPAWIL

SEQ ID NO: 15829 - protein, 9 aa, Artificial Sequence
  source: /note="Description of Artificial Sequence: Synthetic peptide"
ILYQGQWSG

SEQ ID NO: 15830 - protein, 9 aa, Artificial Sequence
  source: /note="Description of Artificial Sequence: Synthetic peptide"
GQWSGAVVG

SEQ ID NO: 15831 - protein, 9 aa, Artificial Sequence
  source: /note="Description of Artificial Sequence: Synthetic peptide"
VAHHLPRPI

SEQ ID NO: 15832 - protein, 9 aa, Artificial Sequence
  source: /note="Description of Artificial Sequence: Synthetic peptide"
GLHCPQAPH

SEQ ID NO: 15833 - protein, 9 aa, Artificial Sequence
  source: /note="Description of Artificial Sequence: Synthetic peptide"
PQAPHQPAL

SEQ ID NO: 15834 - protein, 9 aa, Artificial Sequence
  source: /note="Description of Artificial Sequence: Synthetic peptide"
EPEGVAAPH

SEQ ID NO: 15835 - protein, 9 aa, Artificial Sequence
  source: /note="Description of Artificial Sequence: Synthetic peptide"
CPLQTFHLH

SEQ ID NO: 15836 - protein, 9 aa, Artificial Sequence
  source: /note="Description of Artificial Sequence: Synthetic peptide"
QPSSCPPAW

SEQ ID NO: 15837 - protein, 9 aa, Artificial Sequence
  source: /note="Description of Artificial Sequence: Synthetic peptide"
QPALSWGKW

SEQ ID NO: 15838 - protein, 9 aa, Artificial Sequence
  source: /note="Description of Artificial Sequence: Synthetic peptide"
LEAHCPLQT

SEQ ID NO: 15839 - protein, 10 aa, Artificial Sequence
  source: /note="Description of Artificial Sequence: Synthetic peptide"
SSCPPAWILY

SEQ ID NO: 15840 - protein, 10 aa, Artificial Sequence
  source: /note="Description of Artificial Sequence: Synthetic peptide"
HLPPRTKWPL

SEQ ID NO: 15841 - protein, 10 aa, Artificial Sequence
  source: /note="Description of Artificial Sequence: Synthetic peptide"
ILYQGQWSGA

SEQ ID NO: 15842 - protein, 10 aa, Artificial Sequence
  source: /note="Description of Artificial Sequence: Synthetic peptide"
YQGQWSGAVV

SEQ ID NO: 15843 - protein, 10 aa, Artificial Sequence
  source: /note="Description of Artificial Sequence: Synthetic peptide"
GQWSGAVVGL

SEQ ID NO: 15844 - protein, 10 aa, Artificial Sequence
  source: /note="Description of Artificial Sequence: Synthetic peptide"
LLHSLGTTGT

SEQ ID NO: 15845 - protein, 10 aa, Artificial Sequence
  source: /note="Description of Artificial Sequence: Synthetic peptide"
SITLPTTSLK

SEQ ID NO: 15846 - protein, 10 aa, Artificial Sequence
  source: /note="Description of Artificial Sequence: Synthetic peptide"
TSCCPRSHPR

SEQ ID NO: 15847 - protein, 10 aa, Artificial Sequence
  source: /note="Description of Artificial Sequence: Synthetic peptide"
GTTGTLVWER

SEQ ID NO: 15848 - protein, 10 aa, Artificial Sequence
  source: /note="Description of Artificial Sequence: Synthetic peptide"
RTASITLPTT

SEQ ID NO: 15849 - protein, 10 aa, Artificial Sequence
  source: /note="Description of Artificial Sequence: Synthetic peptide"
KGSRTSCCPR

SEQ ID NO: 15850 - protein, 10 aa, Artificial Sequence
  source: /note="Description of Artificial Sequence: Synthetic peptide"
RSHPRLPGPL

SEQ ID NO: 15851 - protein, 10 aa, Artificial Sequence
  source: /note="Description of Artificial Sequence: Synthetic peptide"
RTKWPLQCLL

SEQ ID NO: 15852 - protein, 10 aa, Artificial Sequence
  source: /note="Description of Artificial Sequence: Synthetic peptide"
RTQPSSCPPA

SEQ ID NO: 15853 - protein, 10 aa, Artificial Sequence
  source: /note="Description of Artificial Sequence: Synthetic peptide"
PARCCRWPRR

SEQ ID NO: 15854 - protein, 10 aa, Artificial Sequence
  source: /note="Description of Artificial Sequence: Synthetic peptide"
LQTFHLHHCR

SEQ ID NO: 15855 - protein, 10 aa, Artificial Sequence
  source: /note="Description of Artificial Sequence: Synthetic peptide"
QWSGAVVGLR

SEQ ID NO: 15856 - protein, 10 aa, Artificial Sequence
  source: /note="Description of Artificial Sequence: Synthetic peptide"
HSLGTTGTLV

SEQ ID NO: 15857 - protein, 10 aa, Artificial Sequence
  source: /note="Description of Artificial Sequence: Synthetic peptide"
APHPRTASIT

SEQ ID NO: 15858 - protein, 10 aa, Artificial Sequence
  source: /note="Description of Artificial Sequence: Synthetic peptide"
CPRSHPRLPG

SEQ ID NO: 15859 - protein, 10 aa, Artificial Sequence
  source: /note="Description of Artificial Sequence: Synthetic peptide"
HPRLPGPLSH

SEQ ID NO: 15860 - protein, 10 aa, Artificial Sequence
  source: /note="Description of Artificial Sequence: Synthetic peptide"
WPLQCLLHSL

SEQ ID NO: 15861 - protein, 10 aa, Artificial Sequence
  source: /note="Description of Artificial Sequence: Synthetic peptide"
CPQAPHQPAL

SEQ ID NO: 15862 - protein, 10 aa, Artificial Sequence
  source: /note="Description of Artificial Sequence: Synthetic peptide"
LEAHCPLQTF

SEQ ID NO: 15863 - protein, 10 aa, Artificial Sequence
  source: /note="Description of Artificial Sequence: Synthetic peptide"
LVWERGVLQM

SEQ ID NO: 15864 - protein, 10 aa, Artificial Sequence
  source: /note="Description of Artificial Sequence: Synthetic peptide"
ASITLPTTSL

SEQ ID NO: 15865 - protein, 10 aa, Artificial Sequence
  source: /note="Description of Artificial Sequence: Synthetic peptide"
LSHLPPRTKW

SEQ ID NO: 15866 - protein, 10 aa, Artificial Sequence
  source: /note="Description of Artificial Sequence: Synthetic peptide"
LHSLGTTGTL

SEQ ID NO: 15867 - protein, 10 aa, Artificial Sequence
  source: /note="Description of Artificial Sequence: Synthetic peptide"
SLGTTGTLVW

SEQ ID NO: 15868 - protein, 10 aa, Artificial Sequence
  source: /note="Description of Artificial Sequence: Synthetic peptide"
LQMRSLEAHC

SEQ ID NO: 15869 - protein, 10 aa, Artificial Sequence
  source: /note="Description of Artificial Sequence: Synthetic peptide"
MRSLEAHCPL

SEQ ID NO: 15870 - protein, 10 aa, Artificial Sequence
  source: /note="Description of Artificial Sequence: Synthetic peptide"
TQPSSCPPAW

SEQ ID NO: 15871 - protein, 10 aa, Artificial Sequence
  source: /note="Description of Artificial Sequence: Synthetic peptide"
HQPALSWGKW

SEQ ID NO: 15872 - protein, 10 aa, Artificial Sequence
  source: /note="Description of Artificial Sequence: Synthetic peptide"
LSWGKWPVGM

SEQ ID NO: 15873 - protein, 10 aa, Artificial Sequence
  source: /note="Description of Artificial Sequence: Synthetic peptide"
WERGVLQMRS

SEQ ID NO: 15874 - protein, 10 aa, Artificial Sequence
  source: /note="Description of Artificial Sequence: Synthetic peptide"
QPSSCPPAWI

SEQ ID NO: 15875 - protein, 9 aa, Artificial Sequence
  source: /note="Description of Artificial Sequence: Synthetic peptide"
TMAGPSASL

SEQ ID NO: 15876 - protein, 9 aa, Artificial Sequence
  source: /note="Description of Artificial Sequence: Synthetic peptide"
SLHPASGRA

SEQ ID NO: 15877 - protein, 9 aa, Artificial Sequence
  source: /note="Description of Artificial Sequence: Synthetic peptide"
ASLHPASGR

SEQ ID NO: 15878 - protein, 9 aa, Artificial Sequence
  source: /note="Description of Artificial Sequence: Synthetic peptide"
RASRKTWQR

SEQ ID NO: 15879 - protein, 9 aa, Artificial Sequence
  source: /note="Description of Artificial Sequence: Synthetic peptide"
RTMAGPSAS

SEQ ID NO: 15880 - protein, 9 aa, Artificial Sequence
  source: /note="Description of Artificial Sequence: Synthetic peptide"
ASRKTWQRR

SEQ ID NO: 15881 - protein, 9 aa, Artificial Sequence
  source: /note="Description of Artificial Sequence: Synthetic peptide"
KTWQRRLRA

SEQ ID NO: 15882 - protein, 9 aa, Artificial Sequence
  source: /note="Description of Artificial Sequence: Synthetic peptide"
WQRRLRACR

SEQ ID NO: 15883 - protein, 9 aa, Artificial Sequence
  source: /note="Description of Artificial Sequence: Synthetic peptide"
RLRACRAGG

SEQ ID NO: 15884 - protein, 9 aa, Artificial Sequence
  source: /note="Description of Artificial Sequence: Synthetic peptide"
RACRAGGPA

SEQ ID NO: 15885 - protein, 9 aa, Artificial Sequence
  source: /note="Description of Artificial Sequence: Synthetic peptide"
HPASGRASR

SEQ ID NO: 15886 - protein, 9 aa, Artificial Sequence
  source: /note="Description of Artificial Sequence: Synthetic peptide"
CPRTMAGPS

SEQ ID NO: 15887 - protein, 9 aa, Artificial Sequence
  source: /note="Description of Artificial Sequence: Synthetic peptide"
GPSASLHPA

SEQ ID NO: 15888 - protein, 9 aa, Artificial Sequence
  source: /note="Description of Artificial Sequence: Synthetic peptide"
SGRASRKTW

SEQ ID NO: 15889 - protein, 10 aa, Artificial Sequence
  source: /note="Description of Artificial Sequence: Synthetic peptide"
RTMAGPSASL

SEQ ID NO: 15890 - protein, 10 aa, Artificial Sequence
  source: /note="Description of Artificial Sequence: Synthetic peptide"
RASRKTWQRR

SEQ ID NO: 15891 - protein, 10 aa, Artificial Sequence
  source: /note="Description of Artificial Sequence: Synthetic peptide"
ASRKTWQRRL

SEQ ID NO: 15892 - protein, 10 aa, Artificial Sequence
  source: /note="Description of Artificial Sequence: Synthetic peptide"
KTWQRRLRAC

SEQ ID NO: 15893 - protein, 10 aa, Artificial Sequence
  source: /note="Description of Artificial Sequence: Synthetic peptide"
RLRACRAGGP

SEQ ID NO: 15894 - protein, 10 aa, Artificial Sequence
  source: /note="Description of Artificial Sequence: Synthetic peptide"
ELQPPGDCPR

SEQ ID NO: 15895 - protein, 10 aa, Artificial Sequence
  source: /note="Description of Artificial Sequence: Synthetic peptide"
SASLHPASGR

SEQ ID NO: 15896 - protein, 10 aa, Artificial Sequence
  source: /note="Description of Artificial Sequence: Synthetic peptide"
TWQRRLRACR

SEQ ID NO: 15897 - protein, 10 aa, Artificial Sequence
  source: /note="Description of Artificial Sequence: Synthetic peptide"
CPRTMAGPSA

SEQ ID NO: 15898 - protein, 10 aa, Artificial Sequence
  source: /note="Description of Artificial Sequence: Synthetic peptide"
WQRRLRACRA

SEQ ID NO: 15899 - protein, 10 aa, Artificial Sequence
  source: /note="Description of Artificial Sequence: Synthetic peptide"
TMAGPSASLH

SEQ ID NO: 15900 - protein, 10 aa, Artificial Sequence
  source: /note="Description of Artificial Sequence: Synthetic peptide"
ASGRASRKTW

SEQ ID NO: 15901 - protein, 9 aa, Artificial Sequence
  source: /note="Description of Artificial Sequence: Synthetic peptide"
VAATVNLEL

SEQ ID NO: 15902 - protein, 9 aa, Artificial Sequence
  source: /note="Description of Artificial Sequence: Synthetic peptide"
VLAVLEDSA

SEQ ID NO: 15903 - protein, 9 aa, Artificial Sequence
  source: /note="Description of Artificial Sequence: Synthetic peptide"
SARDIREAL

SEQ ID NO: 15904 - protein, 10 aa, Artificial Sequence
  source: /note="Description of Artificial Sequence: Synthetic peptide"
SARDIREALH

SEQ ID NO: 15905 - protein, 10 aa, Artificial Sequence
  source: /note="Description of Artificial Sequence: Synthetic peptide"
DSARDIREAL

SEQ ID NO: 15906 - protein, 9 aa, Artificial Sequence
  source: /note="Description of Artificial Sequence: Synthetic peptide"
DPYSQQICL

SEQ ID NO: 15907 - protein, 10 aa, Artificial Sequence
  source: /note="Description of Artificial Sequence: Synthetic peptide"
QQICLQQQQA

SEQ ID NO: 15908 - protein, 9 aa, Artificial Sequence
  source: /note="Description of Artificial Sequence: Synthetic peptide"
FVKIIFSVI

SEQ ID NO: 15909 - protein, 9 aa, Artificial Sequence
  source: /note="Description of Artificial Sequence: Synthetic peptide"
EFVKIIFSV

SEQ ID NO: 15910 - protein, 9 aa, Artificial Sequence
  source: /note="Description of Artificial Sequence: Synthetic peptide"
DEFVKIIFS

SEQ ID NO: 15911 - protein, 10 aa, Artificial Sequence
  source: /note="Description of Artificial Sequence: Synthetic peptide"
ILNVDEFVKI

SEQ ID NO: 15912 - protein, 10 aa, Artificial Sequence
  source: /note="Description of Artificial Sequence: Synthetic peptide"
EFVKIIFSVI

SEQ ID NO: 15913 - protein, 10 aa, Artificial Sequence
  source: /note="Description of Artificial Sequence: Synthetic peptide"
DEFVKIIFSV

SEQ ID NO: 15914 - protein, 10 aa, Artificial Sequence
  source: /note="Description of Artificial Sequence: Synthetic peptide"
PQKRRTQELK

SEQ ID NO: 15915 - protein, 10 aa, Artificial Sequence
  source: /note="Description of Artificial Sequence: Synthetic peptide"
ELKGGRCSPA

SEQ ID NO: 15916 - protein, 9 aa, Artificial Sequence
  source: /note="Description of Artificial Sequence: Synthetic peptide"
SMLGRILPT

SEQ ID NO: 15917 - protein, 9 aa, Artificial Sequence
  source: /note="Description of Artificial Sequence: Synthetic peptide"
MLGRILPTI

SEQ ID NO: 15918 - protein, 9 aa, Artificial Sequence
  source: /note="Description of Artificial Sequence: Synthetic peptide"
SARGRRSML

SEQ ID NO: 15919 - protein, 9 aa, Artificial Sequence
  source: /note="Description of Artificial Sequence: Synthetic peptide"
RGRRSMLGR

SEQ ID NO: 15920 - protein, 9 aa, Artificial Sequence
  source: /note="Description of Artificial Sequence: Synthetic peptide"
RSMLGRILP

SEQ ID NO: 15921 - protein, 9 aa, Artificial Sequence
  source: /note="Description of Artificial Sequence: Synthetic peptide"
GSARGRRSM

SEQ ID NO: 15922 - protein, 9 aa, Artificial Sequence
  source: /note="Description of Artificial Sequence: Synthetic peptide"
RRSMLGRIL

SEQ ID NO: 15923 - protein, 10 aa, Artificial Sequence
  source: /note="Description of Artificial Sequence: Synthetic peptide"
SMLGRILPTI

SEQ ID NO: 15924 - protein, 10 aa, Artificial Sequence
  source: /note="Description of Artificial Sequence: Synthetic peptide"
MLGRILPTIV

SEQ ID NO: 15925 - protein, 10 aa, Artificial Sequence
  source: /note="Description of Artificial Sequence: Synthetic peptide"
ILPTIVHQET

SEQ ID NO: 15926 - protein, 10 aa, Artificial Sequence
  source: /note="Description of Artificial Sequence: Synthetic peptide"
SSRPGSARGR

SEQ ID NO: 15927 - protein, 10 aa, Artificial Sequence
  source: /note="Description of Artificial Sequence: Synthetic peptide"
SARGRRSMLG

SEQ ID NO: 15928 - protein, 10 aa, Artificial Sequence
  source: /note="Description of Artificial Sequence: Synthetic peptide"
RGRRSMLGRI

SEQ ID NO: 15929 - protein, 10 aa, Artificial Sequence
  source: /note="Description of Artificial Sequence: Synthetic peptide"
RSMLGRILPT

SEQ ID NO: 15930 - protein, 9 aa, Artificial Sequence
  source: /note="Description of Artificial Sequence: Synthetic peptide"
LLQNTSFFL

SEQ ID NO: 15931 - protein, 9 aa, Artificial Sequence
  source: /note="Description of Artificial Sequence: Synthetic peptide"
YLMRWPINL

SEQ ID NO: 15932 - protein, 9 aa, Artificial Sequence
  source: /note="Description of Artificial Sequence: Synthetic peptide"
LMRWPINLI

SEQ ID NO: 15933 - protein, 9 aa, Artificial Sequence
  source: /note="Description of Artificial Sequence: Synthetic peptide"
TSFFLHYLM

SEQ ID NO: 15934 - protein, 9 aa, Artificial Sequence
  source: /note="Description of Artificial Sequence: Synthetic peptide"
SFFLHYLMR

SEQ ID NO: 15935 - protein, 9 aa, Artificial Sequence
  source: /note="Description of Artificial Sequence: Synthetic peptide"
FFLHYLMRW

SEQ ID NO: 15936 - protein, 9 aa, Artificial Sequence
  source: /note="Description of Artificial Sequence: Synthetic peptide"
RRWTSFWEI

SEQ ID NO: 15937 - protein, 9 aa, Artificial Sequence
  source: /note="Description of Artificial Sequence: Synthetic peptide"
LQNTSFFLH

SEQ ID NO: 15938 - protein, 9 aa, Artificial Sequence
  source: /note="Description of Artificial Sequence: Synthetic peptide"
QNTSFFLHY

SEQ ID NO: 15939 - protein, 9 aa, Artificial Sequence
  source: /note="Description of Artificial Sequence: Synthetic peptide"
NTSFFLHYL

SEQ ID NO: 15940 - protein, 9 aa, Artificial Sequence
  source: /note="Description of Artificial Sequence: Synthetic peptide"
LHYLMRWPI

SEQ ID NO: 15941 - protein, 9 aa, Artificial Sequence
  source: /note="Description of Artificial Sequence: Synthetic peptide"
NLIRRWTSF

SEQ ID NO: 15942 - protein, 9 aa, Artificial Sequence
  source: /note="Description of Artificial Sequence: Synthetic peptide"
LIRRWTSFW

SEQ ID NO: 15943 - protein, 9 aa, Artificial Sequence
  source: /note="Description of Artificial Sequence: Synthetic peptide"
WPINLIRRW

SEQ ID NO: 15944 - protein, 10 aa, Artificial Sequence
  source: /note="Description of Artificial Sequence: Synthetic peptide"
NTSFFLHYLM

SEQ ID NO: 15945 - protein, 10 aa, Artificial Sequence
  source: /note="Description of Artificial Sequence: Synthetic peptide"
VLLQNTSFFL

SEQ ID NO: 15946 - protein, 10 aa, Artificial Sequence
  source: /note="Description of Artificial Sequence: Synthetic peptide"
FLHYLMRWPI

SEQ ID NO: 15947 - protein, 10 aa, Artificial Sequence
  source: /note="Description of Artificial Sequence: Synthetic peptide"
YLMRWPINLI

SEQ ID NO: 15948 - protein, 10 aa, Artificial Sequence
  source: /note="Description of Artificial Sequence: Synthetic peptide"
TSFFLHYLMR

SEQ ID NO: 15949 - protein, 10 aa, Artificial Sequence
  source: /note="Description of Artificial Sequence: Synthetic peptide"
SFFLHYLMRW

SEQ ID NO: 15950 - protein, 10 aa, Artificial Sequence
  source: /note="Description of Artificial Sequence: Synthetic peptide"
HYLMRWPINL

SEQ ID NO: 15951 - protein, 10 aa, Artificial Sequence
  source: /note="Description of Artificial Sequence: Synthetic peptide"
RWPINLIRRW

SEQ ID NO: 15952 - protein, 10 aa, Artificial Sequence
  source: /note="Description of Artificial Sequence: Synthetic peptide"
LMRWPINLIR

SEQ ID NO: 15953 - protein, 10 aa, Artificial Sequence
  source: /note="Description of Artificial Sequence: Synthetic peptide"
LQNTSFFLHY

SEQ ID NO: 15954 - protein, 10 aa, Artificial Sequence
  source: /note="Description of Artificial Sequence: Synthetic peptide"
INLIRRWTSF

SEQ ID NO: 15955 - protein, 10 aa, Artificial Sequence
  source: /note="Description of Artificial Sequence: Synthetic peptide"
NLIRRWTSFW

SEQ ID NO: 15956 - protein, 10 aa, Artificial Sequence
  source: /note="Description of Artificial Sequence: Synthetic peptide"
IRRWTSFWEI

SEQ ID NO: 15957 - protein, 9 aa, Artificial Sequence
  source: /note="Description of Artificial Sequence: Synthetic peptide"
IQIGILIGI

SEQ ID NO: 15958 - protein, 9 aa, Artificial Sequence
  source: /note="Description of Artificial Sequence: Synthetic peptide"
APLPWHIQI

SEQ ID NO: 15959 - protein, 9 aa, Artificial Sequence
  source: /note="Description of Artificial Sequence: Synthetic peptide"
WHIQIGILI

SEQ ID NO: 15960 - protein, 9 aa, Artificial Sequence
  source: /note="Description of Artificial Sequence: Synthetic peptide"
LPWHIQIGI

SEQ ID NO: 15961 - protein, 10 aa, Artificial Sequence
  source: /note="Description of Artificial Sequence: Synthetic peptide"
QIGILIGISK

SEQ ID NO: 15962 - protein, 10 aa, Artificial Sequence
  source: /note="Description of Artificial Sequence: Synthetic peptide"
TAPLPWHIQI

SEQ ID NO: 15963 - protein, 10 aa, Artificial Sequence
  source: /note="Description of Artificial Sequence: Synthetic peptide"
LPWHIQIGIL

SEQ ID NO: 15964 - protein, 9 aa, Artificial Sequence
  source: /note="Description of Artificial Sequence: Synthetic peptide"
FQNDQNSSG

SEQ ID NO: 15965 - protein, 9 aa, Artificial Sequence
  source: /note="Description of Artificial Sequence: Synthetic peptide"
ISDPYRVYR

SEQ ID NO: 15966 - protein, 9 aa, Artificial Sequence
  source: /note="Description of Artificial Sequence: Synthetic peptide"
RVYRIVPEG

SEQ ID NO: 15967 - protein, 9 aa, Artificial Sequence
  source: /note="Description of Artificial Sequence: Synthetic peptide"
DISDPYRVY

SEQ ID NO: 15968 - protein, 9 aa, Artificial Sequence
  source: /note="Description of Artificial Sequence: Synthetic peptide"
DPYRVYRIV

SEQ ID NO: 15969 - protein, 10 aa, Artificial Sequence
  source: /note="Description of Artificial Sequence: Synthetic peptide"
QLDISDPYRV

SEQ ID NO: 15970 - protein, 10 aa, Artificial Sequence
  source: /note="Description of Artificial Sequence: Synthetic peptide"
RVYRIVPEGA

SEQ ID NO: 15971 - protein, 10 aa, Artificial Sequence
  source: /note="Description of Artificial Sequence: Synthetic peptide"
SQLDISDPYR

SEQ ID NO: 15972 - protein, 10 aa, Artificial Sequence
  source: /note="Description of Artificial Sequence: Synthetic peptide"
DISDPYRVYR

SEQ ID NO: 15973 - protein, 10 aa, Artificial Sequence
  source: /note="Description of Artificial Sequence: Synthetic peptide"
LDISDPYRVY

SEQ ID NO: 15974 - protein, 9 aa, Artificial Sequence
  source: /note="Description of Artificial Sequence: Synthetic peptide"
GQRLRKWER

SEQ ID NO: 15975 - protein, 9 aa, Artificial Sequence
  source: /note="Description of Artificial Sequence: Synthetic peptide"
RLRKWERIR

SEQ ID NO: 15976 - protein, 10 aa, Artificial Sequence
  source: /note="Description of Artificial Sequence: Synthetic peptide"
RLRKWERIRW

SEQ ID NO: 15977 - protein, 10 aa, Artificial Sequence
  source: /note="Description of Artificial Sequence: Synthetic peptide"
GKNSGGGQRL

SEQ ID NO: 15978 - protein, 10 aa, Artificial Sequence
  source: /note="Description of Artificial Sequence: Synthetic peptide"
RGAAAAAAAL

SEQ ID NO: 15979 - protein, 9 aa, Artificial Sequence
  source: /note="Description of Artificial Sequence: Synthetic peptide"
PPGPRPHPL

SEQ ID NO: 15980 - protein, 9 aa, Artificial Sequence
  source: /note="Description of Artificial Sequence: Synthetic peptide"
GPRPHPLSL

SEQ ID NO: 15981 - protein, 10 aa, Artificial Sequence
  source: /note="Description of Artificial Sequence: Synthetic peptide"
GPRPHPLSLL

SEQ ID NO: 15982 - protein, 9 aa, Artificial Sequence
  source: /note="Description of Artificial Sequence: Synthetic peptide"
PLNCVPCPR

SEQ ID NO: 15983 - protein, 10 aa, Artificial Sequence
  source: /note="Description of Artificial Sequence: Synthetic peptide"
ALQGLPLNCV

SEQ ID NO: 15984 - protein, 10 aa, Artificial Sequence
  source: /note="Description of Artificial Sequence: Synthetic peptide"
VPCPRRSEPV

SEQ ID NO: 15985 - protein, 9 aa, Artificial Sequence
  source: /note="Description of Artificial Sequence: Synthetic peptide"
KSKRRVCTT

SEQ ID NO: 15986 - protein, 9 aa, Artificial Sequence
  source: /note="Description of Artificial Sequence: Synthetic peptide"
CTTFTTEQL

SEQ ID NO: 15987 - protein, 9 aa, Artificial Sequence
  source: /note="Description of Artificial Sequence: Synthetic peptide"
SKRRVCTTF

SEQ ID NO: 15988 - protein, 9 aa, Artificial Sequence
  source: /note="Description of Artificial Sequence: Synthetic peptide"
RRVCTTFTT

SEQ ID NO: 15989 - protein, 10 aa, Artificial Sequence
  source: /note="Description of Artificial Sequence: Synthetic peptide"
KSKRRVCTTF

SEQ ID NO: 15990 - protein, 9 aa, Artificial Sequence
  source: /note="Description of Artificial Sequence: Synthetic peptide"
MFAEVGPAL

SEQ ID NO: 15991 - protein, 9 aa, Artificial Sequence
  source: /note="Description of Artificial Sequence: Synthetic peptide"
CRRQGQEAV

SEQ ID NO: 15992 - protein, 9 aa, Artificial Sequence
  source: /note="Description of Artificial Sequence: Synthetic peptide"
RQGQEAVCL

SEQ ID NO: 15993 - protein, 10 aa, Artificial Sequence
  source: /note="Description of Artificial Sequence: Synthetic peptide"
RRQGQEAVCL

SEQ ID NO: 15994 - protein, 10 aa, Artificial Sequence
  source: /note="Description of Artificial Sequence: Synthetic peptide"
RQGQEAVCLT

SEQ ID NO: 15995 - protein, 9 aa, Artificial Sequence
  source: /note="Description of Artificial Sequence: Synthetic peptide"
MTLHVKLPV

SEQ ID NO: 15996 - protein, 9 aa, Artificial Sequence
  source: /note="Description of Artificial Sequence: Synthetic peptide"
DAYEMTLHV

SEQ ID NO: 15997 - protein, 9 aa, Artificial Sequence
  source: /note="Description of Artificial Sequence: Synthetic peptide"
YEMTLHVKL

SEQ ID NO: 15998 - protein, 9 aa, Artificial Sequence
  source: /note="Description of Artificial Sequence: Synthetic peptide"
NAGDDAYEM

SEQ ID NO: 15999 - protein, 10 aa, Artificial Sequence
  source: /note="Description of Artificial Sequence: Synthetic peptide"
AYEMTLHVKL

SEQ ID NO: 16000 - protein, 10 aa, Artificial Sequence
  source: /note="Description of Artificial Sequence: Synthetic peptide"
DAYEMTLHVK

SEQ ID NO: 16001 - protein, 10 aa, Artificial Sequence
  source: /note="Description of Artificial Sequence: Synthetic peptide"
EMTLHVKLPV

SEQ ID NO: 16002 - protein, 10 aa, Artificial Sequence
  source: /note="Description of Artificial Sequence: Synthetic peptide"
FNAGDDAYEM

SEQ ID NO: 16003 - protein, 10 aa, Artificial Sequence
  source: /note="Description of Artificial Sequence: Synthetic peptide"
YEMTLHVKLP

SEQ ID NO: 16004 - protein, 9 aa, Artificial Sequence
  source: /note="Description of Artificial Sequence: Synthetic peptide"
HCLNLLCNF

SEQ ID NO: 16005 - protein, 10 aa, Artificial Sequence
  source: /note="Description of Artificial Sequence: Synthetic peptide"
CLNLLCNFGK

SEQ ID NO: 16006 - protein, 10 aa, Artificial Sequence
  source: /note="Description of Artificial Sequence: Synthetic peptide"
IKADPHCLNL

SEQ ID NO: 16007 - protein, 9 aa, Artificial Sequence
  source: /note="Description of Artificial Sequence: Synthetic peptide"
NLDAEDPAV

SEQ ID NO: 16008 - protein, 9 aa, Artificial Sequence
  source: /note="Description of Artificial Sequence: Synthetic peptide"
STFKECLEV

SEQ ID NO: 16009 - protein, 9 aa, Artificial Sequence
  source: /note="Description of Artificial Sequence: Synthetic peptide"
TFKECLEVK

SEQ ID NO: 16010 - protein, 9 aa, Artificial Sequence
  source: /note="Description of Artificial Sequence: Synthetic peptide"
KECLEVKPI

SEQ ID NO: 16011 - protein, 9 aa, Artificial Sequence
  source: /note="Description of Artificial Sequence: Synthetic peptide"
DESTFKECL

SEQ ID NO: 16012 - protein, 10 aa, Artificial Sequence
  source: /note="Description of Artificial Sequence: Synthetic peptide"
CLEVKPILNY

SEQ ID NO: 16013 - protein, 10 aa, Artificial Sequence
  source: /note="Description of Artificial Sequence: Synthetic peptide"
STFKECLEVK

SEQ ID NO: 16014 - protein, 10 aa, Artificial Sequence
  source: /note="Description of Artificial Sequence: Synthetic peptide"
ESTFKECLEV

SEQ ID NO: 16015 - protein, 10 aa, Artificial Sequence
  source: /note="Description of Artificial Sequence: Synthetic peptide"
KECLEVKPIL

SEQ ID NO: 16016 - protein, 9 aa, Artificial Sequence
  source: /note="Description of Artificial Sequence: Synthetic peptide"
GHLSPRATF

SEQ ID NO: 16017 - protein, 9 aa, Artificial Sequence
  source: /note="Description of Artificial Sequence: Synthetic peptide"
GIIHYAIGV

SEQ ID NO: 16018 - protein, 9 aa, Artificial Sequence
  source: /note="Description of Artificial Sequence: Synthetic peptide"
DAAGIIHYA

SEQ ID NO: 16019 - protein, 9 aa, Artificial Sequence
  source: /note="Description of Artificial Sequence: Synthetic peptide"
ADAAGIIHY

SEQ ID NO: 16020 - protein, 9 aa, Artificial Sequence
  source: /note="Description of Artificial Sequence: Synthetic peptide"
IHYAIGVGL

SEQ ID NO: 16021 - protein, 10 aa, Artificial Sequence
  source: /note="Description of Artificial Sequence: Synthetic peptide"
MADAAGIIHY

SEQ ID NO: 16022 - protein, 10 aa, Artificial Sequence
  source: /note="Description of Artificial Sequence: Synthetic peptide"
IIHYAIGVGL

SEQ ID NO: 16023 - protein, 10 aa, Artificial Sequence
  source: /note="Description of Artificial Sequence: Synthetic peptide"
HYAIGVGLAF

SEQ ID NO: 16024 - protein, 10 aa, Artificial Sequence
  source: /note="Description of Artificial Sequence: Synthetic peptide"
DAAGIIHYAI

SEQ ID NO: 16025 - protein, 10 aa, Artificial Sequence
  source: /note="Description of Artificial Sequence: Synthetic peptide"
IHYAIGVGLA

SEQ ID NO: 16026 - protein, 9 aa, Artificial Sequence
  source: /note="Description of Artificial Sequence: Synthetic peptide"
LIIDAYNSI

SEQ ID NO: 16027 - protein, 10 aa, Artificial Sequence
  source: /note="Description of Artificial Sequence: Synthetic peptide"
QLIIDAYNSI

SEQ ID NO: 16028 - protein, 10 aa, Artificial Sequence
  source: /note="Description of Artificial Sequence: Synthetic peptide"
AYNSISSEVI

SEQ ID NO: 16029 - protein, 10 aa, Artificial Sequence
  source: /note="Description of Artificial Sequence: Synthetic peptide"
DAYNSISSEV

SEQ ID NO: 16030 - protein, 9 aa, Artificial Sequence
  source: /note="Description of Artificial Sequence: Synthetic peptide"
SMKDNLENV

SEQ ID NO: 16031 - protein, 9 aa, Artificial Sequence
  source: /note="Description of Artificial Sequence: Synthetic peptide"
LSYSMKDNL

SEQ ID NO: 16032 - protein, 10 aa, Artificial Sequence
  source: /note="Description of Artificial Sequence: Synthetic peptide"
YSMKDNLENV

SEQ ID NO: 16033 - protein, 10 aa, Artificial Sequence
  source: /note="Description of Artificial Sequence: Synthetic peptide"
SMKDNLENVK

SEQ ID NO: 16034 - protein, 9 aa, Artificial Sequence
  source: /note="Description of Artificial Sequence: Synthetic peptide"
CGSALAFFY

SEQ ID NO: 16035 - protein, 9 aa, Artificial Sequence
  source: /note="Description of Artificial Sequence: Synthetic peptide"
ALAFFYRCI

SEQ ID NO: 16036 - protein, 9 aa, Artificial Sequence
  source: /note="Description of Artificial Sequence: Synthetic peptide"
LVPLGSLGV

SEQ ID NO: 16037 - protein, 9 aa, Artificial Sequence
  source: /note="Description of Artificial Sequence: Synthetic peptide"
GSALAFFYR

SEQ ID NO: 16038 - protein, 9 aa, Artificial Sequence
  source: /note="Description of Artificial Sequence: Synthetic peptide"
FTCSWTGPR

SEQ ID NO: 16039 - protein, 9 aa, Artificial Sequence
  source: /note="Description of Artificial Sequence: Synthetic peptide"
FYRCICLPA

SEQ ID NO: 16040 - protein, 9 aa, Artificial Sequence
  source: /note="Description of Artificial Sequence: Synthetic peptide"
RSRLVPLGS

SEQ ID NO: 16041 - protein, 9 aa, Artificial Sequence
  source: /note="Description of Artificial Sequence: Synthetic peptide"
CLPAKRPAR

SEQ ID NO: 16042 - protein, 9 aa, Artificial Sequence
  source: /note="Description of Artificial Sequence: Synthetic peptide"
RPARSRLVP

SEQ ID NO: 16043 - protein, 9 aa, Artificial Sequence
  source: /note="Description of Artificial Sequence: Synthetic peptide"
VPLGSLGVF

SEQ ID NO: 16044 - protein, 9 aa, Artificial Sequence
  source: /note="Description of Artificial Sequence: Synthetic peptide"
PARSRLVPL

SEQ ID NO: 16045 - protein, 9 aa, Artificial Sequence
  source: /note="Description of Artificial Sequence: Synthetic peptide"
AKRPARSRL

SEQ ID NO: 16046 - protein, 9 aa, Artificial Sequence
  source: /note="Description of Artificial Sequence: Synthetic peptide"
SRLVPLGSL

SEQ ID NO: 16047 - protein, 9 aa, Artificial Sequence
  source: /note="Description of Artificial Sequence: Synthetic peptide"
SLGVFTCSW

SEQ ID NO: 16048 - protein, 10 aa, Artificial Sequence
  source: /note="Description of Artificial Sequence: Synthetic peptide"
RLVPLGSLGV

SEQ ID NO: 16049 - protein, 10 aa, Artificial Sequence
  source: /note="Description of Artificial Sequence: Synthetic peptide"
FFYRCICLPA

SEQ ID NO: 16050 - protein, 10 aa, Artificial Sequence
  source: /note="Description of Artificial Sequence: Synthetic peptide"
CGSALAFFYR

SEQ ID NO: 16051 - protein, 10 aa, Artificial Sequence
  source: /note="Description of Artificial Sequence: Synthetic peptide"
FYRCICLPAK

SEQ ID NO: 16052 - protein, 10 aa, Artificial Sequence
  source: /note="Description of Artificial Sequence: Synthetic peptide"
RSRLVPLGSL

SEQ ID NO: 16053 - protein, 10 aa, Artificial Sequence
  source: /note="Description of Artificial Sequence: Synthetic peptide"
MCGSALAFFY

SEQ ID NO: 16054 - protein, 10 aa, Artificial Sequence
  source: /note="Description of Artificial Sequence: Synthetic peptide"
VFTCSWTGPR

SEQ ID NO: 16055 - protein, 10 aa, Artificial Sequence
  source: /note="Description of Artificial Sequence: Synthetic peptide"
RPARSRLVPL

SEQ ID NO: 16056 - protein, 10 aa, Artificial Sequence
  source: /note="Description of Artificial Sequence: Synthetic peptide"
LAFFYRCICL

SEQ ID NO: 16057 - protein, 10 aa, Artificial Sequence
  source: /note="Description of Artificial Sequence: Synthetic peptide"
GSLGVFTCSW

SEQ ID NO: 16058 - protein, 10 aa, Artificial Sequence
  source: /note="Description of Artificial Sequence: Synthetic peptide"
SALAFFYRCI

SEQ ID NO: 16059 - protein, 9 aa, Artificial Sequence
  source: /note="Description of Artificial Sequence: Synthetic peptide"
SLLNWHFKV

SEQ ID NO: 16060 - protein, 9 aa, Artificial Sequence
  source: /note="Description of Artificial Sequence: Synthetic peptide"
TSLLNWHFK

SEQ ID NO: 16061 - protein, 9 aa, Artificial Sequence
  source: /note="Description of Artificial Sequence: Synthetic peptide"
STSLLNWHF

SEQ ID NO: 16062 - protein, 9 aa, Artificial Sequence
  source: /note="Description of Artificial Sequence: Synthetic peptide"
LNWHFKVTY

SEQ ID NO: 16063 - protein, 10 aa, Artificial Sequence
  source: /note="Description of Artificial Sequence: Synthetic peptide"
STSLLNWHFK

SEQ ID NO: 16064 - protein, 10 aa, Artificial Sequence
  source: /note="Description of Artificial Sequence: Synthetic peptide"
CSTSLLNWHF

SEQ ID NO: 16065 - protein, 10 aa, Artificial Sequence
  source: /note="Description of Artificial Sequence: Synthetic peptide"
LLNWHFKVTY

SEQ ID NO: 16066 - protein, 10 aa, Artificial Sequence
  source: /note="Description of Artificial Sequence: Synthetic peptide"
TSLLNWHFKV

SEQ ID NO: 16067 - protein, 9 aa, Artificial Sequence
  source: /note="Description of Artificial Sequence: Synthetic peptide"
VNVDFVGIY

SEQ ID NO: 16068 - protein, 9 aa, Artificial Sequence
  source: /note="Description of Artificial Sequence: Synthetic peptide"
NVDFVGIYI

SEQ ID NO: 16069 - protein, 9 aa, Artificial Sequence
  source: /note="Description of Artificial Sequence: Synthetic peptide"
HPVNVDFVG

SEQ ID NO: 16070 - protein, 10 aa, Artificial Sequence
  source: /note="Description of Artificial Sequence: Synthetic peptide"
VGIYIPPTNK

SEQ ID NO: 16071 - protein, 10 aa, Artificial Sequence
  source: /note="Description of Artificial Sequence: Synthetic peptide"
PVNVDFVGIY

SEQ ID NO: 16072 - protein, 10 aa, Artificial Sequence
  source: /note="Description of Artificial Sequence: Synthetic peptide"
HPVNVDFVGI

SEQ ID NO: 16073 - protein, 9 aa, Artificial Sequence
  source: /note="Description of Artificial Sequence: Synthetic peptide"
LALRRNKEY

SEQ ID NO: 16074 - protein, 9 aa, Artificial Sequence
  source: /note="Description of Artificial Sequence: Synthetic peptide"
RRNKEYCLL

SEQ ID NO: 16075 - protein, 9 aa, Artificial Sequence
  source: /note="Description of Artificial Sequence: Synthetic peptide"
KEYCLLDSS

SEQ ID NO: 16076 - protein, 10 aa, Artificial Sequence
  source: /note="Description of Artificial Sequence: Synthetic peptide"
ALRRNKEYCL

SEQ ID NO: 16077 - protein, 10 aa, Artificial Sequence
  source: /note="Description of Artificial Sequence: Synthetic peptide"
ELALRRNKEY

SEQ ID NO: 16078 - protein, 9 aa, Artificial Sequence
  source: /note="Description of Artificial Sequence: Synthetic peptide"
SNFKVLFFV

SEQ ID NO: 16079 - protein, 9 aa, Artificial Sequence
  source: /note="Description of Artificial Sequence: Synthetic peptide"
VLFFVLTKA

SEQ ID NO: 16080 - protein, 9 aa, Artificial Sequence
  source: /note="Description of Artificial Sequence: Synthetic peptide"
KVLFFVLTK

SEQ ID NO: 16081 - protein, 9 aa, Artificial Sequence
  source: /note="Description of Artificial Sequence: Synthetic peptide"
NFKVLFFVL

SEQ ID NO: 16082 - protein, 9 aa, Artificial Sequence
  source: /note="Description of Artificial Sequence: Synthetic peptide"
SPSNFKVLF

SEQ ID NO: 16083 - protein, 10 aa, Artificial Sequence
  source: /note="Description of Artificial Sequence: Synthetic peptide"
KVLFFVLTKA

SEQ ID NO: 16084 - protein, 10 aa, Artificial Sequence
  source: /note="Description of Artificial Sequence: Synthetic peptide"
TSPSNFKVLF

SEQ ID NO: 16085 - protein, 10 aa, Artificial Sequence
  source: /note="Description of Artificial Sequence: Synthetic peptide"
RTSPSNFKVL

SEQ ID NO: 16086 - protein, 10 aa, Artificial Sequence
  source: /note="Description of Artificial Sequence: Synthetic peptide"
SPSNFKVLFF

SEQ ID NO: 16087 - protein, 10 aa, Artificial Sequence
  source: /note="Description of Artificial Sequence: Synthetic peptide"
SNFKVLFFVL

SEQ ID NO: 16088 - protein, 10 aa, Artificial Sequence
  source: /note="Description of Artificial Sequence: Synthetic peptide"
LFFVLTKASL

SEQ ID NO: 16089 - protein, 9 aa, Artificial Sequence
  source: /note="Description of Artificial Sequence: Synthetic peptide"
YVIKLNTTI

SEQ ID NO: 16090 - protein, 9 aa, Artificial Sequence
  source: /note="Description of Artificial Sequence: Synthetic peptide"
VIKLNTTIV

SEQ ID NO: 16091 - protein, 9 aa, Artificial Sequence
  source: /note="Description of Artificial Sequence: Synthetic peptide"
SLDKCYVIK

SEQ ID NO: 16092 - protein, 9 aa, Artificial Sequence
  source: /note="Description of Artificial Sequence: Synthetic peptide"
IKLNTTIVL

SEQ ID NO: 16093 - protein, 10 aa, Artificial Sequence
  source: /note="Description of Artificial Sequence: Synthetic peptide"
SLDKCYVIKL

SEQ ID NO: 16094 - protein, 10 aa, Artificial Sequence
  source: /note="Description of Artificial Sequence: Synthetic peptide"
YVIKLNTTIV

SEQ ID NO: 16095 - protein, 10 aa, Artificial Sequence
  source: /note="Description of Artificial Sequence: Synthetic peptide"
ISLDKCYVIK

SEQ ID NO: 16096 - protein, 10 aa, Artificial Sequence
  source: /note="Description of Artificial Sequence: Synthetic peptide"
CYVIKLNTTI

SEQ ID NO: 16097 - protein, 9 aa, Artificial Sequence
  source: /note="Description of Artificial Sequence: Synthetic peptide"
NMCHYLCFI

SEQ ID NO: 16098 - protein, 9 aa, Artificial Sequence
  source: /note="Description of Artificial Sequence: Synthetic peptide"
HNMCHYLCF

SEQ ID NO: 16099 - protein, 9 aa, Artificial Sequence
  source: /note="Description of Artificial Sequence: Synthetic peptide"
KEEHNMCHY

SEQ ID NO: 16100 - protein, 9 aa, Artificial Sequence
  source: /note="Description of Artificial Sequence: Synthetic peptide"
CHYLCFIVL

SEQ ID NO: 16101 - protein, 9 aa, Artificial Sequence
  source: /note="Description of Artificial Sequence: Synthetic peptide"
EEHNMCHYL

SEQ ID NO: 16102 - protein, 10 aa, Artificial Sequence
  source: /note="Description of Artificial Sequence: Synthetic peptide"
NMCHYLCFIV

SEQ ID NO: 16103 - protein, 10 aa, Artificial Sequence
  source: /note="Description of Artificial Sequence: Synthetic peptide"
HNMCHYLCFI

SEQ ID NO: 16104 - protein, 10 aa, Artificial Sequence
  source: /note="Description of Artificial Sequence: Synthetic peptide"
IKEEHNMCHY

SEQ ID NO: 16105 - protein, 10 aa, Artificial Sequence
  source: /note="Description of Artificial Sequence: Synthetic peptide"
KEEHNMCHYL

SEQ ID NO: 16106 - protein, 10 aa, Artificial Sequence
  source: /note="Description of Artificial Sequence: Synthetic peptide"
MCHYLCFIVL

SEQ ID NO: 16107 - protein, 9 aa, Artificial Sequence
  source: /note="Description of Artificial Sequence: Synthetic peptide"
IMYTLVSVQ

SEQ ID NO: 16108 - protein, 9 aa, Artificial Sequence
  source: /note="Description of Artificial Sequence: Synthetic peptide"
VQHGNDIAS

SEQ ID NO: 16109 - protein, 10 aa, Artificial Sequence
  source: /note="Description of Artificial Sequence: Synthetic peptide"
IMYTLVSVQH

SEQ ID NO: 16110 - protein, 10 aa, Artificial Sequence
  source: /note="Description of Artificial Sequence: Synthetic peptide"
VQHGNDIASL

SEQ ID NO: 16111 - protein, 10 aa, Artificial Sequence
  source: /note="Description of Artificial Sequence: Synthetic peptide"
QHGNDIASLF

SEQ ID NO: 16112 - protein, 10 aa, Artificial Sequence
  source: /note="Description of Artificial Sequence: Synthetic peptide"
RKFTDIRKKA

SEQ ID NO: 16113 - protein, 10 aa, Artificial Sequence
  source: /note="Description of Artificial Sequence: Synthetic peptide"
TSCRDLVNGY

SEQ ID NO: 16114 - protein, 10 aa, Artificial Sequence
  source: /note="Description of Artificial Sequence: Synthetic peptide"
CQNDTSCRDL

SEQ ID NO: 16115 - protein, 9 aa, Artificial Sequence
  source: /note="Description of Artificial Sequence: Synthetic peptide"
SNDGGNILY

SEQ ID NO: 16116 - protein, 9 aa, Artificial Sequence
  source: /note="Description of Artificial Sequence: Synthetic peptide"
NILYYEVMV

SEQ ID NO: 16117 - protein, 9 aa, Artificial Sequence
  source: /note="Description of Artificial Sequence: Synthetic peptide"
ILYYEVMVT

SEQ ID NO: 16118 - protein, 9 aa, Artificial Sequence
  source: /note="Description of Artificial Sequence: Synthetic peptide"
HSNDGGNIL

SEQ ID NO: 16119 - protein, 9 aa, Artificial Sequence
  source: /note="Description of Artificial Sequence: Synthetic peptide"
GNILYYEVM

SEQ ID NO: 16120 - protein, 10 aa, Artificial Sequence
  source: /note="Description of Artificial Sequence: Synthetic peptide"
HSNDGGNILY

SEQ ID NO: 16121 - protein, 10 aa, Artificial Sequence
  source: /note="Description of Artificial Sequence: Synthetic peptide"
SNDGGNILYY

SEQ ID NO: 16122 - protein, 10 aa, Artificial Sequence
  source: /note="Description of Artificial Sequence: Synthetic peptide"
FHSNDGGNIL

SEQ ID NO: 16123 - protein, 9 aa, Artificial Sequence
  source: /note="Description of Artificial Sequence: Synthetic peptide"
INQKRIAEL

SEQ ID NO: 16124 - protein, 10 aa, Artificial Sequence
  source: /note="Description of Artificial Sequence: Synthetic peptide"
RINQKRIAEL

SEQ ID NO: 16125 - protein, 10 aa, Artificial Sequence
  source: /note="Description of Artificial Sequence: Synthetic peptide"
SSPDLRINQK

SEQ ID NO: 16126 - protein, 9 aa, Artificial Sequence
  source: /note="Description of Artificial Sequence: Synthetic peptide"
GQWQVEPKV

SEQ ID NO: 16127 - protein, 9 aa, Artificial Sequence
  source: /note="Description of Artificial Sequence: Synthetic peptide"
QWPQGQWQV

SEQ ID NO: 16128 - protein, 9 aa, Artificial Sequence
  source: /note="Description of Artificial Sequence: Synthetic peptide"
GVQVHWARR

SEQ ID NO: 16129 - protein, 9 aa, Artificial Sequence
  source: /note="Description of Artificial Sequence: Synthetic peptide"
RQWPQGQWQ

SEQ ID NO: 16130 - protein, 9 aa, Artificial Sequence
  source: /note="Description of Artificial Sequence: Synthetic peptide"
WQVEPKVMH

SEQ ID NO: 16131 - protein, 10 aa, Artificial Sequence
  source: /note="Description of Artificial Sequence: Synthetic peptide"
VLSLGGGVQV

SEQ ID NO: 16132 - protein, 10 aa, Artificial Sequence
  source: /note="Description of Artificial Sequence: Synthetic peptide"
RQWPQGQWQV

SEQ ID NO: 16133 - protein, 10 aa, Artificial Sequence
  source: /note="Description of Artificial Sequence: Synthetic peptide"
KQVLSLGGGV

SEQ ID NO: 16134 - protein, 10 aa, Artificial Sequence
  source: /note="Description of Artificial Sequence: Synthetic peptide"
LSLGGGVQVH

SEQ ID NO: 16135 - protein, 10 aa, Artificial Sequence
  source: /note="Description of Artificial Sequence: Synthetic peptide"
SLGGGVQVHW

SEQ ID NO: 16136 - protein, 10 aa, Artificial Sequence
  source: /note="Description of Artificial Sequence: Synthetic peptide"
VQVHWARRQW

SEQ ID NO: 16137 - protein, 10 aa, Artificial Sequence
  source: /note="Description of Artificial Sequence: Synthetic peptide"
ARRQWPQGQW

SEQ ID NO: 16138 - protein, 10 aa, Artificial Sequence
  source: /note="Description of Artificial Sequence: Synthetic peptide"
GQWQVEPKVM

SEQ ID NO: 16139 - protein, 9 aa, Artificial Sequence
  source: /note="Description of Artificial Sequence: Synthetic peptide"
CGRACSCGR

SEQ ID NO: 16140 - protein, 9 aa, Artificial Sequence
  source: /note="Description of Artificial Sequence: Synthetic peptide"
KRHTRRRSR

SEQ ID NO: 16141 - protein, 9 aa, Artificial Sequence
  source: /note="Description of Artificial Sequence: Synthetic peptide"
HTRRRSRSR

SEQ ID NO: 16142 - protein, 9 aa, Artificial Sequence
  source: /note="Description of Artificial Sequence: Synthetic peptide"
RRSRSRPPR

SEQ ID NO: 16143 - protein, 9 aa, Artificial Sequence
  source: /note="Description of Artificial Sequence: Synthetic peptide"
RSRSRPPRR

SEQ ID NO: 16144 - protein, 9 aa, Artificial Sequence
  source: /note="Description of Artificial Sequence: Synthetic peptide"
EVGGGSCGR

SEQ ID NO: 16145 - protein, 10 aa, Artificial Sequence
  source: /note="Description of Artificial Sequence: Synthetic peptide"
HTRRRSRSRP

SEQ ID NO: 16146 - protein, 10 aa, Artificial Sequence
  source: /note="Description of Artificial Sequence: Synthetic peptide"
RRRSRSRPPR

SEQ ID NO: 16147 - protein, 9 aa, Artificial Sequence
  source: /note="Description of Artificial Sequence: Synthetic peptide"
MMVPNQCKL

SEQ ID NO: 16148 - protein, 9 aa, Artificial Sequence
  source: /note="Description of Artificial Sequence: Synthetic peptide"
MTTQKLMMV

SEQ ID NO: 16149 - protein, 9 aa, Artificial Sequence
  source: /note="Description of Artificial Sequence: Synthetic peptide"
LMMVPNQCK

SEQ ID NO: 16150 - protein, 9 aa, Artificial Sequence
  source: /note="Description of Artificial Sequence: Synthetic peptide"
VPNQCKLEL

SEQ ID NO: 16151 - protein, 9 aa, Artificial Sequence
  source: /note="Description of Artificial Sequence: Synthetic peptide"
ELSLRNYAL

SEQ ID NO: 16152 - protein, 9 aa, Artificial Sequence
  source: /note="Description of Artificial Sequence: Synthetic peptide"
KKGGTGTDM

SEQ ID NO: 16153 - protein, 9 aa, Artificial Sequence
  source: /note="Description of Artificial Sequence: Synthetic peptide"
TDMTTQKLM

SEQ ID NO: 16154 - protein, 9 aa, Artificial Sequence
  source: /note="Description of Artificial Sequence: Synthetic peptide"
NQCKLELEL

SEQ ID NO: 16155 - protein, 9 aa, Artificial Sequence
  source: /note="Description of Artificial Sequence: Synthetic peptide"
CKLELELSL

SEQ ID NO: 16156 - protein, 9 aa, Artificial Sequence
  source: /note="Description of Artificial Sequence: Synthetic peptide"
ALESSQVPM

SEQ ID NO: 16157 - protein, 9 aa, Artificial Sequence
  source: /note="Description of Artificial Sequence: Synthetic peptide"
LELSLRNYA

SEQ ID NO: 16158 - protein, 10 aa, Artificial Sequence
  source: /note="Description of Artificial Sequence: Synthetic peptide"
GTDMTTQKLM

SEQ ID NO: 16159 - protein, 10 aa, Artificial Sequence
  source: /note="Description of Artificial Sequence: Synthetic peptide"
LMMVPNQCKL

SEQ ID NO: 16160 - protein, 10 aa, Artificial Sequence
  source: /note="Description of Artificial Sequence: Synthetic peptide"
SLMKKGGTGT

SEQ ID NO: 16161 - protein, 10 aa, Artificial Sequence
  source: /note="Description of Artificial Sequence: Synthetic peptide"
KLMMVPNQCK

SEQ ID NO: 16162 - protein, 10 aa, Artificial Sequence
  source: /note="Description of Artificial Sequence: Synthetic peptide"
ALESSQVPMK

SEQ ID NO: 16163 - protein, 10 aa, Artificial Sequence
  source: /note="Description of Artificial Sequence: Synthetic peptide"
GTGTDMTTQK

SEQ ID NO: 16164 - protein, 10 aa, Artificial Sequence
  source: /note="Description of Artificial Sequence: Synthetic peptide"
YALESSQVPM

SEQ ID NO: 16165 - protein, 10 aa, Artificial Sequence
  source: /note="Description of Artificial Sequence: Synthetic peptide"
MKKGGTGTDM

SEQ ID NO: 16166 - protein, 10 aa, Artificial Sequence
  source: /note="Description of Artificial Sequence: Synthetic peptide"
TDMTTQKLMM

SEQ ID NO: 16167 - protein, 10 aa, Artificial Sequence
  source: /note="Description of Artificial Sequence: Synthetic peptide"
LELELSLRNY

SEQ ID NO: 16168 - protein, 10 aa, Artificial Sequence
  source: /note="Description of Artificial Sequence: Synthetic peptide"
LELSLRNYAL

SEQ ID NO: 16169 - protein, 10 aa, Artificial Sequence
  source: /note="Description of Artificial Sequence: Synthetic peptide"
RNYALESSQV

SEQ ID NO: 16170 - protein, 9 aa, Artificial Sequence
  source: /note="Description of Artificial Sequence: Synthetic peptide"
PTDENLAHY

SEQ ID NO: 16171 - protein, 9 aa, Artificial Sequence
  source: /note="Description of Artificial Sequence: Synthetic peptide"
AHYESWSSS

SEQ ID NO: 16172 - protein, 9 aa, Artificial Sequence
  source: /note="Description of Artificial Sequence: Synthetic peptide"
DENLAHYES

SEQ ID NO: 16173 - protein, 10 aa, Artificial Sequence
  source: /note="Description of Artificial Sequence: Synthetic peptide"
KPTDENLAHY

SEQ ID NO: 16174 - protein, 10 aa, Artificial Sequence
  source: /note="Description of Artificial Sequence: Synthetic peptide"
AHYESWSSSV

SEQ ID NO: 16175 - protein, 10 aa, Artificial Sequence
  source: /note="Description of Artificial Sequence: Synthetic peptide"
DENLAHYESW

SEQ ID NO: 16176 - protein, 9 aa, Artificial Sequence
  source: /note="Description of Artificial Sequence: Synthetic peptide"
LSSMPALHR

SEQ ID NO: 16177 - protein, 9 aa, Artificial Sequence
  source: /note="Description of Artificial Sequence: Synthetic peptide"
SSMPALHRA

SEQ ID NO: 16178 - protein, 9 aa, Artificial Sequence
  source: /note="Description of Artificial Sequence: Synthetic peptide"
NTLSSMPAL

SEQ ID NO: 16179 - protein, 9 aa, Artificial Sequence
  source: /note="Description of Artificial Sequence: Synthetic peptide"
SSTNTLSSM

SEQ ID NO: 16180 - protein, 10 aa, Artificial Sequence
  source: /note="Description of Artificial Sequence: Synthetic peptide"
TLSSMPALHR

SEQ ID NO: 16181 - protein, 10 aa, Artificial Sequence
  source: /note="Description of Artificial Sequence: Synthetic peptide"
STNTLSSMPA

SEQ ID NO: 16182 - protein, 10 aa, Artificial Sequence
  source: /note="Description of Artificial Sequence: Synthetic peptide"
VSSTNTLSSM

SEQ ID NO: 16183 - protein, 9 aa, Artificial Sequence
  source: /note="Description of Artificial Sequence: Synthetic peptide"
LVGQKRGAL

SEQ ID NO: 16184 - protein, 10 aa, Artificial Sequence
  source: /note="Description of Artificial Sequence: Synthetic peptide"
LVGQKRGALR

SEQ ID NO: 16185 - protein, 10 aa, Artificial Sequence
  source: /note="Description of Artificial Sequence: Synthetic peptide"
SPLPPTPPPL

SEQ ID NO: 16186 - protein, 10 aa, Artificial Sequence
  source: /note="Description of Artificial Sequence: Synthetic peptide"
LPPTPPPLPV

SEQ ID NO: 16187 - protein, 9 aa, Artificial Sequence
  source: /note="Description of Artificial Sequence: Synthetic peptide"
DAADQATLA

SEQ ID NO: 16188 - protein, 10 aa, Artificial Sequence
  source: /note="Description of Artificial Sequence: Synthetic peptide"
TLAARQECDI

SEQ ID NO: 16189 - protein, 10 aa, Artificial Sequence
  source: /note="Description of Artificial Sequence: Synthetic peptide"
DAADQATLAA

SEQ ID NO: 16190 - protein, 10 aa, Artificial Sequence
  source: /note="Description of Artificial Sequence: Synthetic peptide"
KADAADQATL

SEQ ID NO: 16191 - protein, 10 aa, Artificial Sequence
  source: /note="Description of Artificial Sequence: Synthetic peptide"
NGLEYHRPKR

SEQ ID NO: 16192 - protein, 10 aa, Artificial Sequence
  source: /note="Description of Artificial Sequence: Synthetic peptide"
YHRPKRQTSC

SEQ ID NO: 16193 - protein, 9 aa, Artificial Sequence
  source: /note="Description of Artificial Sequence: Synthetic peptide"
KAGASPRSA

SEQ ID NO: 16194 - protein, 9 aa, Artificial Sequence
  source: /note="Description of Artificial Sequence: Synthetic peptide"
SPRSAPARK

SEQ ID NO: 16195 - protein, 9 aa, Artificial Sequence
  source: /note="Description of Artificial Sequence: Synthetic peptide"
RSAPARKKA

SEQ ID NO: 16196 - protein, 10 aa, Artificial Sequence
  source: /note="Description of Artificial Sequence: Synthetic peptide"
ASPRSAPARK

SEQ ID NO: 16197 - protein, 10 aa, Artificial Sequence
  source: /note="Description of Artificial Sequence: Synthetic peptide"
GASPRSAPAR

SEQ ID NO: 16198 - protein, 10 aa, Artificial Sequence
  source: /note="Description of Artificial Sequence: Synthetic peptide"
APARKKAQTA

SEQ ID NO: 16199 - protein, 10 aa, Artificial Sequence
  source: /note="Description of Artificial Sequence: Synthetic peptide"
LKAGASPRSA

SEQ ID NO: 16200 - protein, 9 aa, Artificial Sequence
  source: /note="Description of Artificial Sequence: Synthetic peptide"
ALAPLMELL

SEQ ID NO: 16201 - protein, 9 aa, Artificial Sequence
  source: /note="Description of Artificial Sequence: Synthetic peptide"
AEGALAPLM

SEQ ID NO: 16202 - protein, 9 aa, Artificial Sequence
  source: /note="Description of Artificial Sequence: Synthetic peptide"
GALAPLMEL

SEQ ID NO: 16203 - protein, 9 aa, Artificial Sequence
  source: /note="Description of Artificial Sequence: Synthetic peptide"
DAIDAEGAL

SEQ ID NO: 16204 - protein, 10 aa, Artificial Sequence
  source: /note="Description of Artificial Sequence: Synthetic peptide"
DAIDAEGALA

SEQ ID NO: 16205 - protein, 10 aa, Artificial Sequence
  source: /note="Description of Artificial Sequence: Synthetic peptide"
IDAEGALAPL

SEQ ID NO: 16206 - protein, 9 aa, Artificial Sequence
  source: /note="Description of Artificial Sequence: Synthetic peptide"
STINSDGSV

SEQ ID NO: 16207 - protein, 9 aa, Artificial Sequence
  source: /note="Description of Artificial Sequence: Synthetic peptide"
NLRLANSTI

SEQ ID NO: 16208 - protein, 10 aa, Artificial Sequence
  source: /note="Description of Artificial Sequence: Synthetic peptide"
TINSDGSVTV

SEQ ID NO: 16209 - protein, 10 aa, Artificial Sequence
  source: /note="Description of Artificial Sequence: Synthetic peptide"
NSTINSDGSV

SEQ ID NO: 16210 - protein, 10 aa, Artificial Sequence
  source: /note="Description of Artificial Sequence: Synthetic peptide"
ANLRLANSTI

SEQ ID NO: 16211 - protein, 9 aa, Artificial Sequence
  source: /note="Description of Artificial Sequence: Synthetic peptide"
AERELELLH

SEQ ID NO: 16212 - protein, 9 aa, Artificial Sequence
  source: /note="Description of Artificial Sequence: Synthetic peptide"
RELELLHAS

SEQ ID NO: 16213 - protein, 10 aa, Artificial Sequence
  source: /note="Description of Artificial Sequence: Synthetic peptide"
LLHASLEHQR

SEQ ID NO: 16214 - protein, 10 aa, Artificial Sequence
  source: /note="Description of Artificial Sequence: Synthetic peptide"
AERELELLHA

SEQ ID NO: 16215 - protein, 10 aa, Artificial Sequence
  source: /note="Description of Artificial Sequence: Synthetic peptide"
RELELLHASL

SEQ ID NO: 16216 - protein, 10 aa, Artificial Sequence
  source: /note="Description of Artificial Sequence: Synthetic peptide"
LELLHASLEH

SEQ ID NO: 16217 - protein, 9 aa, Artificial Sequence
  source: /note="Description of Artificial Sequence: Synthetic peptide"
PLPGPPFPF

SEQ ID NO: 16218 - protein, 9 aa, Artificial Sequence
  source: /note="Description of Artificial Sequence: Synthetic peptide"
PFQNVLVVL

SEQ ID NO: 16219 - protein, 9 aa, Artificial Sequence
  source: /note="Description of Artificial Sequence: Synthetic peptide"
FPFQNVLVV

SEQ ID NO: 16220 - protein, 9 aa, Artificial Sequence
  source: /note="Description of Artificial Sequence: Synthetic peptide"
GPPFPFQNV

SEQ ID NO: 16221 - protein, 10 aa, Artificial Sequence
  source: /note="Description of Artificial Sequence: Synthetic peptide"
LPLPGPPFPF

SEQ ID NO: 16222 - protein, 10 aa, Artificial Sequence
  source: /note="Description of Artificial Sequence: Synthetic peptide"
GPPFPFQNVL

SEQ ID NO: 16223 - protein, 10 aa, Artificial Sequence
  source: /note="Description of Artificial Sequence: Synthetic peptide"
FPFQNVLVVL

SEQ ID NO: 16224 - protein, 10 aa, Artificial Sequence
  source: /note="Description of Artificial Sequence: Synthetic peptide"
PPFPFQNVLV

SEQ ID NO: 16225 - protein, 9 aa, Artificial Sequence
  source: /note="Description of Artificial Sequence: Synthetic peptide"
AVVCLEFPL

SEQ ID NO: 16226 - protein, 9 aa, Artificial Sequence
  source: /note="Description of Artificial Sequence: Synthetic peptide"
CLEFPLLTV

SEQ ID NO: 16227 - protein, 9 aa, Artificial Sequence
  source: /note="Description of Artificial Sequence: Synthetic peptide"
VTAVVCLEF

SEQ ID NO: 16228 - protein, 9 aa, Artificial Sequence
  source: /note="Description of Artificial Sequence: Synthetic peptide"
LEFPLLTVD

SEQ ID NO: 16229 - protein, 10 aa, Artificial Sequence
  source: /note="Description of Artificial Sequence: Synthetic peptide"
YVTAVVCLEF

SEQ ID NO: 16230 - protein, 10 aa, Artificial Sequence
  source: /note="Description of Artificial Sequence: Synthetic peptide"
TAVVCLEFPL

SEQ ID NO: 16231 - protein, 9 aa, Artificial Sequence
  source: /note="Description of Artificial Sequence: Synthetic peptide"
QVVECAAFL

SEQ ID NO: 16232 - protein, 9 aa, Artificial Sequence
  source: /note="Description of Artificial Sequence: Synthetic peptide"
LQVVECAAF

SEQ ID NO: 16233 - protein, 9 aa, Artificial Sequence
  source: /note="Description of Artificial Sequence: Synthetic peptide"
AEDELLQVV

SEQ ID NO: 16234 - protein, 10 aa, Artificial Sequence
  source: /note="Description of Artificial Sequence: Synthetic peptide"
LLQVVECAAF

SEQ ID NO: 16235 - protein, 10 aa, Artificial Sequence
  source: /note="Description of Artificial Sequence: Synthetic peptide"
LQVVECAAFL

SEQ ID NO: 16236 - protein, 10 aa, Artificial Sequence
  source: /note="Description of Artificial Sequence: Synthetic peptide"
DELLQVVECA

SEQ ID NO: 16237 - protein, 9 aa, Artificial Sequence
  source: /note="Description of Artificial Sequence: Synthetic peptide"
YILGGARPY

SEQ ID NO: 16238 - protein, 9 aa, Artificial Sequence
  source: /note="Description of Artificial Sequence: Synthetic peptide"
ILGGARPYY

SEQ ID NO: 16239 - protein, 9 aa, Artificial Sequence
  source: /note="Description of Artificial Sequence: Synthetic peptide"
YIYILGGAR

SEQ ID NO: 16240 - protein, 10 aa, Artificial Sequence
  source: /note="Description of Artificial Sequence: Synthetic peptide"
ILGGARPYYW

SEQ ID NO: 16241 - protein, 10 aa, Artificial Sequence
  source: /note="Description of Artificial Sequence: Synthetic peptide"
IYILGGARPY

SEQ ID NO: 16242 - protein, 10 aa, Artificial Sequence
  source: /note="Description of Artificial Sequence: Synthetic peptide"
YILGGARPYY

SEQ ID NO: 16243 - protein, 10 aa, Artificial Sequence
  source: /note="Description of Artificial Sequence: Synthetic peptide"
GYIYILGGAR

SEQ ID NO: 16244 - protein, 9 aa, Artificial Sequence
  source: /note="Description of Artificial Sequence: Synthetic peptide"
VTVEEHIFR

SEQ ID NO: 16245 - protein, 9 aa, Artificial Sequence
  source: /note="Description of Artificial Sequence: Synthetic peptide"
TQVTVEEHI

SEQ ID NO: 16246 - protein, 10 aa, Artificial Sequence
  source: /note="Description of Artificial Sequence: Synthetic peptide"
IFRTSRKNSL

SEQ ID NO: 16247 - protein, 10 aa, Artificial Sequence
  source: /note="Description of Artificial Sequence: Synthetic peptide"
QVTVEEHIFR

SEQ ID NO: 16248 - protein, 10 aa, Artificial Sequence
  source: /note="Description of Artificial Sequence: Synthetic peptide"
TQVTVEEHIF

SEQ ID NO: 16249 - protein, 9 aa, Artificial Sequence
  source: /note="Description of Artificial Sequence: Synthetic peptide"
TTVGYCDMY

SEQ ID NO: 16250 - protein, 9 aa, Artificial Sequence
  source: /note="Description of Artificial Sequence: Synthetic peptide"
VGYCDMYPV

SEQ ID NO: 16251 - protein, 10 aa, Artificial Sequence
  source: /note="Description of Artificial Sequence: Synthetic peptide"
MTTVGYCDMY

SEQ ID NO: 16252 - protein, 10 aa, Artificial Sequence
  source: /note="Description of Artificial Sequence: Synthetic peptide"
TVGYCDMYPV

SEQ ID NO: 16253 - protein, 10 aa, Artificial Sequence
  source: /note="Description of Artificial Sequence: Synthetic peptide"
GYCDMYPVTI

SEQ ID NO: 16254 - protein, 10 aa, Artificial Sequence
  source: /note="Description of Artificial Sequence: Synthetic peptide"
SMTTVGYCDM

SEQ ID NO: 16255 - protein, 9 aa, Artificial Sequence
  source: /note="Description of Artificial Sequence: Synthetic peptide"
ILFSSVVYF

SEQ ID NO: 16256 - protein, 9 aa, Artificial Sequence
  source: /note="Description of Artificial Sequence: Synthetic peptide"
GVILFSSVV

SEQ ID NO: 16257 - protein, 9 aa, Artificial Sequence
  source: /note="Description of Artificial Sequence: Synthetic peptide"
VILFSSVVY

SEQ ID NO: 16258 - protein, 9 aa, Artificial Sequence
  source: /note="Description of Artificial Sequence: Synthetic peptide"
SSVVYFAEA

SEQ ID NO: 16259 - protein, 10 aa, Artificial Sequence
  source: /note="Description of Artificial Sequence: Synthetic peptide"
FIGVILFSSV

SEQ ID NO: 16260 - protein, 10 aa, Artificial Sequence
  source: /note="Description of Artificial Sequence: Synthetic peptide"
ILFSSVVYFA

SEQ ID NO: 16261 - protein, 10 aa, Artificial Sequence
  source: /note="Description of Artificial Sequence: Synthetic peptide"
FSSVVYFAEA

SEQ ID NO: 16262 - protein, 10 aa, Artificial Sequence
  source: /note="Description of Artificial Sequence: Synthetic peptide"
VILFSSVVYF

SEQ ID NO: 16263 - protein, 10 aa, Artificial Sequence
  source: /note="Description of Artificial Sequence: Synthetic peptide"
GVILFSSVVY

SEQ ID NO: 16264 - protein, 9 aa, Artificial Sequence
  source: /note="Description of Artificial Sequence: Synthetic peptide"
HQLAHVEAV

SEQ ID NO: 16265 - protein, 9 aa, Artificial Sequence
  source: /note="Description of Artificial Sequence: Synthetic peptide"
QLNDNHQLA

SEQ ID NO: 16266 - protein, 9 aa, Artificial Sequence
  source: /note="Description of Artificial Sequence: Synthetic peptide"
GQLNDNHQL

SEQ ID NO: 16267 - protein, 10 aa, Artificial Sequence
  source: /note="Description of Artificial Sequence: Synthetic peptide"
GQLNDNHQLA

SEQ ID NO: 16268 - protein, 10 aa, Artificial Sequence
  source: /note="Description of Artificial Sequence: Synthetic peptide"
HQLAHVEAVC

SEQ ID NO: 16269 - protein, 10 aa, Artificial Sequence
  source: /note="Description of Artificial Sequence: Synthetic peptide"
DEFGQLNDNH

SEQ ID NO: 16270 - protein, 9 aa, Artificial Sequence
  source: /note="Description of Artificial Sequence: Synthetic peptide"
KQKLPKKKR

SEQ ID NO: 16271 - protein, 9 aa, Artificial Sequence
  source: /note="Description of Artificial Sequence: Synthetic peptide"
RSWDLPIIV

SEQ ID NO: 16272 - protein, 9 aa, Artificial Sequence
  source: /note="Description of Artificial Sequence: Synthetic peptide"
LPKKKRSIF

SEQ ID NO: 16273 - protein, 9 aa, Artificial Sequence
  source: /note="Description of Artificial Sequence: Synthetic peptide"
SIFRGHRSW

SEQ ID NO: 16274 - protein, 9 aa, Artificial Sequence
  source: /note="Description of Artificial Sequence: Synthetic peptide"
GHRSWDLPI

SEQ ID NO: 16275 - protein, 9 aa, Artificial Sequence
  source: /note="Description of Artificial Sequence: Synthetic peptide"
WDLPIIVNL

SEQ ID NO: 16276 - protein, 10 aa, Artificial Sequence
  source: /note="Description of Artificial Sequence: Synthetic peptide"
IFRGHRSWDL

SEQ ID NO: 16277 - protein, 10 aa, Artificial Sequence
  source: /note="Description of Artificial Sequence: Synthetic peptide"
KKRSIFRGHR

SEQ ID NO: 16278 - protein, 10 aa, Artificial Sequence
  source: /note="Description of Artificial Sequence: Synthetic peptide"
RGHRSWDLPI

SEQ ID NO: 16279 - protein, 10 aa, Artificial Sequence
  source: /note="Description of Artificial Sequence: Synthetic peptide"
LPKKKRSIFR

SEQ ID NO: 16280 - protein, 10 aa, Artificial Sequence
  source: /note="Description of Artificial Sequence: Synthetic peptide"
RSIFRGHRSW

SEQ ID NO: 16281 - protein, 10 aa, Artificial Sequence
  source: /note="Description of Artificial Sequence: Synthetic peptide"
GHRSWDLPII

SEQ ID NO: 16282 - protein, 9 aa, Artificial Sequence
  source: /note="Description of Artificial Sequence: Synthetic peptide"
SLNAYLHSK

SEQ ID NO: 16283 - protein, 9 aa, Artificial Sequence
  source: /note="Description of Artificial Sequence: Synthetic peptide"
KTGSLNAYL

SEQ ID NO: 16284 - protein, 9 aa, Artificial Sequence
  source: /note="Description of Artificial Sequence: Synthetic peptide"
LNAYLHSKR

SEQ ID NO: 16285 - protein, 9 aa, Artificial Sequence
  source: /note="Description of Artificial Sequence: Synthetic peptide"
IRVAKTGSL

SEQ ID NO: 16286 - protein, 9 aa, Artificial Sequence
  source: /note="Description of Artificial Sequence: Synthetic peptide"
AKTGSLNAY

SEQ ID NO: 16287 - protein, 10 aa, Artificial Sequence
  source: /note="Description of Artificial Sequence: Synthetic peptide"
GSLNAYLHSK

SEQ ID NO: 16288 - protein, 10 aa, Artificial Sequence
  source: /note="Description of Artificial Sequence: Synthetic peptide"
KTGSLNAYLH

SEQ ID NO: 16289 - protein, 10 aa, Artificial Sequence
  source: /note="Description of Artificial Sequence: Synthetic peptide"
SLNAYLHSKR

SEQ ID NO: 16290 - protein, 10 aa, Artificial Sequence
  source: /note="Description of Artificial Sequence: Synthetic peptide"
RIRVAKTGSL

SEQ ID NO: 16291 - protein, 10 aa, Artificial Sequence
  source: /note="Description of Artificial Sequence: Synthetic peptide"
RVAKTGSLNA

SEQ ID NO: 16292 - protein, 10 aa, Artificial Sequence
  source: /note="Description of Artificial Sequence: Synthetic peptide"
VAKTGSLNAY

SEQ ID NO: 16293 - protein, 10 aa, Artificial Sequence
  source: /note="Description of Artificial Sequence: Synthetic peptide"
AKTGSLNAYL

SEQ ID NO: 16294 - protein, 9 aa, Artificial Sequence
  source: /note="Description of Artificial Sequence: Synthetic peptide"
RAPPTSWLA

SEQ ID NO: 16295 - protein, 9 aa, Artificial Sequence
  source: /note="Description of Artificial Sequence: Synthetic peptide"
NHRAPPTSW

SEQ ID NO: 16296 - protein, 9 aa, Artificial Sequence
  source: /note="Description of Artificial Sequence: Synthetic peptide"
HRAPPTSWL

SEQ ID NO: 16297 - protein, 9 aa, Artificial Sequence
  source: /note="Description of Artificial Sequence: Synthetic peptide"
KIFSICTIL

SEQ ID NO: 16298 - protein, 9 aa, Artificial Sequence
  source: /note="Description of Artificial Sequence: Synthetic peptide"
ILIGALMHA

SEQ ID NO: 16299 - protein, 9 aa, Artificial Sequence
  source: /note="Description of Artificial Sequence: Synthetic peptide"
SICTILIGA

SEQ ID NO: 16300 - protein, 9 aa, Artificial Sequence
  source: /note="Description of Artificial Sequence: Synthetic peptide"
IFSICTILI

SEQ ID NO: 16301 - protein, 9 aa, Artificial Sequence
  source: /note="Description of Artificial Sequence: Synthetic peptide"
CTILIGALM

SEQ ID NO: 16302 - protein, 9 aa, Artificial Sequence
  source: /note="Description of Artificial Sequence: Synthetic peptide"
EKIFSICTI

SEQ ID NO: 16303 - protein, 10 aa, Artificial Sequence
  source: /note="Description of Artificial Sequence: Synthetic peptide"
KIFSICTILI

SEQ ID NO: 16304 - protein, 10 aa, Artificial Sequence
  source: /note="Description of Artificial Sequence: Synthetic peptide"
FSICTILIGA

SEQ ID NO: 16305 - protein, 10 aa, Artificial Sequence
  source: /note="Description of Artificial Sequence: Synthetic peptide"
ILIGALMHAL

SEQ ID NO: 16306 - protein, 10 aa, Artificial Sequence
  source: /note="Description of Artificial Sequence: Synthetic peptide"
SICTILIGAL

SEQ ID NO: 16307 - protein, 10 aa, Artificial Sequence
  source: /note="Description of Artificial Sequence: Synthetic peptide"
AEKIFSICTI

SEQ ID NO: 16308 - protein, 10 aa, Artificial Sequence
  source: /note="Description of Artificial Sequence: Synthetic peptide"
EKIFSICTIL

SEQ ID NO: 16309 - protein, 9 aa, Artificial Sequence
  source: /note="Description of Artificial Sequence: Synthetic peptide"
LAMASATSV

SEQ ID NO: 16310 - protein, 9 aa, Artificial Sequence
  source: /note="Description of Artificial Sequence: Synthetic peptide"
SMQLWPPTM

SEQ ID NO: 16311 - protein, 9 aa, Artificial Sequence
  source: /note="Description of Artificial Sequence: Synthetic peptide"
MQLWPPTMA

SEQ ID NO: 16312 - protein, 9 aa, Artificial Sequence
  source: /note="Description of Artificial Sequence: Synthetic peptide"
SLEPSSSPL

SEQ ID NO: 16313 - protein, 9 aa, Artificial Sequence
  source: /note="Description of Artificial Sequence: Synthetic peptide"
NVHWPLCFL

SEQ ID NO: 16314 - protein, 9 aa, Artificial Sequence
  source: /note="Description of Artificial Sequence: Synthetic peptide"
RLPGPRSGL

SEQ ID NO: 16315 - protein, 9 aa, Artificial Sequence
  source: /note="Description of Artificial Sequence: Synthetic peptide"
AMASATSVR

SEQ ID NO: 16316 - protein, 9 aa, Artificial Sequence
  source: /note="Description of Artificial Sequence: Synthetic peptide"
SSSQVPSWR

SEQ ID NO: 16317 - protein, 9 aa, Artificial Sequence
  source: /note="Description of Artificial Sequence: Synthetic peptide"
SSQVPSWRR

SEQ ID NO: 16318 - protein, 9 aa, Artificial Sequence
  source: /note="Description of Artificial Sequence: Synthetic peptide"
VWYRCTHSL

SEQ ID NO: 16319 - protein, 9 aa, Artificial Sequence
  source: /note="Description of Artificial Sequence: Synthetic peptide"
RNVHWPLCF

SEQ ID NO: 16320 - protein, 9 aa, Artificial Sequence
  source: /note="Description of Artificial Sequence: Synthetic peptide"
VHWPLCFLL

SEQ ID NO: 16321 - protein, 9 aa, Artificial Sequence
  source: /note="Description of Artificial Sequence: Synthetic peptide"
SVRNVHWPL

SEQ ID NO: 16322 - protein, 9 aa, Artificial Sequence
  source: /note="Description of Artificial Sequence: Synthetic peptide"
SWCSPPSWK

SEQ ID NO: 16323 - protein, 9 aa, Artificial Sequence
  source: /note="Description of Artificial Sequence: Synthetic peptide"
SWRRLPGPR

SEQ ID NO: 16324 - protein, 9 aa, Artificial Sequence
  source: /note="Description of Artificial Sequence: Synthetic peptide"
SGLRPFVSA

SEQ ID NO: 16325 - protein, 9 aa, Artificial Sequence
  source: /note="Description of Artificial Sequence: Synthetic peptide"
PTTPPVWYR

SEQ ID NO: 16326 - protein, 9 aa, Artificial Sequence
  source: /note="Description of Artificial Sequence: Synthetic peptide"
DPRPTTPPV

SEQ ID NO: 16327 - protein, 9 aa, Artificial Sequence
  source: /note="Description of Artificial Sequence: Synthetic peptide"
SPLNPKPPL

SEQ ID NO: 16328 - protein, 9 aa, Artificial Sequence
  source: /note="Description of Artificial Sequence: Synthetic peptide"
KPPLAMASA

SEQ ID NO: 16329 - protein, 9 aa, Artificial Sequence
  source: /note="Description of Artificial Sequence: Synthetic peptide"
VPSWRRLPG

SEQ ID NO: 16330 - protein, 9 aa, Artificial Sequence
  source: /note="Description of Artificial Sequence: Synthetic peptide"
GPRSGLRPF

SEQ ID NO: 16331 - protein, 9 aa, Artificial Sequence
  source: /note="Description of Artificial Sequence: Synthetic peptide"
WPPTMASPA

SEQ ID NO: 16332 - protein, 9 aa, Artificial Sequence
  source: /note="Description of Artificial Sequence: Synthetic peptide"
FLLPSWCSP

SEQ ID NO: 16333 - protein, 9 aa, Artificial Sequence
  source: /note="Description of Artificial Sequence: Synthetic peptide"
KSSSQVPSW

SEQ ID NO: 16334 - protein, 9 aa, Artificial Sequence
  source: /note="Description of Artificial Sequence: Synthetic peptide"
SQVPSWRRL

SEQ ID NO: 16335 - protein, 9 aa, Artificial Sequence
  source: /note="Description of Artificial Sequence: Synthetic peptide"
LRPFVSASM

SEQ ID NO: 16336 - protein, 9 aa, Artificial Sequence
  source: /note="Description of Artificial Sequence: Synthetic peptide"
FVSASMQLW

SEQ ID NO: 16337 - protein, 9 aa, Artificial Sequence
  source: /note="Description of Artificial Sequence: Synthetic peptide"
ASMQLWPPT

SEQ ID NO: 16338 - protein, 9 aa, Artificial Sequence
  source: /note="Description of Artificial Sequence: Synthetic peptide"
WPLCFLLPS

SEQ ID NO: 16339 - protein, 9 aa, Artificial Sequence
  source: /note="Description of Artificial Sequence: Synthetic peptide"
LPSWCSPPS

SEQ ID NO: 16340 - protein, 9 aa, Artificial Sequence
  source: /note="Description of Artificial Sequence: Synthetic peptide"
LELDPRPTT

SEQ ID NO: 16341 - protein, 10 aa, Artificial Sequence
  source: /note="Description of Artificial Sequence: Synthetic peptide"
FLLPSWCSPP

SEQ ID NO: 16342 - protein, 10 aa, Artificial Sequence
  source: /note="Description of Artificial Sequence: Synthetic peptide"
SMQLWPPTMA

SEQ ID NO: 16343 - protein, 10 aa, Artificial Sequence
  source: /note="Description of Artificial Sequence: Synthetic peptide"
PLAMASATSV

SEQ ID NO: 16344 - protein, 10 aa, Artificial Sequence
  source: /note="Description of Artificial Sequence: Synthetic peptide"
LLPSWCSPPS

SEQ ID NO: 16345 - protein, 10 aa, Artificial Sequence
  source: /note="Description of Artificial Sequence: Synthetic peptide"
GLRPFVSASM

SEQ ID NO: 16346 - protein, 10 aa, Artificial Sequence
  source: /note="Description of Artificial Sequence: Synthetic peptide"
LAMASATSVR

SEQ ID NO: 16347 - protein, 10 aa, Artificial Sequence
  source: /note="Description of Artificial Sequence: Synthetic peptide"
PSWCSPPSWK

SEQ ID NO: 16348 - protein, 10 aa, Artificial Sequence
  source: /note="Description of Artificial Sequence: Synthetic peptide"
KSSSQVPSWR

SEQ ID NO: 16349 - protein, 10 aa, Artificial Sequence
  source: /note="Description of Artificial Sequence: Synthetic peptide"
SSSQVPSWRR

SEQ ID NO: 16350 - protein, 10 aa, Artificial Sequence
  source: /note="Description of Artificial Sequence: Synthetic peptide"
PFVSASMQLW

SEQ ID NO: 16351 - protein, 10 aa, Artificial Sequence
  source: /note="Description of Artificial Sequence: Synthetic peptide"
HSLEPSSSPL

SEQ ID NO: 16352 - protein, 10 aa, Artificial Sequence
  source: /note="Description of Artificial Sequence: Synthetic peptide"
SVRNVHWPLC

SEQ ID NO: 16353 - protein, 10 aa, Artificial Sequence
  source: /note="Description of Artificial Sequence: Synthetic peptide"
SWKSSSQVPS

SEQ ID NO: 16354 - protein, 10 aa, Artificial Sequence
  source: /note="Description of Artificial Sequence: Synthetic peptide"
SWRRLPGPRS

SEQ ID NO: 16355 - protein, 10 aa, Artificial Sequence
  source: /note="Description of Artificial Sequence: Synthetic peptide"
RSGLRPFVSA

SEQ ID NO: 16356 - protein, 10 aa, Artificial Sequence
  source: /note="Description of Artificial Sequence: Synthetic peptide"
ASMQLWPPTM

SEQ ID NO: 16357 - protein, 10 aa, Artificial Sequence
  source: /note="Description of Artificial Sequence: Synthetic peptide"
RPTTPPVWYR

SEQ ID NO: 16358 - protein, 10 aa, Artificial Sequence
  source: /note="Description of Artificial Sequence: Synthetic peptide"
MASATSVRNV

SEQ ID NO: 16359 - protein, 10 aa, Artificial Sequence
  source: /note="Description of Artificial Sequence: Synthetic peptide"
TSVRNVHWPL

SEQ ID NO: 16360 - protein, 10 aa, Artificial Sequence
  source: /note="Description of Artificial Sequence: Synthetic peptide"
NVHWPLCFLL

SEQ ID NO: 16361 - protein, 10 aa, Artificial Sequence
  source: /note="Description of Artificial Sequence: Synthetic peptide"
GPRSGLRPFV

SEQ ID NO: 16362 - protein, 10 aa, Artificial Sequence
  source: /note="Description of Artificial Sequence: Synthetic peptide"
RPFVSASMQL

SEQ ID NO: 16363 - protein, 10 aa, Artificial Sequence
  source: /note="Description of Artificial Sequence: Synthetic peptide"
SATSVRNVHW

SEQ ID NO: 16364 - protein, 10 aa, Artificial Sequence
  source: /note="Description of Artificial Sequence: Synthetic peptide"
VRNVHWPLCF

SEQ ID NO: 16365 - protein, 10 aa, Artificial Sequence
  source: /note="Description of Artificial Sequence: Synthetic peptide"
RNVHWPLCFL

SEQ ID NO: 16366 - protein, 10 aa, Artificial Sequence
  source: /note="Description of Artificial Sequence: Synthetic peptide"
WKSSSQVPSW

SEQ ID NO: 16367 - protein, 10 aa, Artificial Sequence
  source: /note="Description of Artificial Sequence: Synthetic peptide"
SQVPSWRRLP

SEQ ID NO: 16368 - protein, 10 aa, Artificial Sequence
  source: /note="Description of Artificial Sequence: Synthetic peptide"
RRLPGPRSGL

SEQ ID NO: 16369 - protein, 10 aa, Artificial Sequence
  source: /note="Description of Artificial Sequence: Synthetic peptide"
MQLWPPTMAS

SEQ ID NO: 16370 - protein, 10 aa, Artificial Sequence
  source: /note="Description of Artificial Sequence: Synthetic peptide"
WPLCFLLPSW

SEQ ID NO: 16371 - protein, 10 aa, Artificial Sequence
  source: /note="Description of Artificial Sequence: Synthetic peptide"
LPSWCSPPSW

SEQ ID NO: 16372 - protein, 10 aa, Artificial Sequence
  source: /note="Description of Artificial Sequence: Synthetic peptide"
DPRPTTPPVW

SEQ ID NO: 16373 - protein, 9 aa, Artificial Sequence
  source: /note="Description of Artificial Sequence: Synthetic peptide"
YSFGDLPMK

SEQ ID NO: 16374 - protein, 9 aa, Artificial Sequence
  source: /note="Description of Artificial Sequence: Synthetic peptide"
AYSFGDLPM

SEQ ID NO: 16375 - protein, 9 aa, Artificial Sequence
  source: /note="Description of Artificial Sequence: Synthetic peptide"
SFGDLPMKL

SEQ ID NO: 16376 - protein, 9 aa, Artificial Sequence
  source: /note="Description of Artificial Sequence: Synthetic peptide"
TTSEKAYSF

SEQ ID NO: 16377 - protein, 10 aa, Artificial Sequence
  source: /note="Description of Artificial Sequence: Synthetic peptide"
KAYSFGDLPM

SEQ ID NO: 16378 - protein, 10 aa, Artificial Sequence
  source: /note="Description of Artificial Sequence: Synthetic peptide"
AYSFGDLPMK

SEQ ID NO: 16379 - protein, 10 aa, Artificial Sequence
  source: /note="Description of Artificial Sequence: Synthetic peptide"
YSFGDLPMKL

SEQ ID NO: 16380 - protein, 10 aa, Artificial Sequence
  source: /note="Description of Artificial Sequence: Synthetic peptide"
STTSEKAYSF

SEQ ID NO: 16381 - protein, 10 aa, Artificial Sequence
  source: /note="Description of Artificial Sequence: Synthetic peptide"
SEKAYSFGDL

SEQ ID NO: 16382 - protein, 9 aa, Artificial Sequence
  source: /note="Description of Artificial Sequence: Synthetic peptide"
GTVLLLLAY

SEQ ID NO: 16383 - protein, 9 aa, Artificial Sequence
  source: /note="Description of Artificial Sequence: Synthetic peptide"
RVRGCAVPG

SEQ ID NO: 16384 - protein, 9 aa, Artificial Sequence
  source: /note="Description of Artificial Sequence: Synthetic peptide"
CAVPGTVLL

SEQ ID NO: 16385 - protein, 9 aa, Artificial Sequence
  source: /note="Description of Artificial Sequence: Synthetic peptide"
VPGTVLLLL

SEQ ID NO: 16386 - protein, 10 aa, Artificial Sequence
  source: /note="Description of Artificial Sequence: Synthetic peptide"
RVRGCAVPGT

SEQ ID NO: 16387 - protein, 10 aa, Artificial Sequence
  source: /note="Description of Artificial Sequence: Synthetic peptide"
PGTVLLLLAY

SEQ ID NO: 16388 - protein, 10 aa, Artificial Sequence
  source: /note="Description of Artificial Sequence: Synthetic peptide"
RGCAVPGTVL

SEQ ID NO: 16389 - protein, 10 aa, Artificial Sequence
  source: /note="Description of Artificial Sequence: Synthetic peptide"
CAVPGTVLLL

SEQ ID NO: 16390 - protein, 10 aa, Artificial Sequence
  source: /note="Description of Artificial Sequence: Synthetic peptide"
VPGTVLLLLA

SEQ ID NO: 16391 - protein, 9 aa, Artificial Sequence
  source: /note="Description of Artificial Sequence: Synthetic peptide"
ALGKLFPVL

SEQ ID NO: 16392 - protein, 9 aa, Artificial Sequence
  source: /note="Description of Artificial Sequence: Synthetic peptide"
KLFPVLCFL

SEQ ID NO: 16393 - protein, 9 aa, Artificial Sequence
  source: /note="Description of Artificial Sequence: Synthetic peptide"
VLCFLCFLV

SEQ ID NO: 16394 - protein, 9 aa, Artificial Sequence
  source: /note="Description of Artificial Sequence: Synthetic peptide"
EALGKLFPV

SEQ ID NO: 16395 - protein, 9 aa, Artificial Sequence
  source: /note="Description of Artificial Sequence: Synthetic peptide"
GKLFPVLCF

SEQ ID NO: 16396 - protein, 9 aa, Artificial Sequence
  source: /note="Description of Artificial Sequence: Synthetic peptide"
FPVLCFLCF

SEQ ID NO: 16397 - protein, 10 aa, Artificial Sequence
  source: /note="Description of Artificial Sequence: Synthetic peptide"
KLFPVLCFLC

SEQ ID NO: 16398 - protein, 10 aa, Artificial Sequence
  source: /note="Description of Artificial Sequence: Synthetic peptide"
LFPVLCFLCF

SEQ ID NO: 16399 - protein, 10 aa, Artificial Sequence
  source: /note="Description of Artificial Sequence: Synthetic peptide"
FPVLCFLCFL

SEQ ID NO: 16400 - protein, 10 aa, Artificial Sequence
  source: /note="Description of Artificial Sequence: Synthetic peptide"
LGKLFPVLCF

SEQ ID NO: 16401 - protein, 10 aa, Artificial Sequence
  source: /note="Description of Artificial Sequence: Synthetic peptide"
GKLFPVLCFL

SEQ ID NO: 16402 - protein, 10 aa, Artificial Sequence
  source: /note="Description of Artificial Sequence: Synthetic peptide"
PEALGKLFPV

SEQ ID NO: 16403 - protein, 9 aa, Artificial Sequence
  source: /note="Description of Artificial Sequence: Synthetic peptide"
AWRERPGYR

SEQ ID NO: 16404 - protein, 9 aa, Artificial Sequence
  source: /note="Description of Artificial Sequence: Synthetic peptide"
SAWRERPGY

SEQ ID NO: 16405 - protein, 9 aa, Artificial Sequence
  source: /note="Description of Artificial Sequence: Synthetic peptide"
MLPSAWRER

SEQ ID NO: 16406 - protein, 10 aa, Artificial Sequence
  source: /note="Description of Artificial Sequence: Synthetic peptide"
SAWRERPGYR

SEQ ID NO: 16407 - protein, 10 aa, Artificial Sequence
  source: /note="Description of Artificial Sequence: Synthetic peptide"
AWRERPGYRA

SEQ ID NO: 16408 - protein, 10 aa, Artificial Sequence
  source: /note="Description of Artificial Sequence: Synthetic peptide"
PSAWRERPGY

SEQ ID NO: 16409 - protein, 9 aa, Artificial Sequence
  source: /note="Description of Artificial Sequence: Synthetic peptide"
IGFGNISPL

SEQ ID NO: 16410 - protein, 10 aa, Artificial Sequence
  source: /note="Description of Artificial Sequence: Synthetic peptide"
SPLTEGGKIF

SEQ ID NO: 16411 - protein, 9 aa, Artificial Sequence
  source: /note="Description of Artificial Sequence: Synthetic peptide"
CGKKFEESM

SEQ ID NO: 16412 - protein, 9 aa, Artificial Sequence
  source: /note="Description of Artificial Sequence: Synthetic peptide"
KKFEESMSL

SEQ ID NO: 16413 - protein, 10 aa, Artificial Sequence
  source: /note="Description of Artificial Sequence: Synthetic peptide"
CSYIPKCGKK

SEQ ID NO: 16414 - protein, 10 aa, Artificial Sequence
  source: /note="Description of Artificial Sequence: Synthetic peptide"
SYIPKCGKKF

SEQ ID NO: 16415 - protein, 10 aa, Artificial Sequence
  source: /note="Description of Artificial Sequence: Synthetic peptide"
KKFEESMSLV

SEQ ID NO: 16416 - protein, 9 aa, Artificial Sequence
  source: /note="Description of Artificial Sequence: Synthetic peptide"
MCLNSLPNF

SEQ ID NO: 16417 - protein, 10 aa, Artificial Sequence
  source: /note="Description of Artificial Sequence: Synthetic peptide"
CLNSLPNFQI

SEQ ID NO: 16418 - protein, 10 aa, Artificial Sequence
  source: /note="Description of Artificial Sequence: Synthetic peptide"
TMCLNSLPNF

SEQ ID NO: 16419 - protein, 9 aa, Artificial Sequence
  source: /note="Description of Artificial Sequence: Synthetic peptide"
KTFALELKV

SEQ ID NO: 16420 - protein, 9 aa, Artificial Sequence
  source: /note="Description of Artificial Sequence: Synthetic peptide"
RVAMWISSV

SEQ ID NO: 16421 - protein, 9 aa, Artificial Sequence
  source: /note="Description of Artificial Sequence: Synthetic peptide"
GLKTFALEL

SEQ ID NO: 16422 - protein, 9 aa, Artificial Sequence
  source: /note="Description of Artificial Sequence: Synthetic peptide"
KLREGLAAG

SEQ ID NO: 16423 - protein, 9 aa, Artificial Sequence
  source: /note="Description of Artificial Sequence: Synthetic peptide"
KVTLPVKKK

SEQ ID NO: 16424 - protein, 9 aa, Artificial Sequence
  source: /note="Description of Artificial Sequence: Synthetic peptide"
IMYNAPSSR

SEQ ID NO: 16425 - protein, 9 aa, Artificial Sequence
  source: /note="Description of Artificial Sequence: Synthetic peptide"
SVFEANPSR

SEQ ID NO: 16426 - protein, 9 aa, Artificial Sequence
  source: /note="Description of Artificial Sequence: Synthetic peptide"
VAMWISSVF

SEQ ID NO: 16427 - protein, 9 aa, Artificial Sequence
  source: /note="Description of Artificial Sequence: Synthetic peptide"
ELKVTLPVK

SEQ ID NO: 16428 - protein, 9 aa, Artificial Sequence
  source: /note="Description of Artificial Sequence: Synthetic peptide"
KSSIIMYNA

SEQ ID NO: 16429 - protein, 9 aa, Artificial Sequence
  source: /note="Description of Artificial Sequence: Synthetic peptide"
SSRCHGKRK

SEQ ID NO: 16430 - protein, 9 aa, Artificial Sequence
  source: /note="Description of Artificial Sequence: Synthetic peptide"
KRKKGRVAM

SEQ ID NO: 16431 - protein, 9 aa, Artificial Sequence
  source: /note="Description of Artificial Sequence: Synthetic peptide"
KGRVAMWIS

SEQ ID NO: 16432 - protein, 9 aa, Artificial Sequence
  source: /note="Description of Artificial Sequence: Synthetic peptide"
GLKSSIIMY

SEQ ID NO: 16433 - protein, 9 aa, Artificial Sequence
  source: /note="Description of Artificial Sequence: Synthetic peptide"
LKERGLKTF

SEQ ID NO: 16434 - protein, 9 aa, Artificial Sequence
  source: /note="Description of Artificial Sequence: Synthetic peptide"
FALELKVTL

SEQ ID NO: 16435 - protein, 9 aa, Artificial Sequence
  source: /note="Description of Artificial Sequence: Synthetic peptide"
LELKVTLPV

SEQ ID NO: 16436 - protein, 9 aa, Artificial Sequence
  source: /note="Description of Artificial Sequence: Synthetic peptide"
KKLREGLAA

SEQ ID NO: 16437 - protein, 9 aa, Artificial Sequence
  source: /note="Description of Artificial Sequence: Synthetic peptide"
LAAGLKSSI

SEQ ID NO: 16438 - protein, 9 aa, Artificial Sequence
  source: /note="Description of Artificial Sequence: Synthetic peptide"
AGLKSSIIM

SEQ ID NO: 16439 - protein, 9 aa, Artificial Sequence
  source: /note="Description of Artificial Sequence: Synthetic peptide"
RKKGRVAMW

SEQ ID NO: 16440 - protein, 9 aa, Artificial Sequence
  source: /note="Description of Artificial Sequence: Synthetic peptide"
MWISSVFEA

SEQ ID NO: 16441 - protein, 9 aa, Artificial Sequence
  source: /note="Description of Artificial Sequence: Synthetic peptide"
FEANPSRIW

SEQ ID NO: 16442 - protein, 9 aa, Artificial Sequence
  source: /note="Description of Artificial Sequence: Synthetic peptide"
KERGLKTFA

SEQ ID NO: 16443 - protein, 10 aa, Artificial Sequence
  source: /note="Description of Artificial Sequence: Synthetic peptide"
ALELKVTLPV

SEQ ID NO: 16444 - protein, 10 aa, Artificial Sequence
  source: /note="Description of Artificial Sequence: Synthetic peptide"
KLREGLAAGL

SEQ ID NO: 16445 - protein, 10 aa, Artificial Sequence
  source: /note="Description of Artificial Sequence: Synthetic peptide"
GLAAGLKSSI

SEQ ID NO: 16446 - protein, 10 aa, Artificial Sequence
  source: /note="Description of Artificial Sequence: Synthetic peptide"
AMWISSVFEA

SEQ ID NO: 16447 - protein, 10 aa, Artificial Sequence
  source: /note="Description of Artificial Sequence: Synthetic peptide"
IMYNAPSSRC

SEQ ID NO: 16448 - protein, 10 aa, Artificial Sequence
  source: /note="Description of Artificial Sequence: Synthetic peptide"
SVFEANPSRI

SEQ ID NO: 16449 - protein, 10 aa, Artificial Sequence
  source: /note="Description of Artificial Sequence: Synthetic peptide"
GLKTFALELK

SEQ ID NO: 16450 - protein, 10 aa, Artificial Sequence
  source: /note="Description of Artificial Sequence: Synthetic peptide"
IIMYNAPSSR

SEQ ID NO: 16451 - protein, 10 aa, Artificial Sequence
  source: /note="Description of Artificial Sequence: Synthetic peptide"
TFALELKVTL

SEQ ID NO: 16452 - protein, 10 aa, Artificial Sequence
  source: /note="Description of Artificial Sequence: Synthetic peptide"
RVAMWISSVF

SEQ ID NO: 16453 - protein, 10 aa, Artificial Sequence
  source: /note="Description of Artificial Sequence: Synthetic peptide"
VFEANPSRIW

SEQ ID NO: 16454 - protein, 10 aa, Artificial Sequence
  source: /note="Description of Artificial Sequence: Synthetic peptide"
RGLKTFALEL

SEQ ID NO: 16455 - protein, 10 aa, Artificial Sequence
  source: /note="Description of Artificial Sequence: Synthetic peptide"
SSRCHGKRKK

SEQ ID NO: 16456 - protein, 10 aa, Artificial Sequence
  source: /note="Description of Artificial Sequence: Synthetic peptide"
KGRVAMWISS

SEQ ID NO: 16457 - protein, 10 aa, Artificial Sequence
  source: /note="Description of Artificial Sequence: Synthetic peptide"
AGLKSSIIMY

SEQ ID NO: 16458 - protein, 10 aa, Artificial Sequence
  source: /note="Description of Artificial Sequence: Synthetic peptide"
VTLPVKKKLR

SEQ ID NO: 16459 - protein, 10 aa, Artificial Sequence
  source: /note="Description of Artificial Sequence: Synthetic peptide"
VLKERGLKTF

SEQ ID NO: 16460 - protein, 10 aa, Artificial Sequence
  source: /note="Description of Artificial Sequence: Synthetic peptide"
KERGLKTFAL

SEQ ID NO: 16461 - protein, 10 aa, Artificial Sequence
  source: /note="Description of Artificial Sequence: Synthetic peptide"
LAAGLKSSII

SEQ ID NO: 16462 - protein, 10 aa, Artificial Sequence
  source: /note="Description of Artificial Sequence: Synthetic peptide"
AAGLKSSIIM

SEQ ID NO: 16463 - protein, 10 aa, Artificial Sequence
  source: /note="Description of Artificial Sequence: Synthetic peptide"
GKRKKGRVAM

SEQ ID NO: 16464 - protein, 10 aa, Artificial Sequence
  source: /note="Description of Artificial Sequence: Synthetic peptide"
RKKGRVAMWI

SEQ ID NO: 16465 - protein, 10 aa, Artificial Sequence
  source: /note="Description of Artificial Sequence: Synthetic peptide"
GRVAMWISSV

SEQ ID NO: 16466 - protein, 10 aa, Artificial Sequence
  source: /note="Description of Artificial Sequence: Synthetic peptide"
REGLAAGLKS

SEQ ID NO: 16467 - protein, 9 aa, Artificial Sequence
  source: /note="Description of Artificial Sequence: Synthetic peptide"
MSDPIMLNV

SEQ ID NO: 16468 - protein, 9 aa, Artificial Sequence
  source: /note="Description of Artificial Sequence: Synthetic peptide"
MLNVGGKLY

SEQ ID NO: 16469 - protein, 9 aa, Artificial Sequence
  source: /note="Description of Artificial Sequence: Synthetic peptide"
IMLNVGGKL

SEQ ID NO: 16470 - protein, 10 aa, Artificial Sequence
  source: /note="Description of Artificial Sequence: Synthetic peptide"
IMLNVGGKLY

SEQ ID NO: 16471 - protein, 9 aa, Artificial Sequence
  source: /note="Description of Artificial Sequence: Synthetic peptide"
IMGDDIFCY

SEQ ID NO: 16472 - protein, 9 aa, Artificial Sequence
  source: /note="Description of Artificial Sequence: Synthetic peptide"
GQEFARNNI

SEQ ID NO: 16473 - protein, 9 aa, Artificial Sequence
  source: /note="Description of Artificial Sequence: Synthetic peptide"
QEFARNNIM

SEQ ID NO: 16474 - protein, 10 aa, Artificial Sequence
  source: /note="Description of Artificial Sequence: Synthetic peptide"
IMGDDIFCYY

SEQ ID NO: 16475 - protein, 10 aa, Artificial Sequence
  source: /note="Description of Artificial Sequence: Synthetic peptide"
NIMGDDIFCY

SEQ ID NO: 16476 - protein, 10 aa, Artificial Sequence
  source: /note="Description of Artificial Sequence: Synthetic peptide"
GQEFARNNIM

SEQ ID NO: 16477 - protein, 10 aa, Artificial Sequence
  source: /note="Description of Artificial Sequence: Synthetic peptide"
RNNIMGDDIF

SEQ ID NO: 16478 - protein, 9 aa, Artificial Sequence
  source: /note="Description of Artificial Sequence: Synthetic peptide"
RSWDHNELF

SEQ ID NO: 16479 - protein, 9 aa, Artificial Sequence
  source: /note="Description of Artificial Sequence: Synthetic peptide"
ARSWDHNEL

SEQ ID NO: 16480 - protein, 9 aa, Artificial Sequence
  source: /note="Description of Artificial Sequence: Synthetic peptide"
DHNELFAQF

SEQ ID NO: 16481 - protein, 9 aa, Artificial Sequence
  source: /note="Description of Artificial Sequence: Synthetic peptide"
NELFAQFAG

SEQ ID NO: 16482 - protein, 10 aa, Artificial Sequence
  source: /note="Description of Artificial Sequence: Synthetic peptide"
SARSWDHNEL

SEQ ID NO: 16483 - protein, 10 aa, Artificial Sequence
  source: /note="Description of Artificial Sequence: Synthetic peptide"
RSWDHNELFA

SEQ ID NO: 16484 - protein, 10 aa, Artificial Sequence
  source: /note="Description of Artificial Sequence: Synthetic peptide"
ARSWDHNELF

SEQ ID NO: 16485 - protein, 10 aa, Artificial Sequence
  source: /note="Description of Artificial Sequence: Synthetic peptide"
WDHNELFAQF

SEQ ID NO: 16486 - protein, 9 aa, Artificial Sequence
  source: /note="Description of Artificial Sequence: Synthetic peptide"
FPRSSLHPQ

SEQ ID NO: 16487 - protein, 9 aa, Artificial Sequence
  source: /note="Description of Artificial Sequence: Synthetic peptide"
IPFPRSSLH

SEQ ID NO: 16488 - protein, 10 aa, Artificial Sequence
  source: /note="Description of Artificial Sequence: Synthetic peptide"
TGIPFPRSSL

SEQ ID NO: 16489 - protein, 9 aa, Artificial Sequence
  source: /note="Description of Artificial Sequence: Synthetic peptide"
SVKDGRRKI

SEQ ID NO: 16490 - protein, 9 aa, Artificial Sequence
  source: /note="Description of Artificial Sequence: Synthetic peptide"
DFGSGFSVK

SEQ ID NO: 16491 - protein, 9 aa, Artificial Sequence
  source: /note="Description of Artificial Sequence: Synthetic peptide"
KDFGSGFSV

SEQ ID NO: 16492 - protein, 10 aa, Artificial Sequence
  source: /note="Description of Artificial Sequence: Synthetic peptide"
SSKDFGSGFS

SEQ ID NO: 16493 - protein, 10 aa, Artificial Sequence
  source: /note="Description of Artificial Sequence: Synthetic peptide"
KDFGSGFSVK

SEQ ID NO: 16494 - protein, 10 aa, Artificial Sequence
  source: /note="Description of Artificial Sequence: Synthetic peptide"
SVKDGRRKIL

SEQ ID NO: 16495 - protein, 9 aa, Artificial Sequence
  source: /note="Description of Artificial Sequence: Synthetic peptide"
VAVLNCLLY

SEQ ID NO: 16496 - protein, 9 aa, Artificial Sequence
  source: /note="Description of Artificial Sequence: Synthetic peptide"
AVLNCLLYA

SEQ ID NO: 16497 - protein, 9 aa, Artificial Sequence
  source: /note="Description of Artificial Sequence: Synthetic peptide"
VLNCLLYAV

SEQ ID NO: 16498 - protein, 9 aa, Artificial Sequence
  source: /note="Description of Artificial Sequence: Synthetic peptide"
CLLYAVGGF

SEQ ID NO: 16499 - protein, 10 aa, Artificial Sequence
  source: /note="Description of Artificial Sequence: Synthetic peptide"
GVAVLNCLLY

SEQ ID NO: 16500 - protein, 10 aa, Artificial Sequence
  source: /note="Description of Artificial Sequence: Synthetic peptide"
AVLNCLLYAV

SEQ ID NO: 16501 - protein, 9 aa, Artificial Sequence
  source: /note="Description of Artificial Sequence: Synthetic peptide"
LYAVGGFDW

SEQ ID NO: 16502 - protein, 10 aa, Artificial Sequence
  source: /note="Description of Artificial Sequence: Synthetic peptide"
AVGGFDWTNR

SEQ ID NO: 16503 - protein, 10 aa, Artificial Sequence
  source: /note="Description of Artificial Sequence: Synthetic peptide"
LLYAVGGFDW

SEQ ID NO: 16504 - protein, 10 aa, Artificial Sequence
  source: /note="Description of Artificial Sequence: Synthetic peptide"
FDWTNRLNSA

SEQ ID NO: 16505 - protein, 9 aa, Artificial Sequence
  source: /note="Description of Artificial Sequence: Synthetic peptide"
RMTSGRSWV

SEQ ID NO: 16506 - protein, 9 aa, Artificial Sequence
  source: /note="Description of Artificial Sequence: Synthetic peptide"
SWVGVAVTM

SEQ ID NO: 16507 - protein, 9 aa, Artificial Sequence
  source: /note="Description of Artificial Sequence: Synthetic peptide"
SGRSWVGVA

SEQ ID NO: 16508 - protein, 9 aa, Artificial Sequence
  source: /note="Description of Artificial Sequence: Synthetic peptide"
TRMTSGRSW

SEQ ID NO: 16509 - protein, 9 aa, Artificial Sequence
  source: /note="Description of Artificial Sequence: Synthetic peptide"
GRSWVGVAV

SEQ ID NO: 16510 - protein, 9 aa, Artificial Sequence
  source: /note="Description of Artificial Sequence: Synthetic peptide"
RSWVGVAVT

SEQ ID NO: 16511 - protein, 10 aa, Artificial Sequence
  source: /note="Description of Artificial Sequence: Synthetic peptide"
MTSGRSWVGV

SEQ ID NO: 16512 - protein, 10 aa, Artificial Sequence
  source: /note="Description of Artificial Sequence: Synthetic peptide"
SGRSWVGVAV

SEQ ID NO: 16513 - protein, 10 aa, Artificial Sequence
  source: /note="Description of Artificial Sequence: Synthetic peptide"
RSWVGVAVTM

SEQ ID NO: 16514 - protein, 10 aa, Artificial Sequence
  source: /note="Description of Artificial Sequence: Synthetic peptide"
VTRMTSGRSW

SEQ ID NO: 16515 - protein, 10 aa, Artificial Sequence
  source: /note="Description of Artificial Sequence: Synthetic peptide"
RMTSGRSWVG

SEQ ID NO: 16516 - protein, 9 aa, Artificial Sequence
  source: /note="Description of Artificial Sequence: Synthetic peptide"
FISMGEKCV

SEQ ID NO: 16517 - protein, 9 aa, Artificial Sequence
  source: /note="Description of Artificial Sequence: Synthetic peptide"
TAFISMGEK

SEQ ID NO: 16518 - protein, 9 aa, Artificial Sequence
  source: /note="Description of Artificial Sequence: Synthetic peptide"
FAYTAFISM

SEQ ID NO: 16519 - protein, 9 aa, Artificial Sequence
  source: /note="Description of Artificial Sequence: Synthetic peptide"
YTAFISMGE

SEQ ID NO: 16520 - protein, 9 aa, Artificial Sequence
  source: /note="Description of Artificial Sequence: Synthetic peptide"
LIEFAYTAF

SEQ ID NO: 16521 - protein, 9 aa, Artificial Sequence
  source: /note="Description of Artificial Sequence: Synthetic peptide"
IEFAYTAFI

SEQ ID NO: 16522 - protein, 10 aa, Artificial Sequence
  source: /note="Description of Artificial Sequence: Synthetic peptide"
RLIEFAYTAF

SEQ ID NO: 16523 - protein, 10 aa, Artificial Sequence
  source: /note="Description of Artificial Sequence: Synthetic peptide"
LIEFAYTAFI

SEQ ID NO: 16524 - protein, 10 aa, Artificial Sequence
  source: /note="Description of Artificial Sequence: Synthetic peptide"
FISMGEKCVL

SEQ ID NO: 16525 - protein, 10 aa, Artificial Sequence
  source: /note="Description of Artificial Sequence: Synthetic peptide"
YTAFISMGEK

SEQ ID NO: 16526 - protein, 10 aa, Artificial Sequence
  source: /note="Description of Artificial Sequence: Synthetic peptide"
IEFAYTAFIS

SEQ ID NO: 16527 - protein, 10 aa, Artificial Sequence
  source: /note="Description of Artificial Sequence: Synthetic peptide"
EFAYTAFISM

SEQ ID NO: 16528 - protein, 9 aa, Artificial Sequence
  source: /note="Description of Artificial Sequence: Synthetic peptide"
VLHFMNGAV

SEQ ID NO: 16529 - protein, 9 aa, Artificial Sequence
  source: /note="Description of Artificial Sequence: Synthetic peptide"
FMNGAVMYQ

SEQ ID NO: 16530 - protein, 9 aa, Artificial Sequence
  source: /note="Description of Artificial Sequence: Synthetic peptide"
HFMNGAVMY

SEQ ID NO: 16531 - protein, 9 aa, Artificial Sequence
  source: /note="Description of Artificial Sequence: Synthetic peptide"
CVLHFMNGA

SEQ ID NO: 16532 - protein, 9 aa, Artificial Sequence
  source: /note="Description of Artificial Sequence: Synthetic peptide"
MGEKCVLHF

SEQ ID NO: 16533 - protein, 9 aa, Artificial Sequence
  source: /note="Description of Artificial Sequence: Synthetic peptide"
GEKCVLHFM

SEQ ID NO: 16534 - protein, 9 aa, Artificial Sequence
  source: /note="Description of Artificial Sequence: Synthetic peptide"
LHFMNGAVM

SEQ ID NO: 16535 - protein, 10 aa, Artificial Sequence
  source: /note="Description of Artificial Sequence: Synthetic peptide"
CVLHFMNGAV

SEQ ID NO: 16536 - protein, 10 aa, Artificial Sequence
  source: /note="Description of Artificial Sequence: Synthetic peptide"
FMNGAVMYQI

SEQ ID NO: 16537 - protein, 10 aa, Artificial Sequence
  source: /note="Description of Artificial Sequence: Synthetic peptide"
SMGEKCVLHF

SEQ ID NO: 16538 - protein, 10 aa, Artificial Sequence
  source: /note="Description of Artificial Sequence: Synthetic peptide"
LHFMNGAVMY

SEQ ID NO: 16539 - protein, 10 aa, Artificial Sequence
  source: /note="Description of Artificial Sequence: Synthetic peptide"
VLHFMNGAVM

SEQ ID NO: 16540 - protein, 9 aa, Artificial Sequence
  source: /note="Description of Artificial Sequence: Synthetic peptide"
QLRFYVQAL

SEQ ID NO: 16541 - protein, 9 aa, Artificial Sequence
  source: /note="Description of Artificial Sequence: Synthetic peptide"
KYDCEQLRF

SEQ ID NO: 16542 - protein, 9 aa, Artificial Sequence
  source: /note="Description of Artificial Sequence: Synthetic peptide"
LRFYVQALL

SEQ ID NO: 16543 - protein, 10 aa, Artificial Sequence
  source: /note="Description of Artificial Sequence: Synthetic peptide"
QLRFYVQALL

SEQ ID NO: 16544 - protein, 10 aa, Artificial Sequence
  source: /note="Description of Artificial Sequence: Synthetic peptide"
KYDCEQLRFY

SEQ ID NO: 16545 - protein, 10 aa, Artificial Sequence
  source: /note="Description of Artificial Sequence: Synthetic peptide"
WVKYDCEQLR

SEQ ID NO: 16546 - protein, 10 aa, Artificial Sequence
  source: /note="Description of Artificial Sequence: Synthetic peptide"
EQLRFYVQAL

SEQ ID NO: 16547 - protein, 10 aa, Artificial Sequence
  source: /note="Description of Artificial Sequence: Synthetic peptide"
VKYDCEQLRF

SEQ ID NO: 16548 - protein, 10 aa, Artificial Sequence
  source: /note="Description of Artificial Sequence: Synthetic peptide"
CEQLRFYVQA

SEQ ID NO: 16549 - protein, 9 aa, Artificial Sequence
  source: /note="Description of Artificial Sequence: Synthetic peptide"
CMEETGTFF

SEQ ID NO: 16550 - protein, 9 aa, Artificial Sequence
  source: /note="Description of Artificial Sequence: Synthetic peptide"
KCMEETGTF

SEQ ID NO: 16551 - protein, 10 aa, Artificial Sequence
  source: /note="Description of Artificial Sequence: Synthetic peptide"
MKCMEETGTF

SEQ ID NO: 16552 - protein, 10 aa, Artificial Sequence
  source: /note="Description of Artificial Sequence: Synthetic peptide"
KCMEETGTFF

SEQ ID NO: 16553 - protein, 9 aa, Artificial Sequence
  source: /note="Description of Artificial Sequence: Synthetic peptide"
RIAPTAPLR

SEQ ID NO: 16554 - protein, 9 aa, Artificial Sequence
  source: /note="Description of Artificial Sequence: Synthetic peptide"
APLRGRGGA

SEQ ID NO: 16555 - protein, 9 aa, Artificial Sequence
  source: /note="Description of Artificial Sequence: Synthetic peptide"
PLRGRGGAI

SEQ ID NO: 16556 - protein, 9 aa, Artificial Sequence
  source: /note="Description of Artificial Sequence: Synthetic peptide"
IRIAPTAPL

SEQ ID NO: 16557 - protein, 10 aa, Artificial Sequence
  source: /note="Description of Artificial Sequence: Synthetic peptide"
GIRIAPTAPL

SEQ ID NO: 16558 - protein, 10 aa, Artificial Sequence
  source: /note="Description of Artificial Sequence: Synthetic peptide"
APLRGRGGAI

SEQ ID NO: 16559 - protein, 9 aa, Artificial Sequence
  source: /note="Description of Artificial Sequence: Synthetic peptide"
KSITKLGKR

SEQ ID NO: 16560 - protein, 9 aa, Artificial Sequence
  source: /note="Description of Artificial Sequence: Synthetic peptide"
ITKLGKRGV

SEQ ID NO: 16561 - protein, 9 aa, Artificial Sequence
  source: /note="Description of Artificial Sequence: Synthetic peptide"
RGVKQFKNK

SEQ ID NO: 16562 - protein, 9 aa, Artificial Sequence
  source: /note="Description of Artificial Sequence: Synthetic peptide"
LGKRGVKQF

SEQ ID NO: 16563 - protein, 10 aa, Artificial Sequence
  source: /note="Description of Artificial Sequence: Synthetic peptide"
ITKLGKRGVK

SEQ ID NO: 16564 - protein, 10 aa, Artificial Sequence
  source: /note="Description of Artificial Sequence: Synthetic peptide"
LGKRGVKQFK

SEQ ID NO: 16565 - protein, 10 aa, Artificial Sequence
  source: /note="Description of Artificial Sequence: Synthetic peptide"
KLGKRGVKQF

SEQ ID NO: 16566 - protein, 9 aa, Artificial Sequence
  source: /note="Description of Artificial Sequence: Synthetic peptide"
HSVPSTPPR

SEQ ID NO: 16567 - protein, 10 aa, Artificial Sequence
  source: /note="Description of Artificial Sequence: Synthetic peptide"
RSNQNREWCL

SEQ ID NO: 16568 - protein, 9 aa, Artificial Sequence
  source: /note="Description of Artificial Sequence: Synthetic peptide"
APATQAPCM

SEQ ID NO: 16569 - protein, 9 aa, Artificial Sequence
  source: /note="Description of Artificial Sequence: Synthetic peptide"
SEIPPPAPA

SEQ ID NO: 16570 - protein, 10 aa, Artificial Sequence
  source: /note="Description of Artificial Sequence: Synthetic peptide"
APATQAPCMM

SEQ ID NO: 16571 - protein, 10 aa, Artificial Sequence
  source: /note="Description of Artificial Sequence: Synthetic peptide"
SEIPPPAPAT

SEQ ID NO: 16572 - protein, 10 aa, Artificial Sequence
  source: /note="Description of Artificial Sequence: Synthetic peptide"
MPGSEIPPPA

SEQ ID NO: 16573 - protein, 9 aa, Artificial Sequence
  source: /note="Description of Artificial Sequence: Synthetic peptide"
ISKKQNALA

SEQ ID NO: 16574 - protein, 9 aa, Artificial Sequence
  source: /note="Description of Artificial Sequence: Synthetic peptide"
NISKKQNAL

SEQ ID NO: 16575 - protein, 9 aa, Artificial Sequence
  source: /note="Description of Artificial Sequence: Synthetic peptide"
KKQNALAEH

SEQ ID NO: 16576 - protein, 9 aa, Artificial Sequence
  source: /note="Description of Artificial Sequence: Synthetic peptide"
EYQWIDQIR

SEQ ID NO: 16577 - protein, 9 aa, Artificial Sequence
  source: /note="Description of Artificial Sequence: Synthetic peptide"
WIDQIRTPR

SEQ ID NO: 16578 - protein, 9 aa, Artificial Sequence
  source: /note="Description of Artificial Sequence: Synthetic peptide"
PEYQWIDQI

SEQ ID NO: 16579 - protein, 10 aa, Artificial Sequence
  source: /note="Description of Artificial Sequence: Synthetic peptide"
QWIDQIRTPR

SEQ ID NO: 16580 - protein, 10 aa, Artificial Sequence
  source: /note="Description of Artificial Sequence: Synthetic peptide"
YQWIDQIRTP

SEQ ID NO: 16581 - protein, 10 aa, Artificial Sequence
  source: /note="Description of Artificial Sequence: Synthetic peptide"
DPEYQWIDQI

SEQ ID NO: 16582 - protein, 9 aa, Artificial Sequence
  source: /note="Description of Artificial Sequence: Synthetic peptide"
WIHSFRGVK

SEQ ID NO: 16583 - protein, 9 aa, Artificial Sequence
  source: /note="Description of Artificial Sequence: Synthetic peptide"
YNKSWIHSF

SEQ ID NO: 16584 - protein, 9 aa, Artificial Sequence
  source: /note="Description of Artificial Sequence: Synthetic peptide"
KSWIHSFRG

SEQ ID NO: 16585 - protein, 9 aa, Artificial Sequence
  source: /note="Description of Artificial Sequence: Synthetic peptide"
NKSWIHSFR

SEQ ID NO: 16586 - protein, 9 aa, Artificial Sequence
  source: /note="Description of Artificial Sequence: Synthetic peptide"
RIWNYNKSW

SEQ ID NO: 16587 - protein, 9 aa, Artificial Sequence
  source: /note="Description of Artificial Sequence: Synthetic peptide"
WNYNKSWIH

SEQ ID NO: 16588 - protein, 10 aa, Artificial Sequence
  source: /note="Description of Artificial Sequence: Synthetic peptide"
NYNKSWIHSF

SEQ ID NO: 16589 - protein, 10 aa, Artificial Sequence
  source: /note="Description of Artificial Sequence: Synthetic peptide"
RIWNYNKSWI

SEQ ID NO: 16590 - protein, 10 aa, Artificial Sequence
  source: /note="Description of Artificial Sequence: Synthetic peptide"
KSWIHSFRGV

SEQ ID NO: 16591 - protein, 10 aa, Artificial Sequence
  source: /note="Description of Artificial Sequence: Synthetic peptide"
SWIHSFRGVK

SEQ ID NO: 16592 - protein, 10 aa, Artificial Sequence
  source: /note="Description of Artificial Sequence: Synthetic peptide"
YNKSWIHSFR

SEQ ID NO: 16593 - protein, 10 aa, Artificial Sequence
  source: /note="Description of Artificial Sequence: Synthetic peptide"
IRIWNYNKSW

SEQ ID NO: 16594 - protein, 9 aa, Artificial Sequence
  source: /note="Description of Artificial Sequence: Synthetic peptide"
ATRKTICEA

SEQ ID NO: 16595 - protein, 9 aa, Artificial Sequence
  source: /note="Description of Artificial Sequence: Synthetic peptide"
RKTICEAEY

SEQ ID NO: 16596 - protein, 10 aa, Artificial Sequence
  source: /note="Description of Artificial Sequence: Synthetic peptide"
RPLSATRKTI

SEQ ID NO: 16597 - protein, 10 aa, Artificial Sequence
  source: /note="Description of Artificial Sequence: Synthetic peptide"
TRKTICEAEY

SEQ ID NO: 16598 - protein, 10 aa, Artificial Sequence
  source: /note="Description of Artificial Sequence: Synthetic peptide"
DVSDAAVSDL

SEQ ID NO: 16599 - protein, 10 aa, Artificial Sequence
  source: /note="Description of Artificial Sequence: Synthetic peptide"
SDLEDCSQSL

SEQ ID NO: 16600 - protein, 10 aa, Artificial Sequence
  source: /note="Description of Artificial Sequence: Synthetic peptide"
QPPPQPQPPL

SEQ ID NO: 16601 - protein, 9 aa, Artificial Sequence
  source: /note="Description of Artificial Sequence: Synthetic peptide"
TSLSSDWNK

SEQ ID NO: 16602 - protein, 9 aa, Artificial Sequence
  source: /note="Description of Artificial Sequence: Synthetic peptide"
LSSDWNKNR

SEQ ID NO: 16603 - protein, 9 aa, Artificial Sequence
  source: /note="Description of Artificial Sequence: Synthetic peptide"
QAVDASTSL

SEQ ID NO: 16604 - protein, 10 aa, Artificial Sequence
  source: /note="Description of Artificial Sequence: Synthetic peptide"
STSLSSDWNK

SEQ ID NO: 16605 - protein, 10 aa, Artificial Sequence
  source: /note="Description of Artificial Sequence: Synthetic peptide"
SLSSDWNKNR

SEQ ID NO: 16606 - protein, 10 aa, Artificial Sequence
  source: /note="Description of Artificial Sequence: Synthetic peptide"
KEREGQAVDA

SEQ ID NO: 16607 - protein, 10 aa, Artificial Sequence
  source: /note="Description of Artificial Sequence: Synthetic peptide"
REGQAVDAST

SEQ ID NO: 16608 - protein, 10 aa, Artificial Sequence
  source: /note="Description of Artificial Sequence: Synthetic peptide"
GQAVDASTSL

SEQ ID NO: 16609 - protein, 10 aa, Artificial Sequence
  source: /note="Description of Artificial Sequence: Synthetic peptide"
DASTSLSSDW

SEQ ID NO: 16610 - protein, 9 aa, Artificial Sequence
  source: /note="Description of Artificial Sequence: Synthetic peptide"
RSKSWAPFH

SEQ ID NO: 16611 - protein, 9 aa, Artificial Sequence
  source: /note="Description of Artificial Sequence: Synthetic peptide"
KSWAPFHLE

SEQ ID NO: 16612 - protein, 9 aa, Artificial Sequence
  source: /note="Description of Artificial Sequence: Synthetic peptide"
FRSKSWAPF

SEQ ID NO: 16613 - protein, 9 aa, Artificial Sequence
  source: /note="Description of Artificial Sequence: Synthetic peptide"
SKSWAPFHL

SEQ ID NO: 16614 - protein, 10 aa, Artificial Sequence
  source: /note="Description of Artificial Sequence: Synthetic peptide"
NFRSKSWAPF

SEQ ID NO: 16615 - protein, 10 aa, Artificial Sequence
  source: /note="Description of Artificial Sequence: Synthetic peptide"
RSKSWAPFHL

SEQ ID NO: 16616 - protein, 10 aa, Artificial Sequence
  source: /note="Description of Artificial Sequence: Synthetic peptide"
APFHLEEPNI

SEQ ID NO: 16617 - protein, 9 aa, Artificial Sequence
  source: /note="Description of Artificial Sequence: Synthetic peptide"
RLIYWTGRK

SEQ ID NO: 16618 - protein, 9 aa, Artificial Sequence
  source: /note="Description of Artificial Sequence: Synthetic peptide"
LEPTLRLIY

SEQ ID NO: 16619 - protein, 9 aa, Artificial Sequence
  source: /note="Description of Artificial Sequence: Synthetic peptide"
LIYWTGRKI

SEQ ID NO: 16620 - protein, 9 aa, Artificial Sequence
  source: /note="Description of Artificial Sequence: Synthetic peptide"
EPTLRLIYW

SEQ ID NO: 16621 - protein, 10 aa, Artificial Sequence
  source: /note="Description of Artificial Sequence: Synthetic peptide"
HLEPTLRLIY

SEQ ID NO: 16622 - protein, 10 aa, Artificial Sequence
  source: /note="Description of Artificial Sequence: Synthetic peptide"
RLIYWTGRKI

SEQ ID NO: 16623 - protein, 10 aa, Artificial Sequence
  source: /note="Description of Artificial Sequence: Synthetic peptide"
TLRLIYWTGR

SEQ ID NO: 16624 - protein, 9 aa, Artificial Sequence
  source: /note="Description of Artificial Sequence: Synthetic peptide"
NSLITQMMK

SEQ ID NO: 16625 - protein, 9 aa, Artificial Sequence
  source: /note="Description of Artificial Sequence: Synthetic peptide"
EKNSLITQM

SEQ ID NO: 16626 - protein, 9 aa, Artificial Sequence
  source: /note="Description of Artificial Sequence: Synthetic peptide"
KNSLITQMM

SEQ ID NO: 16627 - protein, 9 aa, Artificial Sequence
  source: /note="Description of Artificial Sequence: Synthetic peptide"
TPLEKNSLI

SEQ ID NO: 16628 - protein, 10 aa, Artificial Sequence
  source: /note="Description of Artificial Sequence: Synthetic peptide"
KNSLITQMMK

SEQ ID NO: 16629 - protein, 10 aa, Artificial Sequence
  source: /note="Description of Artificial Sequence: Synthetic peptide"
LEKNSLITQM

SEQ ID NO: 16630 - protein, 10 aa, Artificial Sequence
  source: /note="Description of Artificial Sequence: Synthetic peptide"
EKNSLITQMM

SEQ ID NO: 16631 - protein, 9 aa, Artificial Sequence
  source: /note="Description of Artificial Sequence: Synthetic peptide"
GVRMKSVGI

SEQ ID NO: 16632 - protein, 9 aa, Artificial Sequence
  source: /note="Description of Artificial Sequence: Synthetic peptide"
SELERGVRM

SEQ ID NO: 16633 - protein, 9 aa, Artificial Sequence
  source: /note="Description of Artificial Sequence: Synthetic peptide"
VRMKSVGIL

SEQ ID NO: 16634 - protein, 9 aa, Artificial Sequence
  source: /note="Description of Artificial Sequence: Synthetic peptide"
VESELERGV

SEQ ID NO: 16635 - protein, 10 aa, Artificial Sequence
  source: /note="Description of Artificial Sequence: Synthetic peptide"
GVRMKSVGIL

SEQ ID NO: 16636 - protein, 10 aa, Artificial Sequence
  source: /note="Description of Artificial Sequence: Synthetic peptide"
LERGVRMKSV

SEQ ID NO: 16637 - protein, 9 aa, Artificial Sequence
  source: /note="Description of Artificial Sequence: Synthetic peptide"
FSTQDAAPV

SEQ ID NO: 16638 - protein, 9 aa, Artificial Sequence
  source: /note="Description of Artificial Sequence: Synthetic peptide"
KRFSTQDAA

SEQ ID NO: 16639 - protein, 10 aa, Artificial Sequence
  source: /note="Description of Artificial Sequence: Synthetic peptide"
VTKRFSTQDA

SEQ ID NO: 16640 - protein, 9 aa, Artificial Sequence
  source: /note="Description of Artificial Sequence: Synthetic peptide"
RSASAWRRR

SEQ ID NO: 16641 - protein, 9 aa, Artificial Sequence
  source: /note="Description of Artificial Sequence: Synthetic peptide"
SASAWRRRR

SEQ ID NO: 16642 - protein, 9 aa, Artificial Sequence
  source: /note="Description of Artificial Sequence: Synthetic peptide"
KRRRGGGWR

SEQ ID NO: 16643 - protein, 9 aa, Artificial Sequence
  source: /note="Description of Artificial Sequence: Synthetic peptide"
GWRRTPGWR

SEQ ID NO: 16644 - protein, 9 aa, Artificial Sequence
  source: /note="Description of Artificial Sequence: Synthetic peptide"
GWRSGGGRR

SEQ ID NO: 16645 - protein, 9 aa, Artificial Sequence
  source: /note="Description of Artificial Sequence: Synthetic peptide"
RSGGGRRRR

SEQ ID NO: 16646 - protein, 9 aa, Artificial Sequence
  source: /note="Description of Artificial Sequence: Synthetic peptide"
SGGGRRRRK

SEQ ID NO: 16647 - protein, 9 aa, Artificial Sequence
  source: /note="Description of Artificial Sequence: Synthetic peptide"
RSSKGRRRR

SEQ ID NO: 16648 - protein, 9 aa, Artificial Sequence
  source: /note="Description of Artificial Sequence: Synthetic peptide"
SSKGRRRRR

SEQ ID NO: 16649 - protein, 9 aa, Artificial Sequence
  source: /note="Description of Artificial Sequence: Synthetic peptide"
KGRRRRRLR

SEQ ID NO: 16650 - protein, 9 aa, Artificial Sequence
  source: /note="Description of Artificial Sequence: Synthetic peptide"
RRRRLRDGK

SEQ ID NO: 16651 - protein, 9 aa, Artificial Sequence
  source: /note="Description of Artificial Sequence: Synthetic peptide"
KSWNSRRRR

SEQ ID NO: 16652 - protein, 9 aa, Artificial Sequence
  source: /note="Description of Artificial Sequence: Synthetic peptide"
RRRCRGRPR

SEQ ID NO: 16653 - protein, 9 aa, Artificial Sequence
  source: /note="Description of Artificial Sequence: Synthetic peptide"
RGRPRRWRR

SEQ ID NO: 16654 - protein, 9 aa, Artificial Sequence
  source: /note="Description of Artificial Sequence: Synthetic peptide"
RWRRLGRAG

SEQ ID NO: 16655 - protein, 9 aa, Artificial Sequence
  source: /note="Description of Artificial Sequence: Synthetic peptide"
LGRAGGARR

SEQ ID NO: 16656 - protein, 9 aa, Artificial Sequence
  source: /note="Description of Artificial Sequence: Synthetic peptide"
RAGGARRRR

SEQ ID NO: 16657 - protein, 9 aa, Artificial Sequence
  source: /note="Description of Artificial Sequence: Synthetic peptide"
GARRRRIWG

SEQ ID NO: 16658 - protein, 9 aa, Artificial Sequence
  source: /note="Description of Artificial Sequence: Synthetic peptide"
ARRRRIWGK

SEQ ID NO: 16659 - protein, 9 aa, Artificial Sequence
  source: /note="Description of Artificial Sequence: Synthetic peptide"
RRRRIWGKR

SEQ ID NO: 16660 - protein, 9 aa, Artificial Sequence
  source: /note="Description of Artificial Sequence: Synthetic peptide"
RIWGKRRRR

SEQ ID NO: 16661 - protein, 9 aa, Artificial Sequence
  source: /note="Description of Artificial Sequence: Synthetic peptide"
RRRARRTWR

SEQ ID NO: 16662 - protein, 9 aa, Artificial Sequence
  source: /note="Description of Artificial Sequence: Synthetic peptide"
RARRTWRTG

SEQ ID NO: 16663 - protein, 9 aa, Artificial Sequence
  source: /note="Description of Artificial Sequence: Synthetic peptide"
DGKSWNSRR

SEQ ID NO: 16664 - protein, 9 aa, Artificial Sequence
  source: /note="Description of Artificial Sequence: Synthetic peptide"
RPRRWRRLG

SEQ ID NO: 16665 - protein, 9 aa, Artificial Sequence
  source: /note="Description of Artificial Sequence: Synthetic peptide"
RERRSASAW

SEQ ID NO: 16666 - protein, 9 aa, Artificial Sequence
  source: /note="Description of Artificial Sequence: Synthetic peptide"
RRLRDGKSW

SEQ ID NO: 16667 - protein, 9 aa, Artificial Sequence
  source: /note="Description of Artificial Sequence: Synthetic peptide"
RRRRARRTW

SEQ ID NO: 16668 - protein, 9 aa, Artificial Sequence
  source: /note="Description of Artificial Sequence: Synthetic peptide"
WRTGGGSSV

SEQ ID NO: 16669 - protein, 9 aa, Artificial Sequence
  source: /note="Description of Artificial Sequence: Synthetic peptide"
TGGGSSVSF

SEQ ID NO: 16670 - protein, 9 aa, Artificial Sequence
  source: /note="Description of Artificial Sequence: Synthetic peptide"
AERRERRSA

SEQ ID NO: 16671 - protein, 10 aa, Artificial Sequence
  source: /note="Description of Artificial Sequence: Synthetic peptide"
RTGGGSSVSF

SEQ ID NO: 16672 - protein, 10 aa, Artificial Sequence
  source: /note="Description of Artificial Sequence: Synthetic peptide"
RERRSASAWR

SEQ ID NO: 16673 - protein, 10 aa, Artificial Sequence
  source: /note="Description of Artificial Sequence: Synthetic peptide"
RSASAWRRRR

SEQ ID NO: 16674 - protein, 10 aa, Artificial Sequence
  source: /note="Description of Artificial Sequence: Synthetic peptide"
AWRRRRSEGV

SEQ ID NO: 16675 - protein, 10 aa, Artificial Sequence
  source: /note="Description of Artificial Sequence: Synthetic peptide"
KRRRGGGWRR

SEQ ID NO: 16676 - protein, 10 aa, Artificial Sequence
  source: /note="Description of Artificial Sequence: Synthetic peptide"
RSGGGRRRRK

SEQ ID NO: 16677 - protein, 10 aa, Artificial Sequence
  source: /note="Description of Artificial Sequence: Synthetic peptide"
RSSKGRRRRR

SEQ ID NO: 16678 - protein, 10 aa, Artificial Sequence
  source: /note="Description of Artificial Sequence: Synthetic peptide"
SSKGRRRRRL

SEQ ID NO: 16679 - protein, 10 aa, Artificial Sequence
  source: /note="Description of Artificial Sequence: Synthetic peptide"
KGRRRRRLRD

SEQ ID NO: 16680 - protein, 10 aa, Artificial Sequence
  source: /note="Description of Artificial Sequence: Synthetic peptide"
RRRRRLRDGK

SEQ ID NO: 16681 - protein, 10 aa, Artificial Sequence
  source: /note="Description of Artificial Sequence: Synthetic peptide"
RLRDGKSWNS

SEQ ID NO: 16682 - protein, 10 aa, Artificial Sequence
  source: /note="Description of Artificial Sequence: Synthetic peptide"
KSWNSRRRRC

SEQ ID NO: 16683 - protein, 10 aa, Artificial Sequence
  source: /note="Description of Artificial Sequence: Synthetic peptide"
NSRRRRCRGR

SEQ ID NO: 16684 - protein, 10 aa, Artificial Sequence
  source: /note="Description of Artificial Sequence: Synthetic peptide"
RRRRCRGRPR

SEQ ID NO: 16685 - protein, 10 aa, Artificial Sequence
  source: /note="Description of Artificial Sequence: Synthetic peptide"
RRRCRGRPRR

SEQ ID NO: 16686 - protein, 10 aa, Artificial Sequence
  source: /note="Description of Artificial Sequence: Synthetic peptide"
RCRGRPRRWR

SEQ ID NO: 16687 - protein, 10 aa, Artificial Sequence
  source: /note="Description of Artificial Sequence: Synthetic peptide"
RGRPRRWRRL

SEQ ID NO: 16688 - protein, 10 aa, Artificial Sequence
  source: /note="Description of Artificial Sequence: Synthetic peptide"
RPRRWRRLGR

SEQ ID NO: 16689 - protein, 10 aa, Artificial Sequence
  source: /note="Description of Artificial Sequence: Synthetic peptide"
RWRRLGRAGG

SEQ ID NO: 16690 - protein, 10 aa, Artificial Sequence
  source: /note="Description of Artificial Sequence: Synthetic peptide"
LGRAGGARRR

SEQ ID NO: 16691 - protein, 10 aa, Artificial Sequence
  source: /note="Description of Artificial Sequence: Synthetic peptide"
RAGGARRRRI

SEQ ID NO: 16692 - protein, 10 aa, Artificial Sequence
  source: /note="Description of Artificial Sequence: Synthetic peptide"
GARRRRIWGK

SEQ ID NO: 16693 - protein, 10 aa, Artificial Sequence
  source: /note="Description of Artificial Sequence: Synthetic peptide"
RIWGKRRRRA

SEQ ID NO: 16694 - protein, 10 aa, Artificial Sequence
  source: /note="Description of Artificial Sequence: Synthetic peptide"
RRRRARRTWR

SEQ ID NO: 16695 - protein, 10 aa, Artificial Sequence
  source: /note="Description of Artificial Sequence: Synthetic peptide"
RARRTWRTGG

SEQ ID NO: 16696 - protein, 10 aa, Artificial Sequence
  source: /note="Description of Artificial Sequence: Synthetic peptide"
TWRTGGGSSV

SEQ ID NO: 16697 - protein, 10 aa, Artificial Sequence
  source: /note="Description of Artificial Sequence: Synthetic peptide"
DARRSSKGRR

SEQ ID NO: 16698 - protein, 10 aa, Artificial Sequence
  source: /note="Description of Artificial Sequence: Synthetic peptide"
DGKSWNSRRR

SEQ ID NO: 16699 - protein, 10 aa, Artificial Sequence
  source: /note="Description of Artificial Sequence: Synthetic peptide"
SWNSRRRRCR

SEQ ID NO: 16700 - protein, 10 aa, Artificial Sequence
  source: /note="Description of Artificial Sequence: Synthetic peptide"
RPRPKRRRGG

SEQ ID NO: 16701 - protein, 10 aa, Artificial Sequence
  source: /note="Description of Artificial Sequence: Synthetic peptide"
RPKRRRGGGW

SEQ ID NO: 16702 - protein, 10 aa, Artificial Sequence
  source: /note="Description of Artificial Sequence: Synthetic peptide"
ERRERRSASA

SEQ ID NO: 16703 - protein, 10 aa, Artificial Sequence
  source: /note="Description of Artificial Sequence: Synthetic peptide"
RRERRSASAW

SEQ ID NO: 16704 - protein, 10 aa, Artificial Sequence
  source: /note="Description of Artificial Sequence: Synthetic peptide"
RRRLRDGKSW

SEQ ID NO: 16705 - protein, 9 aa, Artificial Sequence
  source: /note="Description of Artificial Sequence: Synthetic peptide"
RKMRGGAQK

SEQ ID NO: 16706 - protein, 9 aa, Artificial Sequence
  source: /note="Description of Artificial Sequence: Synthetic peptide"
KMRGGAQKA

SEQ ID NO: 16707 - protein, 9 aa, Artificial Sequence
  source: /note="Description of Artificial Sequence: Synthetic peptide"
REREGARAP

SEQ ID NO: 16708 - protein, 9 aa, Artificial Sequence
  source: /note="Description of Artificial Sequence: Synthetic peptide"
RQAGGAEAA

SEQ ID NO: 16709 - protein, 9 aa, Artificial Sequence
  source: /note="Description of Artificial Sequence: Synthetic peptide"
AERREREGA

SEQ ID NO: 16710 - protein, 10 aa, Artificial Sequence
  source: /note="Description of Artificial Sequence: Synthetic peptide"
RAPGGGGGAK

SEQ ID NO: 16711 - protein, 10 aa, Artificial Sequence
  source: /note="Description of Artificial Sequence: Synthetic peptide"
KMRGGAQKAG

SEQ ID NO: 16712 - protein, 10 aa, Artificial Sequence
  source: /note="Description of Artificial Sequence: Synthetic peptide"
REREGARAPG

SEQ ID NO: 16713 - protein, 10 aa, Artificial Sequence
  source: /note="Description of Artificial Sequence: Synthetic peptide"
RQAGGAEAAG

SEQ ID NO: 16714 - protein, 10 aa, Artificial Sequence
  source: /note="Description of Artificial Sequence: Synthetic peptide"
RKMRGGAQKA

SEQ ID NO: 16715 - protein, 9 aa, Artificial Sequence
  source: /note="Description of Artificial Sequence: Synthetic peptide"
RVISHDRDF

SEQ ID NO: 16716 - protein, 9 aa, Artificial Sequence
  source: /note="Description of Artificial Sequence: Synthetic peptide"
VMDNQLKSM

SEQ ID NO: 16717 - protein, 9 aa, Artificial Sequence
  source: /note="Description of Artificial Sequence: Synthetic peptide"
MDNQLKSMW

SEQ ID NO: 16718 - protein, 10 aa, Artificial Sequence
  source: /note="Description of Artificial Sequence: Synthetic peptide"
VLADVMDNQL

SEQ ID NO: 16719 - protein, 10 aa, Artificial Sequence
  source: /note="Description of Artificial Sequence: Synthetic peptide"
DVMDNQLKSM

SEQ ID NO: 16720 - protein, 10 aa, Artificial Sequence
  source: /note="Description of Artificial Sequence: Synthetic peptide"
VMDNQLKSMW

SEQ ID NO: 16721 - protein, 10 aa, Artificial Sequence
  source: /note="Description of Artificial Sequence: Synthetic peptide"
MDNQLKSMWF

SEQ ID NO: 16722 - protein, 9 aa, Artificial Sequence
  source: /note="Description of Artificial Sequence: Synthetic peptide"
RAAIIFGYR

SEQ ID NO: 16723 - protein, 9 aa, Artificial Sequence
  source: /note="Description of Artificial Sequence: Synthetic peptide"
LQRAAIIFG

SEQ ID NO: 16724 - protein, 9 aa, Artificial Sequence
  source: /note="Description of Artificial Sequence: Synthetic peptide"
QRAAIIFGY

SEQ ID NO: 16725 - protein, 9 aa, Artificial Sequence
  source: /note="Description of Artificial Sequence: Synthetic peptide"
AAIIFGYRI

SEQ ID NO: 16726 - protein, 9 aa, Artificial Sequence
  source: /note="Description of Artificial Sequence: Synthetic peptide"
FGYRIQGVI

SEQ ID NO: 16727 - protein, 10 aa, Artificial Sequence
  source: /note="Description of Artificial Sequence: Synthetic peptide"
IIFGYRIQGV

SEQ ID NO: 16728 - protein, 10 aa, Artificial Sequence
  source: /note="Description of Artificial Sequence: Synthetic peptide"
RAAIIFGYRI

SEQ ID NO: 16729 - protein, 10 aa, Artificial Sequence
  source: /note="Description of Artificial Sequence: Synthetic peptide"
IFGYRIQGVI

SEQ ID NO: 16730 - protein, 10 aa, Artificial Sequence
  source: /note="Description of Artificial Sequence: Synthetic peptide"
LQRAAIIFGY

SEQ ID NO: 16731 - protein, 10 aa, Artificial Sequence
  source: /note="Description of Artificial Sequence: Synthetic peptide"
MDLQRAAIIF

SEQ ID NO: 16732 - protein, 10 aa, Artificial Sequence
  source: /note="Description of Artificial Sequence: Synthetic peptide"
KFKKKTAEDR

SEQ ID NO: 16733 - protein, 10 aa, Artificial Sequence
  source: /note="Description of Artificial Sequence: Synthetic peptide"
KELDTDADKF

SEQ ID NO: 16734 - protein, 9 aa, Artificial Sequence
  source: /note="Description of Artificial Sequence: Synthetic peptide"
EQELFTENM

SEQ ID NO: 16735 - protein, 9 aa, Artificial Sequence
  source: /note="Description of Artificial Sequence: Synthetic peptide"
EEQELFTEN

SEQ ID NO: 16736 - protein, 10 aa, Artificial Sequence
  source: /note="Description of Artificial Sequence: Synthetic peptide"
FTENMRGELR

SEQ ID NO: 16737 - protein, 10 aa, Artificial Sequence
  source: /note="Description of Artificial Sequence: Synthetic peptide"
NMRGELRACR

SEQ ID NO: 16738 - protein, 10 aa, Artificial Sequence
  source: /note="Description of Artificial Sequence: Synthetic peptide"
EEQELFTENM

SEQ ID NO: 16739 - protein, 10 aa, Artificial Sequence
  source: /note="Description of Artificial Sequence: Synthetic peptide"
TENMRGELRA

SEQ ID NO: 16740 - protein, 9 aa, Artificial Sequence
  source: /note="Description of Artificial Sequence: Synthetic peptide"
RQGDFYLHV

SEQ ID NO: 16741 - protein, 10 aa, Artificial Sequence
  source: /note="Description of Artificial Sequence: Synthetic peptide"
LLRQGDFYLH

SEQ ID NO: 16742 - protein, 10 aa, Artificial Sequence
  source: /note="Description of Artificial Sequence: Synthetic peptide"
RQGDFYLHVE

SEQ ID NO: 16743 - protein, 9 aa, Artificial Sequence
  source: /note="Description of Artificial Sequence: Synthetic peptide"
MLERELNIL

SEQ ID NO: 16744 - protein, 9 aa, Artificial Sequence
  source: /note="Description of Artificial Sequence: Synthetic peptide"
REIDMLERE

SEQ ID NO: 16745 - protein, 10 aa, Artificial Sequence
  source: /note="Description of Artificial Sequence: Synthetic peptide"
QLAEREIDML

SEQ ID NO: 16746 - protein, 10 aa, Artificial Sequence
  source: /note="Description of Artificial Sequence: Synthetic peptide"
MLERELNILI

SEQ ID NO: 16747 - protein, 10 aa, Artificial Sequence
  source: /note="Description of Artificial Sequence: Synthetic peptide"
QQLAEREIDM

SEQ ID NO: 16748 - protein, 10 aa, Artificial Sequence
  source: /note="Description of Artificial Sequence: Synthetic peptide"
REIDMLEREL

SEQ ID NO: 16749 - protein, 10 aa, Artificial Sequence
  source: /note="Description of Artificial Sequence: Synthetic peptide"
IDMLERELNI

SEQ ID NO: 16750 - protein, 9 aa, Artificial Sequence
  source: /note="Description of Artificial Sequence: Synthetic peptide"
EWELNILIF

SEQ ID NO: 16751 - protein, 9 aa, Artificial Sequence
  source: /note="Description of Artificial Sequence: Synthetic peptide"
EIDVLEWEL

SEQ ID NO: 16752 - protein, 9 aa, Artificial Sequence
  source: /note="Description of Artificial Sequence: Synthetic peptide"
DVLEWELNI

SEQ ID NO: 16753 - protein, 9 aa, Artificial Sequence
  source: /note="Description of Artificial Sequence: Synthetic peptide"
LEWELNILI

SEQ ID NO: 16754 - protein, 9 aa, Artificial Sequence
  source: /note="Description of Artificial Sequence: Synthetic peptide"
WELNILIFQ

SEQ ID NO: 16755 - protein, 10 aa, Artificial Sequence
  source: /note="Description of Artificial Sequence: Synthetic peptide"
VLEWELNILI

SEQ ID NO: 16756 - protein, 10 aa, Artificial Sequence
  source: /note="Description of Artificial Sequence: Synthetic peptide"
AEREIDVLEW

SEQ ID NO: 16757 - protein, 10 aa, Artificial Sequence
  source: /note="Description of Artificial Sequence: Synthetic peptide"
REIDVLEWEL

SEQ ID NO: 16758 - protein, 10 aa, Artificial Sequence
  source: /note="Description of Artificial Sequence: Synthetic peptide"
LEWELNILIF

SEQ ID NO: 16759 - protein, 10 aa, Artificial Sequence
  source: /note="Description of Artificial Sequence: Synthetic peptide"
WELNILIFQL

SEQ ID NO: 16760 - protein, 9 aa, Artificial Sequence
  source: /note="Description of Artificial Sequence: Synthetic peptide"
RQWWCTCRM

SEQ ID NO: 16761 - protein, 9 aa, Artificial Sequence
  source: /note="Description of Artificial Sequence: Synthetic peptide"
RMSGPSCLL

SEQ ID NO: 16762 - protein, 9 aa, Artificial Sequence
  source: /note="Description of Artificial Sequence: Synthetic peptide"
TLLDGTQKL

SEQ ID NO: 16763 - protein, 9 aa, Artificial Sequence
  source: /note="Description of Artificial Sequence: Synthetic peptide"
QTLLDGTQK

SEQ ID NO: 16764 - protein, 9 aa, Artificial Sequence
  source: /note="Description of Artificial Sequence: Synthetic peptide"
MSGPSCLLW

SEQ ID NO: 16765 - protein, 9 aa, Artificial Sequence
  source: /note="Description of Artificial Sequence: Synthetic peptide"
LWRSGRPCA

SEQ ID NO: 16766 - protein, 9 aa, Artificial Sequence
  source: /note="Description of Artificial Sequence: Synthetic peptide"
RSGRPCASR

SEQ ID NO: 16767 - protein, 9 aa, Artificial Sequence
  source: /note="Description of Artificial Sequence: Synthetic peptide"
SGRPCASRK

SEQ ID NO: 16768 - protein, 9 aa, Artificial Sequence
  source: /note="Description of Artificial Sequence: Synthetic peptide"
ASRKLQRQL

SEQ ID NO: 16769 - protein, 9 aa, Artificial Sequence
  source: /note="Description of Artificial Sequence: Synthetic peptide"
KGKRSLLNR

SEQ ID NO: 16770 - protein, 9 aa, Artificial Sequence
  source: /note="Description of Artificial Sequence: Synthetic peptide"
RSLLNRHLM

SEQ ID NO: 16771 - protein, 9 aa, Artificial Sequence
  source: /note="Description of Artificial Sequence: Synthetic peptide"
KLQRPPHSR

SEQ ID NO: 16772 - protein, 9 aa, Artificial Sequence
  source: /note="Description of Artificial Sequence: Synthetic peptide"
LQRPPHSRK

SEQ ID NO: 16773 - protein, 9 aa, Artificial Sequence
  source: /note="Description of Artificial Sequence: Synthetic peptide"
HSRKRTLIS

SEQ ID NO: 16774 - protein, 9 aa, Artificial Sequence
  source: /note="Description of Artificial Sequence: Synthetic peptide"
RTLISQRPL

SEQ ID NO: 16775 - protein, 9 aa, Artificial Sequence
  source: /note="Description of Artificial Sequence: Synthetic peptide"
SCLLWRSGR

SEQ ID NO: 16776 - protein, 9 aa, Artificial Sequence
  source: /note="Description of Artificial Sequence: Synthetic peptide"
MPWSKQQTL

SEQ ID NO: 16777 - protein, 9 aa, Artificial Sequence
  source: /note="Description of Artificial Sequence: Synthetic peptide"
PPHSRKRTL

SEQ ID NO: 16778 - protein, 9 aa, Artificial Sequence
  source: /note="Description of Artificial Sequence: Synthetic peptide"
LQPGPPGGF

SEQ ID NO: 16779 - protein, 9 aa, Artificial Sequence
  source: /note="Description of Artificial Sequence: Synthetic peptide"
CRMSGPSCL

SEQ ID NO: 16780 - protein, 9 aa, Artificial Sequence
  source: /note="Description of Artificial Sequence: Synthetic peptide"
RQLPQPRRH

SEQ ID NO: 16781 - protein, 9 aa, Artificial Sequence
  source: /note="Description of Artificial Sequence: Synthetic peptide"
RRHKGKRSL

SEQ ID NO: 16782 - protein, 9 aa, Artificial Sequence
  source: /note="Description of Artificial Sequence: Synthetic peptide"
KRSLLNRHL

SEQ ID NO: 16783 - protein, 9 aa, Artificial Sequence
  source: /note="Description of Artificial Sequence: Synthetic peptide"
LLNRHLMPW

SEQ ID NO: 16784 - protein, 10 aa, Artificial Sequence
  source: /note="Description of Artificial Sequence: Synthetic peptide"
LLNRHLMPWS

SEQ ID NO: 16785 - protein, 10 aa, Artificial Sequence
  source: /note="Description of Artificial Sequence: Synthetic peptide"
HLMPWSKQQT

SEQ ID NO: 16786 - protein, 10 aa, Artificial Sequence
  source: /note="Description of Artificial Sequence: Synthetic peptide"
LMPWSKQQTL

SEQ ID NO: 16787 - protein, 10 aa, Artificial Sequence
  source: /note="Description of Artificial Sequence: Synthetic peptide"
RSGRPCASRK

SEQ ID NO: 16788 - protein, 10 aa, Artificial Sequence
  source: /note="Description of Artificial Sequence: Synthetic peptide"
KLQRPPHSRK

SEQ ID NO: 16789 - protein, 10 aa, Artificial Sequence
  source: /note="Description of Artificial Sequence: Synthetic peptide"
MSGPSCLLWR

SEQ ID NO: 16790 - protein, 10 aa, Artificial Sequence
  source: /note="Description of Artificial Sequence: Synthetic peptide"
YLQPGPPGGF

SEQ ID NO: 16791 - protein, 10 aa, Artificial Sequence
  source: /note="Description of Artificial Sequence: Synthetic peptide"
RMSGPSCLLW

SEQ ID NO: 16792 - protein, 10 aa, Artificial Sequence
  source: /note="Description of Artificial Sequence: Synthetic peptide"
SLLNRHLMPW

SEQ ID NO: 16793 - protein, 10 aa, Artificial Sequence
  source: /note="Description of Artificial Sequence: Synthetic peptide"
SGRPCASRKL

SEQ ID NO: 16794 - protein, 10 aa, Artificial Sequence
  source: /note="Description of Artificial Sequence: Synthetic peptide"
LQRQLPQPRR

SEQ ID NO: 16795 - protein, 10 aa, Artificial Sequence
  source: /note="Description of Artificial Sequence: Synthetic peptide"
RQLPQPRRHK

SEQ ID NO: 16796 - protein, 10 aa, Artificial Sequence
  source: /note="Description of Artificial Sequence: Synthetic peptide"
KGKRSLLNRH

SEQ ID NO: 16797 - protein, 10 aa, Artificial Sequence
  source: /note="Description of Artificial Sequence: Synthetic peptide"
LNRHLMPWSK

SEQ ID NO: 16798 - protein, 10 aa, Artificial Sequence
  source: /note="Description of Artificial Sequence: Synthetic peptide"
LQRPPHSRKR

SEQ ID NO: 16799 - protein, 10 aa, Artificial Sequence
  source: /note="Description of Artificial Sequence: Synthetic peptide"
HSRKRTLISQ

SEQ ID NO: 16800 - protein, 10 aa, Artificial Sequence
  source: /note="Description of Artificial Sequence: Synthetic peptide"
RTLISQRPLH

SEQ ID NO: 16801 - protein, 10 aa, Artificial Sequence
  source: /note="Description of Artificial Sequence: Synthetic peptide"
GFRQWWCTCR

SEQ ID NO: 16802 - protein, 10 aa, Artificial Sequence
  source: /note="Description of Artificial Sequence: Synthetic peptide"
KLQRQLPQPR

SEQ ID NO: 16803 - protein, 10 aa, Artificial Sequence
  source: /note="Description of Artificial Sequence: Synthetic peptide"
MPWSKQQTLL

SEQ ID NO: 16804 - protein, 10 aa, Artificial Sequence
  source: /note="Description of Artificial Sequence: Synthetic peptide"
RPPHSRKRTL

SEQ ID NO: 16805 - protein, 10 aa, Artificial Sequence
  source: /note="Description of Artificial Sequence: Synthetic peptide"
FQYLQPGPPG

SEQ ID NO: 16806 - protein, 10 aa, Artificial Sequence
  source: /note="Description of Artificial Sequence: Synthetic peptide"
FRQWWCTCRM

SEQ ID NO: 16807 - protein, 10 aa, Artificial Sequence
  source: /note="Description of Artificial Sequence: Synthetic peptide"
RQWWCTCRMS

SEQ ID NO: 16808 - protein, 10 aa, Artificial Sequence
  source: /note="Description of Artificial Sequence: Synthetic peptide"
CRMSGPSCLL

SEQ ID NO: 16809 - protein, 10 aa, Artificial Sequence
  source: /note="Description of Artificial Sequence: Synthetic peptide"
RRHKGKRSLL

SEQ ID NO: 16810 - protein, 10 aa, Artificial Sequence
  source: /note="Description of Artificial Sequence: Synthetic peptide"
GKRSLLNRHL

SEQ ID NO: 16811 - protein, 10 aa, Artificial Sequence
  source: /note="Description of Artificial Sequence: Synthetic peptide"
KRSLLNRHLM

SEQ ID NO: 16812 - protein, 10 aa, Artificial Sequence
  source: /note="Description of Artificial Sequence: Synthetic peptide"
KRTLISQRPL

SEQ ID NO: 16813 - protein, 9 aa, Artificial Sequence
  source: /note="Description of Artificial Sequence: Synthetic peptide"
SVFTTFPKR

SEQ ID NO: 16814 - protein, 9 aa, Artificial Sequence
  source: /note="Description of Artificial Sequence: Synthetic peptide"
TTFPKRESK

SEQ ID NO: 16815 - protein, 9 aa, Artificial Sequence
  source: /note="Description of Artificial Sequence: Synthetic peptide"
PSVFTTFPK

SEQ ID NO: 16816 - protein, 9 aa, Artificial Sequence
  source: /note="Description of Artificial Sequence: Synthetic peptide"
FFPSVFTTF

SEQ ID NO: 16817 - protein, 10 aa, Artificial Sequence
  source: /note="Description of Artificial Sequence: Synthetic peptide"
FTTFPKRESK

SEQ ID NO: 16818 - protein, 10 aa, Artificial Sequence
  source: /note="Description of Artificial Sequence: Synthetic peptide"
NFFPSVFTTF

SEQ ID NO: 16819 - protein, 10 aa, Artificial Sequence
  source: /note="Description of Artificial Sequence: Synthetic peptide"
FPSVFTTFPK

SEQ ID NO: 16820 - protein, 9 aa, Artificial Sequence
  source: /note="Description of Artificial Sequence: Synthetic peptide"
RICRPCEIK

SEQ ID NO: 16821 - protein, 9 aa, Artificial Sequence
  source: /note="Description of Artificial Sequence: Synthetic peptide"
ICRPCEIKK

SEQ ID NO: 16822 - protein, 9 aa, Artificial Sequence
  source: /note="Description of Artificial Sequence: Synthetic peptide"
SNYEIRICR

SEQ ID NO: 16823 - protein, 9 aa, Artificial Sequence
  source: /note="Description of Artificial Sequence: Synthetic peptide"
YEIRICRPC

SEQ ID NO: 16824 - protein, 10 aa, Artificial Sequence
  source: /note="Description of Artificial Sequence: Synthetic peptide"
RICRPCEIKK

SEQ ID NO: 16825 - protein, 10 aa, Artificial Sequence
  source: /note="Description of Artificial Sequence: Synthetic peptide"
KSNYEIRICR

SEQ ID NO: 16826 - protein, 10 aa, Artificial Sequence
  source: /note="Description of Artificial Sequence: Synthetic peptide"
EIRICRPCEI

SEQ ID NO: 16827 - protein, 10 aa, Artificial Sequence
  source: /note="Description of Artificial Sequence: Synthetic peptide"
RAKKKKKKKR

SEQ ID NO: 16828 - protein, 9 aa, Artificial Sequence
  source: /note="Description of Artificial Sequence: Synthetic peptide"
FLNSRGLSS

SEQ ID NO: 16829 - protein, 9 aa, Artificial Sequence
  source: /note="Description of Artificial Sequence: Synthetic peptide"
GLSSARKFL

SEQ ID NO: 16830 - protein, 9 aa, Artificial Sequence
  source: /note="Description of Artificial Sequence: Synthetic peptide"
SARKFLVTS

SEQ ID NO: 16831 - protein, 9 aa, Artificial Sequence
  source: /note="Description of Artificial Sequence: Synthetic peptide"
NSRGLSSAR

SEQ ID NO: 16832 - protein, 9 aa, Artificial Sequence
  source: /note="Description of Artificial Sequence: Synthetic peptide"
LSSARKFLV

SEQ ID NO: 16833 - protein, 9 aa, Artificial Sequence
  source: /note="Description of Artificial Sequence: Synthetic peptide"
RGLSSARKF

SEQ ID NO: 16834 - protein, 10 aa, Artificial Sequence
  source: /note="Description of Artificial Sequence: Synthetic peptide"
FLNSRGLSSA

SEQ ID NO: 16835 - protein, 10 aa, Artificial Sequence
  source: /note="Description of Artificial Sequence: Synthetic peptide"
GLSSARKFLV

SEQ ID NO: 16836 - protein, 10 aa, Artificial Sequence
  source: /note="Description of Artificial Sequence: Synthetic peptide"
NSRGLSSARK

SEQ ID NO: 16837 - protein, 10 aa, Artificial Sequence
  source: /note="Description of Artificial Sequence: Synthetic peptide"
RGLSSARKFL

SEQ ID NO: 16838 - protein, 10 aa, Artificial Sequence
  source: /note="Description of Artificial Sequence: Synthetic peptide"
SARKFLVTSA

SEQ ID NO: 16839 - protein, 10 aa, Artificial Sequence
  source: /note="Description of Artificial Sequence: Synthetic peptide"
SRGLSSARKF

SEQ ID NO: 16840 - protein, 9 aa, Artificial Sequence
  source: /note="Description of Artificial Sequence: Synthetic peptide"
TMWSGKPSL

SEQ ID NO: 16841 - protein, 9 aa, Artificial Sequence
  source: /note="Description of Artificial Sequence: Synthetic peptide"
KQRTMWSGK

SEQ ID NO: 16842 - protein, 9 aa, Artificial Sequence
  source: /note="Description of Artificial Sequence: Synthetic peptide"
MWSGKPSLW

SEQ ID NO: 16843 - protein, 9 aa, Artificial Sequence
  source: /note="Description of Artificial Sequence: Synthetic peptide"
KQRKQRTMW

SEQ ID NO: 16844 - protein, 9 aa, Artificial Sequence
  source: /note="Description of Artificial Sequence: Synthetic peptide"
RTMWSGKPS

SEQ ID NO: 16845 - protein, 9 aa, Artificial Sequence
  source: /note="Description of Artificial Sequence: Synthetic peptide"
SAIKQRKQR

SEQ ID NO: 16846 - protein, 9 aa, Artificial Sequence
  source: /note="Description of Artificial Sequence: Synthetic peptide"
IKQRKQRTM

SEQ ID NO: 16847 - protein, 10 aa, Artificial Sequence
  source: /note="Description of Artificial Sequence: Synthetic peptide"
YLDEQIKKSA

SEQ ID NO: 16848 - protein, 10 aa, Artificial Sequence
  source: /note="Description of Artificial Sequence: Synthetic peptide"
TMWSGKPSLW

SEQ ID NO: 16849 - protein, 10 aa, Artificial Sequence
  source: /note="Description of Artificial Sequence: Synthetic peptide"
KSAIKQRKQR

SEQ ID NO: 16850 - protein, 10 aa, Artificial Sequence
  source: /note="Description of Artificial Sequence: Synthetic peptide"
AIKQRKQRTM

SEQ ID NO: 16851 - protein, 10 aa, Artificial Sequence
  source: /note="Description of Artificial Sequence: Synthetic peptide"
KQRKQRTMWS

SEQ ID NO: 16852 - protein, 10 aa, Artificial Sequence
  source: /note="Description of Artificial Sequence: Synthetic peptide"
RKQRTMWSGK

SEQ ID NO: 16853 - protein, 10 aa, Artificial Sequence
  source: /note="Description of Artificial Sequence: Synthetic peptide"
KQRTMWSGKP

SEQ ID NO: 16854 - protein, 10 aa, Artificial Sequence
  source: /note="Description of Artificial Sequence: Synthetic peptide"
RTMWSGKPSL

SEQ ID NO: 16855 - protein, 10 aa, Artificial Sequence
  source: /note="Description of Artificial Sequence: Synthetic peptide"
QIKKSAIKQR

SEQ ID NO: 16856 - protein, 10 aa, Artificial Sequence
  source: /note="Description of Artificial Sequence: Synthetic peptide"
IKQRKQRTMW

SEQ ID NO: 16857 - protein, 9 aa, Artificial Sequence
  source: /note="Description of Artificial Sequence: Synthetic peptide"
RITSQINLI

SEQ ID NO: 16858 - protein, 9 aa, Artificial Sequence
  source: /note="Description of Artificial Sequence: Synthetic peptide"
SQINLIDLA

SEQ ID NO: 16859 - protein, 9 aa, Artificial Sequence
  source: /note="Description of Artificial Sequence: Synthetic peptide"
HRITSQINL

SEQ ID NO: 16860 - protein, 10 aa, Artificial Sequence
  source: /note="Description of Artificial Sequence: Synthetic peptide"
HRITSQINLI

SEQ ID NO: 16861 - protein, 10 aa, Artificial Sequence
  source: /note="Description of Artificial Sequence: Synthetic peptide"
SQINLIDLAG

SEQ ID NO: 16862 - protein, 9 aa, Artificial Sequence
  source: /note="Description of Artificial Sequence: Synthetic peptide"
SMEKSNQIV

SEQ ID NO: 16863 - protein, 9 aa, Artificial Sequence
  source: /note="Description of Artificial Sequence: Synthetic peptide"
KSNQIVNIR

SEQ ID NO: 16864 - protein, 9 aa, Artificial Sequence
  source: /note="Description of Artificial Sequence: Synthetic peptide"
ESMEKSNQI

SEQ ID NO: 16865 - protein, 10 aa, Artificial Sequence
  source: /note="Description of Artificial Sequence: Synthetic peptide"
QIVNIRTSLL

SEQ ID NO: 16866 - protein, 10 aa, Artificial Sequence
  source: /note="Description of Artificial Sequence: Synthetic peptide"
ESMEKSNQIV

SEQ ID NO: 16867 - protein, 10 aa, Artificial Sequence
  source: /note="Description of Artificial Sequence: Synthetic peptide"
IESMEKSNQI

SEQ ID NO: 16868 - protein, 10 aa, Artificial Sequence
  source: /note="Description of Artificial Sequence: Synthetic peptide"
MEKSNQIVNI

SEQ ID NO: 16869 - protein, 10 aa, Artificial Sequence
  source: /note="Description of Artificial Sequence: Synthetic peptide"
NQIVNIRTSL

SEQ ID NO: 16870 - protein, 9 aa, Artificial Sequence
  source: /note="Description of Artificial Sequence: Synthetic peptide"
SFQTEVSYL

SEQ ID NO: 16871 - protein, 9 aa, Artificial Sequence
  source: /note="Description of Artificial Sequence: Synthetic peptide"
ASFQTEVSY

SEQ ID NO: 16872 - protein, 9 aa, Artificial Sequence
  source: /note="Description of Artificial Sequence: Synthetic peptide"
DEASFQTEV

SEQ ID NO: 16873 - protein, 10 aa, Artificial Sequence
  source: /note="Description of Artificial Sequence: Synthetic peptide"
QTEVSYLEIY

SEQ ID NO: 16874 - protein, 10 aa, Artificial Sequence
  source: /note="Description of Artificial Sequence: Synthetic peptide"
FQTEVSYLEI

SEQ ID NO: 16875 - protein, 10 aa, Artificial Sequence
  source: /note="Description of Artificial Sequence: Synthetic peptide"
EASFQTEVSY

SEQ ID NO: 16876 - protein, 10 aa, Artificial Sequence
  source: /note="Description of Artificial Sequence: Synthetic peptide"
ASFQTEVSYL

SEQ ID NO: 16877 - protein, 10 aa, Artificial Sequence
  source: /note="Description of Artificial Sequence: Synthetic peptide"
DEASFQTEVS

SEQ ID NO: 16878 - protein, 9 aa, Artificial Sequence
  source: /note="Description of Artificial Sequence: Synthetic peptide"
HMKVVVCVR

SEQ ID NO: 16879 - protein, 10 aa, Artificial Sequence
  source: /note="Description of Artificial Sequence: Synthetic peptide"
VVCVRPENTK

SEQ ID NO: 16880 - protein, 10 aa, Artificial Sequence
  source: /note="Description of Artificial Sequence: Synthetic peptide"
CVRPENTKEK

SEQ ID NO: 16881 - protein, 10 aa, Artificial Sequence
  source: /note="Description of Artificial Sequence: Synthetic peptide"
HHMKVVVCVR

SEQ ID NO: 16882 - protein, 9 aa, Artificial Sequence
  source: /note="Description of Artificial Sequence: Synthetic peptide"
LVVGRIWNK

SEQ ID NO: 16883 - protein, 9 aa, Artificial Sequence
  source: /note="Description of Artificial Sequence: Synthetic peptide"
RELVVGRIW

SEQ ID NO: 16884 - protein, 9 aa, Artificial Sequence
  source: /note="Description of Artificial Sequence: Synthetic peptide"
KSKDYLQVC

SEQ ID NO: 16885 - protein, 9 aa, Artificial Sequence
  source: /note="Description of Artificial Sequence: Synthetic peptide"
FKSKDYLQV

SEQ ID NO: 16886 - protein, 10 aa, Artificial Sequence
  source: /note="Description of Artificial Sequence: Synthetic peptide"
NTEANSFKSK

SEQ ID NO: 16887 - protein, 10 aa, Artificial Sequence
  source: /note="Description of Artificial Sequence: Synthetic peptide"
SFKSKDYLQV

SEQ ID NO: 16888 - protein, 10 aa, Artificial Sequence
  source: /note="Description of Artificial Sequence: Synthetic peptide"
KSKDYLQVCL

SEQ ID NO: 16889 - protein, 10 aa, Artificial Sequence
  source: /note="Description of Artificial Sequence: Synthetic peptide"
EANSFKSKDY

SEQ ID NO: 16890 - protein, 9 aa, Artificial Sequence
  source: /note="Description of Artificial Sequence: Synthetic peptide"
LMHTKIDKL

SEQ ID NO: 16891 - protein, 9 aa, Artificial Sequence
  source: /note="Description of Artificial Sequence: Synthetic peptide"
KLMHTKIDK

SEQ ID NO: 16892 - protein, 9 aa, Artificial Sequence
  source: /note="Description of Artificial Sequence: Synthetic peptide"
KLRTLDSVS

SEQ ID NO: 16893 - protein, 9 aa, Artificial Sequence
  source: /note="Description of Artificial Sequence: Synthetic peptide"
TKIDKLRTL

SEQ ID NO: 16894 - protein, 10 aa, Artificial Sequence
  source: /note="Description of Artificial Sequence: Synthetic peptide"
KLMHTKIDKL

SEQ ID NO: 16895 - protein, 10 aa, Artificial Sequence
  source: /note="Description of Artificial Sequence: Synthetic peptide"
HTKIDKLRTL

SEQ ID NO: 16896 - protein, 10 aa, Artificial Sequence
  source: /note="Description of Artificial Sequence: Synthetic peptide"
LMHTKIDKLR

SEQ ID NO: 16897 - protein, 9 aa, Artificial Sequence
  source: /note="Description of Artificial Sequence: Synthetic peptide"
RTNRTRAKG

SEQ ID NO: 16898 - protein, 9 aa, Artificial Sequence
  source: /note="Description of Artificial Sequence: Synthetic peptide"
RTRAKGNRL

SEQ ID NO: 16899 - protein, 10 aa, Artificial Sequence
  source: /note="Description of Artificial Sequence: Synthetic peptide"
RTRAKGNRLR

SEQ ID NO: 16900 - protein, 10 aa, Artificial Sequence
  source: /note="Description of Artificial Sequence: Synthetic peptide"
RAKGNRLREA

SEQ ID NO: 16901 - protein, 9 aa, Artificial Sequence
  source: /note="Description of Artificial Sequence: Synthetic peptide"
FQAKQYVFK

SEQ ID NO: 16902 - protein, 9 aa, Artificial Sequence
  source: /note="Description of Artificial Sequence: Synthetic peptide"
SFQAKQYVF

SEQ ID NO: 16903 - protein, 9 aa, Artificial Sequence
  source: /note="Description of Artificial Sequence: Synthetic peptide"
IGSFQAKQY

SEQ ID NO: 16904 - protein, 10 aa, Artificial Sequence
  source: /note="Description of Artificial Sequence: Synthetic peptide"
SFQAKQYVFK

SEQ ID NO: 16905 - protein, 10 aa, Artificial Sequence
  source: /note="Description of Artificial Sequence: Synthetic peptide"
KQYVFKSNDR

SEQ ID NO: 16906 - protein, 10 aa, Artificial Sequence
  source: /note="Description of Artificial Sequence: Synthetic peptide"
SIGSFQAKQY

SEQ ID NO: 16907 - protein, 10 aa, Artificial Sequence
  source: /note="Description of Artificial Sequence: Synthetic peptide"
GSFQAKQYVF

SEQ ID NO: 16908 - protein, 9 aa, Artificial Sequence
  source: /note="Description of Artificial Sequence: Synthetic peptide"
MTRTSGQLQ

SEQ ID NO: 16909 - protein, 10 aa, Artificial Sequence
  source: /note="Description of Artificial Sequence: Synthetic peptide"
RTSGQLQREK

SEQ ID NO: 16910 - protein, 10 aa, Artificial Sequence
  source: /note="Description of Artificial Sequence: Synthetic peptide"
MTRTSGQLQR

SEQ ID NO: 16911 - protein, 9 aa, Artificial Sequence
  source: /note="Description of Artificial Sequence: Synthetic peptide"
RLPPHCLPR

SEQ ID NO: 16912 - protein, 9 aa, Artificial Sequence
  source: /note="Description of Artificial Sequence: Synthetic peptide"
TSHPALLPR

SEQ ID NO: 16913 - protein, 9 aa, Artificial Sequence
  source: /note="Description of Artificial Sequence: Synthetic peptide"
RSTSHPALL

SEQ ID NO: 16914 - protein, 9 aa, Artificial Sequence
  source: /note="Description of Artificial Sequence: Synthetic peptide"
RGSCRLPPH

SEQ ID NO: 16915 - protein, 9 aa, Artificial Sequence
  source: /note="Description of Artificial Sequence: Synthetic peptide"
RARIPAWRL

SEQ ID NO: 16916 - protein, 9 aa, Artificial Sequence
  source: /note="Description of Artificial Sequence: Synthetic peptide"
STPRRGSCR

SEQ ID NO: 16917 - protein, 9 aa, Artificial Sequence
  source: /note="Description of Artificial Sequence: Synthetic peptide"
KPRPMGSPG

SEQ ID NO: 16918 - protein, 9 aa, Artificial Sequence
  source: /note="Description of Artificial Sequence: Synthetic peptide"
RPMGSPGWA

SEQ ID NO: 16919 - protein, 9 aa, Artificial Sequence
  source: /note="Description of Artificial Sequence: Synthetic peptide"
CPRPRSTSH

SEQ ID NO: 16920 - protein, 9 aa, Artificial Sequence
  source: /note="Description of Artificial Sequence: Synthetic peptide"
RPRSTSHPA

SEQ ID NO: 16921 - protein, 9 aa, Artificial Sequence
  source: /note="Description of Artificial Sequence: Synthetic peptide"
HPALLPRDA

SEQ ID NO: 16922 - protein, 9 aa, Artificial Sequence
  source: /note="Description of Artificial Sequence: Synthetic peptide"
TPRRGSCRL

SEQ ID NO: 16923 - protein, 9 aa, Artificial Sequence
  source: /note="Description of Artificial Sequence: Synthetic peptide"
LPRARIPAW

SEQ ID NO: 16924 - protein, 9 aa, Artificial Sequence
  source: /note="Description of Artificial Sequence: Synthetic peptide"
IPAWRLGSP

SEQ ID NO: 16925 - protein, 9 aa, Artificial Sequence
  source: /note="Description of Artificial Sequence: Synthetic peptide"
SPRCVRPRL

SEQ ID NO: 16926 - protein, 9 aa, Artificial Sequence
  source: /note="Description of Artificial Sequence: Synthetic peptide"
LPPHCLPRA

SEQ ID NO: 16927 - protein, 10 aa, Artificial Sequence
  source: /note="Description of Artificial Sequence: Synthetic peptide"
RLPPHCLPRA

SEQ ID NO: 16928 - protein, 10 aa, Artificial Sequence
  source: /note="Description of Artificial Sequence: Synthetic peptide"
STSHPALLPR

SEQ ID NO: 16929 - protein, 10 aa, Artificial Sequence
  source: /note="Description of Artificial Sequence: Synthetic peptide"
RPRSTSHPAL

SEQ ID NO: 16930 - protein, 10 aa, Artificial Sequence
  source: /note="Description of Artificial Sequence: Synthetic peptide"
KSTPRRGSCR

SEQ ID NO: 16931 - protein, 10 aa, Artificial Sequence
  source: /note="Description of Artificial Sequence: Synthetic peptide"
RARIPAWRLG

SEQ ID NO: 16932 - protein, 10 aa, Artificial Sequence
  source: /note="Description of Artificial Sequence: Synthetic peptide"
WASPACPRPR

SEQ ID NO: 16933 - protein, 10 aa, Artificial Sequence
  source: /note="Description of Artificial Sequence: Synthetic peptide"
LPRARIPAWR

SEQ ID NO: 16934 - protein, 10 aa, Artificial Sequence
  source: /note="Description of Artificial Sequence: Synthetic peptide"
RLGSPCCSPR

SEQ ID NO: 16935 - protein, 10 aa, Artificial Sequence
  source: /note="Description of Artificial Sequence: Synthetic peptide"
KPRPMGSPGW

SEQ ID NO: 16936 - protein, 10 aa, Artificial Sequence
  source: /note="Description of Artificial Sequence: Synthetic peptide"
RPMGSPGWAS

SEQ ID NO: 16937 - protein, 10 aa, Artificial Sequence
  source: /note="Description of Artificial Sequence: Synthetic peptide"
SPACPRPRST

SEQ ID NO: 16938 - protein, 10 aa, Artificial Sequence
  source: /note="Description of Artificial Sequence: Synthetic peptide"
IPAWRLGSPC

SEQ ID NO: 16939 - protein, 10 aa, Artificial Sequence
  source: /note="Description of Artificial Sequence: Synthetic peptide"
MGSPGWASPA

SEQ ID NO: 16940 - protein, 9 aa, Artificial Sequence
  source: /note="Description of Artificial Sequence: Synthetic peptide"
GMASRESLL

SEQ ID NO: 16941 - protein, 9 aa, Artificial Sequence
  source: /note="Description of Artificial Sequence: Synthetic peptide"
SGMASRESL

SEQ ID NO: 16942 - protein, 10 aa, Artificial Sequence
  source: /note="Description of Artificial Sequence: Synthetic peptide"
SSKDSGMASR

SEQ ID NO: 16943 - protein, 10 aa, Artificial Sequence
  source: /note="Description of Artificial Sequence: Synthetic peptide"
LPPSSKDSGM

SEQ ID NO: 16944 - protein, 10 aa, Artificial Sequence
  source: /note="Description of Artificial Sequence: Synthetic peptide"
SGMASRESLL

SEQ ID NO: 16945 - protein, 10 aa, Artificial Sequence
  source: /note="Description of Artificial Sequence: Synthetic peptide"
SSKDSGVVSR

SEQ ID NO: 16946 - protein, 9 aa, Artificial Sequence
  source: /note="Description of Artificial Sequence: Synthetic peptide"
RTKYEWLMK

SEQ ID NO: 16947 - protein, 9 aa, Artificial Sequence
  source: /note="Description of Artificial Sequence: Synthetic peptide"
RIAEVRTKY

SEQ ID NO: 16948 - protein, 9 aa, Artificial Sequence
  source: /note="Description of Artificial Sequence: Synthetic peptide"
EVRTKYEWL

SEQ ID NO: 16949 - protein, 9 aa, Artificial Sequence
  source: /note="Description of Artificial Sequence: Synthetic peptide"
AEVRTKYEW

SEQ ID NO: 16950 - protein, 10 aa, Artificial Sequence
  source: /note="Description of Artificial Sequence: Synthetic peptide"
QQRIAEVRTK

SEQ ID NO: 16951 - protein, 10 aa, Artificial Sequence
  source: /note="Description of Artificial Sequence: Synthetic peptide"
RTKYEWLMKE

SEQ ID NO: 16952 - protein, 10 aa, Artificial Sequence
  source: /note="Description of Artificial Sequence: Synthetic peptide"
RQQRIAEVRT

SEQ ID NO: 16953 - protein, 10 aa, Artificial Sequence
  source: /note="Description of Artificial Sequence: Synthetic peptide"
QRIAEVRTKY

SEQ ID NO: 16954 - protein, 10 aa, Artificial Sequence
  source: /note="Description of Artificial Sequence: Synthetic peptide"
AEVRTKYEWL

SEQ ID NO: 16955 - protein, 10 aa, Artificial Sequence
  source: /note="Description of Artificial Sequence: Synthetic peptide"
TKYEWLMKEL

SEQ ID NO: 16956 - protein, 10 aa, Artificial Sequence
  source: /note="Description of Artificial Sequence: Synthetic peptide"
IAEVRTKYEW

SEQ ID NO: 16957 - protein, 9 aa, Artificial Sequence
  source: /note="Description of Artificial Sequence: Synthetic peptide"
KLDEQNKWL

SEQ ID NO: 16958 - protein, 10 aa, Artificial Sequence
  source: /note="Description of Artificial Sequence: Synthetic peptide"
EQNKWLDEEV

SEQ ID NO: 16959 - protein, 10 aa, Artificial Sequence
  source: /note="Description of Artificial Sequence: Synthetic peptide"
LQKLDEQNKW

SEQ ID NO: 16960 - protein, 9 aa, Artificial Sequence
  source: /note="Description of Artificial Sequence: Synthetic peptide"
NFRLGVAPF

SEQ ID NO: 16961 - protein, 9 aa, Artificial Sequence
  source: /note="Description of Artificial Sequence: Synthetic peptide"
GQNFRLGVA

SEQ ID NO: 16962 - protein, 10 aa, Artificial Sequence
  source: /note="Description of Artificial Sequence: Synthetic peptide"
RLGVAPFSTK

SEQ ID NO: 16963 - protein, 10 aa, Artificial Sequence
  source: /note="Description of Artificial Sequence: Synthetic peptide"
QNFRLGVAPF

SEQ ID NO: 16964 - protein, 10 aa, Artificial Sequence
  source: /note="Description of Artificial Sequence: Synthetic peptide"
GEPEGQNFRL

SEQ ID NO: 16965 - protein, 9 aa, Artificial Sequence
  source: /note="Description of Artificial Sequence: Synthetic peptide"
GSEINQIFK

SEQ ID NO: 16966 - protein, 10 aa, Artificial Sequence
  source: /note="Description of Artificial Sequence: Synthetic peptide"
QGSEINQIFK

SEQ ID NO: 16967 - protein, 10 aa, Artificial Sequence
  source: /note="Description of Artificial Sequence: Synthetic peptide"
EQGSEINQIF

SEQ ID NO: 16968 - protein, 10 aa, Artificial Sequence
  source: /note="Description of Artificial Sequence: Synthetic peptide"
NQIFKENKSI

SEQ ID NO: 16969 - protein, 10 aa, Artificial Sequence
  source: /note="Description of Artificial Sequence: Synthetic peptide"
NEQGSEINQI

SEQ ID NO: 16970 - protein, 9 aa, Artificial Sequence
  source: /note="Description of Artificial Sequence: Synthetic peptide"
VWVGNPPSL

SEQ ID NO: 16971 - protein, 9 aa, Artificial Sequence
  source: /note="Description of Artificial Sequence: Synthetic peptide"
SPGPKRTQI

SEQ ID NO: 16972 - protein, 10 aa, Artificial Sequence
  source: /note="Description of Artificial Sequence: Synthetic peptide"
CVWVGNPPSL

SEQ ID NO: 16973 - protein, 10 aa, Artificial Sequence
  source: /note="Description of Artificial Sequence: Synthetic peptide"
SPGPKRTQIW

SEQ ID NO: 16974 - protein, 9 aa, Artificial Sequence
  source: /note="Description of Artificial Sequence: Synthetic peptide"
EMKDPTNCY

SEQ ID NO: 16975 - protein, 9 aa, Artificial Sequence
  source: /note="Description of Artificial Sequence: Synthetic peptide"
PTNCYYNVR

SEQ ID NO: 16976 - protein, 9 aa, Artificial Sequence
  source: /note="Description of Artificial Sequence: Synthetic peptide"
MKDPTNCYY

SEQ ID NO: 16977 - protein, 9 aa, Artificial Sequence
  source: /note="Description of Artificial Sequence: Synthetic peptide"
YEMKDPTNC

SEQ ID NO: 16978 - protein, 9 aa, Artificial Sequence
  source: /note="Description of Artificial Sequence: Synthetic peptide"
DPTNCYYNV

SEQ ID NO: 16979 - protein, 10 aa, Artificial Sequence
  source: /note="Description of Artificial Sequence: Synthetic peptide"
EMKDPTNCYY

SEQ ID NO: 16980 - protein, 10 aa, Artificial Sequence
  source: /note="Description of Artificial Sequence: Synthetic peptide"
YEMKDPTNCY

SEQ ID NO: 16981 - protein, 9 aa, Artificial Sequence
  source: /note="Description of Artificial Sequence: Synthetic peptide"
HMLPSPHLA

SEQ ID NO: 16982 - protein, 9 aa, Artificial Sequence
  source: /note="Description of Artificial Sequence: Synthetic peptide"
RLTCDIFPM

SEQ ID NO: 16983 - protein, 9 aa, Artificial Sequence
  source: /note="Description of Artificial Sequence: Synthetic peptide"
HLATRVSRL

SEQ ID NO: 16984 - protein, 9 aa, Artificial Sequence
  source: /note="Description of Artificial Sequence: Synthetic peptide"
ATRVSRLTC

SEQ ID NO: 16985 - protein, 9 aa, Artificial Sequence
  source: /note="Description of Artificial Sequence: Synthetic peptide"
LPSPHLATR

SEQ ID NO: 16986 - protein, 9 aa, Artificial Sequence
  source: /note="Description of Artificial Sequence: Synthetic peptide"
ESWDLQLAI

SEQ ID NO: 16987 - protein, 9 aa, Artificial Sequence
  source: /note="Description of Artificial Sequence: Synthetic peptide"
HPTLELSPA

SEQ ID NO: 16988 - protein, 9 aa, Artificial Sequence
  source: /note="Description of Artificial Sequence: Synthetic peptide"
NPHPLGPQI

SEQ ID NO: 16989 - protein, 9 aa, Artificial Sequence
  source: /note="Description of Artificial Sequence: Synthetic peptide"
SPHLATRVS

SEQ ID NO: 16990 - protein, 9 aa, Artificial Sequence
  source: /note="Description of Artificial Sequence: Synthetic peptide"
FPMEESWDL

SEQ ID NO: 16991 - protein, 9 aa, Artificial Sequence
  source: /note="Description of Artificial Sequence: Synthetic peptide"
LAIMDCSDF

SEQ ID NO: 16992 - protein, 9 aa, Artificial Sequence
  source: /note="Description of Artificial Sequence: Synthetic peptide"
LGMVPPADF

SEQ ID NO: 16993 - protein, 9 aa, Artificial Sequence
  source: /note="Description of Artificial Sequence: Synthetic peptide"
GQAISPHPT

SEQ ID NO: 16994 - protein, 9 aa, Artificial Sequence
  source: /note="Description of Artificial Sequence: Synthetic peptide"
QAISPHPTL

SEQ ID NO: 16995 - protein, 9 aa, Artificial Sequence
  source: /note="Description of Artificial Sequence: Synthetic peptide"
SHMLPSPHL

SEQ ID NO: 16996 - protein, 9 aa, Artificial Sequence
  source: /note="Description of Artificial Sequence: Synthetic peptide"
VSRLTCDIF

SEQ ID NO: 16997 - protein, 9 aa, Artificial Sequence
  source: /note="Description of Artificial Sequence: Synthetic peptide"
MEESWDLQL

SEQ ID NO: 16998 - protein, 9 aa, Artificial Sequence
  source: /note="Description of Artificial Sequence: Synthetic peptide"
EPGQAISPH

SEQ ID NO: 16999 - protein, 9 aa, Artificial Sequence
  source: /note="Description of Artificial Sequence: Synthetic peptide"
EESWDLQLA

SEQ ID NO: 17000 - protein, 9 aa, Artificial Sequence
  source: /note="Description of Artificial Sequence: Synthetic peptide"
DIFPMEESW

SEQ ID NO: 17001 - protein, 10 aa, Artificial Sequence
  source: /note="Description of Artificial Sequence: Synthetic peptide"
AISPHPTLEL

SEQ ID NO: 17002 - protein, 10 aa, Artificial Sequence
  source: /note="Description of Artificial Sequence: Synthetic peptide"
HLATRVSRLT

SEQ ID NO: 17003 - protein, 10 aa, Artificial Sequence
  source: /note="Description of Artificial Sequence: Synthetic peptide"
IFPMEESWDL

SEQ ID NO: 17004 - protein, 10 aa, Artificial Sequence
  source: /note="Description of Artificial Sequence: Synthetic peptide"
MLPSPHLATR

SEQ ID NO: 17005 - protein, 10 aa, Artificial Sequence
  source: /note="Description of Artificial Sequence: Synthetic peptide"
ESWDLQLAIM

SEQ ID NO: 17006 - protein, 10 aa, Artificial Sequence
  source: /note="Description of Artificial Sequence: Synthetic peptide"
NPHLGMVPPA

SEQ ID NO: 17007 - protein, 10 aa, Artificial Sequence
  source: /note="Description of Artificial Sequence: Synthetic peptide"
SPATSNPHPL

SEQ ID NO: 17008 - protein, 10 aa, Artificial Sequence
  source: /note="Description of Artificial Sequence: Synthetic peptide"
WPPGLPPSHM

SEQ ID NO: 17009 - protein, 10 aa, Artificial Sequence
  source: /note="Description of Artificial Sequence: Synthetic peptide"
LPSPHLATRV

SEQ ID NO: 17010 - protein, 10 aa, Artificial Sequence
  source: /note="Description of Artificial Sequence: Synthetic peptide"
QLAIMDCSDF

SEQ ID NO: 17011 - protein, 10 aa, Artificial Sequence
  source: /note="Description of Artificial Sequence: Synthetic peptide"
HLGMVPPADF

SEQ ID NO: 17012 - protein, 10 aa, Artificial Sequence
  source: /note="Description of Artificial Sequence: Synthetic peptide"
ADFTEPGQAI

SEQ ID NO: 17013 - protein, 10 aa, Artificial Sequence
  source: /note="Description of Artificial Sequence: Synthetic peptide"
GQAISPHPTL

SEQ ID NO: 17014 - protein, 10 aa, Artificial Sequence
  source: /note="Description of Artificial Sequence: Synthetic peptide"
HMLPSPHLAT

SEQ ID NO: 17015 - protein, 10 aa, Artificial Sequence
  source: /note="Description of Artificial Sequence: Synthetic peptide"
RVSRLTCDIF

SEQ ID NO: 17016 - protein, 10 aa, Artificial Sequence
  source: /note="Description of Artificial Sequence: Synthetic peptide"
SRLTCDIFPM

SEQ ID NO: 17017 - protein, 10 aa, Artificial Sequence
  source: /note="Description of Artificial Sequence: Synthetic peptide"
EESWDLQLAI

SEQ ID NO: 17018 - protein, 10 aa, Artificial Sequence
  source: /note="Description of Artificial Sequence: Synthetic peptide"
HPTLELSPAT

SEQ ID NO: 17019 - protein, 10 aa, Artificial Sequence
  source: /note="Description of Artificial Sequence: Synthetic peptide"
NPHPLGPQIW

SEQ ID NO: 17020 - protein, 10 aa, Artificial Sequence
  source: /note="Description of Artificial Sequence: Synthetic peptide"
FPMEESWDLQ

SEQ ID NO: 17021 - protein, 10 aa, Artificial Sequence
  source: /note="Description of Artificial Sequence: Synthetic peptide"
MEESWDLQLA

SEQ ID NO: 17022 - protein, 9 aa, Artificial Sequence
  source: /note="Description of Artificial Sequence: Synthetic peptide"
PMYEVQGKV

SEQ ID NO: 17023 - protein, 9 aa, Artificial Sequence
  source: /note="Description of Artificial Sequence: Synthetic peptide"
VQGKVVEEI

SEQ ID NO: 17024 - protein, 10 aa, Artificial Sequence
  source: /note="Description of Artificial Sequence: Synthetic peptide"
EVQGKVVEEI

SEQ ID NO: 17025 - protein, 10 aa, Artificial Sequence
  source: /note="Description of Artificial Sequence: Synthetic peptide"
KPMYEVQGKV

SEQ ID NO: 17026 - protein, 9 aa, Artificial Sequence
  source: /note="Description of Artificial Sequence: Synthetic peptide"
HIKNDSNYV

SEQ ID NO: 17027 - protein, 9 aa, Artificial Sequence
  source: /note="Description of Artificial Sequence: Synthetic peptide"
RHIKNDSNY

SEQ ID NO: 17028 - protein, 9 aa, Artificial Sequence
  source: /note="Description of Artificial Sequence: Synthetic peptide"
CDFGLARHI

SEQ ID NO: 17029 - protein, 10 aa, Artificial Sequence
  source: /note="Description of Artificial Sequence: Synthetic peptide"
HIKNDSNYVV

SEQ ID NO: 17030 - protein, 10 aa, Artificial Sequence
  source: /note="Description of Artificial Sequence: Synthetic peptide"
ARHIKNDSNY

SEQ ID NO: 17031 - protein, 10 aa, Artificial Sequence
  source: /note="Description of Artificial Sequence: Synthetic peptide"
RHIKNDSNYV

SEQ ID NO: 17032 - protein, 9 aa, Artificial Sequence
  source: /note="Description of Artificial Sequence: Synthetic peptide"
ICDFGLARY

SEQ ID NO: 17033 - protein, 9 aa, Artificial Sequence
  source: /note="Description of Artificial Sequence: Synthetic peptide"
YIKNDSNYV

SEQ ID NO: 17034 - protein, 9 aa, Artificial Sequence
  source: /note="Description of Artificial Sequence: Synthetic peptide"
RYIKNDSNY

SEQ ID NO: 17035 - protein, 9 aa, Artificial Sequence
  source: /note="Description of Artificial Sequence: Synthetic peptide"
DFGLARYIK

SEQ ID NO: 17036 - protein, 9 aa, Artificial Sequence
  source: /note="Description of Artificial Sequence: Synthetic peptide"
CDFGLARYI

SEQ ID NO: 17037 - protein, 10 aa, Artificial Sequence
  source: /note="Description of Artificial Sequence: Synthetic peptide"
YIKNDSNYVV

SEQ ID NO: 17038 - protein, 10 aa, Artificial Sequence
  source: /note="Description of Artificial Sequence: Synthetic peptide"
KICDFGLARY

SEQ ID NO: 17039 - protein, 10 aa, Artificial Sequence
  source: /note="Description of Artificial Sequence: Synthetic peptide"
RYIKNDSNYV

SEQ ID NO: 17040 - protein, 10 aa, Artificial Sequence
  source: /note="Description of Artificial Sequence: Synthetic peptide"
ARYIKNDSNY

SEQ ID NO: 17041 - protein, 9 aa, Artificial Sequence
  source: /note="Description of Artificial Sequence: Synthetic peptide"
VIKNDSNYV

SEQ ID NO: 17042 - protein, 9 aa, Artificial Sequence
  source: /note="Description of Artificial Sequence: Synthetic peptide"
RVIKNDSNY

SEQ ID NO: 17043 - protein, 9 aa, Artificial Sequence
  source: /note="Description of Artificial Sequence: Synthetic peptide"
CDFGLARVI

SEQ ID NO: 17044 - protein, 10 aa, Artificial Sequence
  source: /note="Description of Artificial Sequence: Synthetic peptide"
RVIKNDSNYV

SEQ ID NO: 17045 - protein, 10 aa, Artificial Sequence
  source: /note="Description of Artificial Sequence: Synthetic peptide"
VIKNDSNYVV

SEQ ID NO: 17046 - protein, 10 aa, Artificial Sequence
  source: /note="Description of Artificial Sequence: Synthetic peptide"
ARVIKNDSNY

SEQ ID NO: 17047 - protein, 9 aa, Artificial Sequence
  source: /note="Description of Artificial Sequence: Synthetic peptide"
KNDSYYVVK

SEQ ID NO: 17048 - protein, 9 aa, Artificial Sequence
  source: /note="Description of Artificial Sequence: Synthetic peptide"
SYYVVKGNA

SEQ ID NO: 17049 - protein, 9 aa, Artificial Sequence
  source: /note="Description of Artificial Sequence: Synthetic peptide"
RDIKNDSYY

SEQ ID NO: 17050 - protein, 9 aa, Artificial Sequence
  source: /note="Description of Artificial Sequence: Synthetic peptide"
YYVVKGNAR

SEQ ID NO: 17051 - protein, 9 aa, Artificial Sequence
  source: /note="Description of Artificial Sequence: Synthetic peptide"
DIKNDSYYV

SEQ ID NO: 17052 - protein, 9 aa, Artificial Sequence
  source: /note="Description of Artificial Sequence: Synthetic peptide"
IKNDSYYVV

SEQ ID NO: 17053 - protein, 10 aa, Artificial Sequence
  source: /note="Description of Artificial Sequence: Synthetic peptide"
YYVVKGNARL

SEQ ID NO: 17054 - protein, 10 aa, Artificial Sequence
  source: /note="Description of Artificial Sequence: Synthetic peptide"
LARDIKNDSY

SEQ ID NO: 17055 - protein, 10 aa, Artificial Sequence
  source: /note="Description of Artificial Sequence: Synthetic peptide"
SYYVVKGNAR

SEQ ID NO: 17056 - protein, 10 aa, Artificial Sequence
  source: /note="Description of Artificial Sequence: Synthetic peptide"
DIKNDSYYVV

SEQ ID NO: 17057 - protein, 10 aa, Artificial Sequence
  source: /note="Description of Artificial Sequence: Synthetic peptide"
DSYYVVKGNA

SEQ ID NO: 17058 - protein, 9 aa, Artificial Sequence
  source: /note="Description of Artificial Sequence: Synthetic peptide"
KNDSKYVVK

SEQ ID NO: 17059 - protein, 9 aa, Artificial Sequence
  source: /note="Description of Artificial Sequence: Synthetic peptide"
RDIKNDSKY

SEQ ID NO: 17060 - protein, 9 aa, Artificial Sequence
  source: /note="Description of Artificial Sequence: Synthetic peptide"
IKNDSKYVV

SEQ ID NO: 17061 - protein, 10 aa, Artificial Sequence
  source: /note="Description of Artificial Sequence: Synthetic peptide"
KYVVKGNARL

SEQ ID NO: 17062 - protein, 10 aa, Artificial Sequence
  source: /note="Description of Artificial Sequence: Synthetic peptide"
LARDIKNDSK

SEQ ID NO: 17063 - protein, 9 aa, Artificial Sequence
  source: /note="Description of Artificial Sequence: Synthetic peptide"
TPRSPLTPG

SEQ ID NO: 17064 - protein, 10 aa, Artificial Sequence
  source: /note="Description of Artificial Sequence: Synthetic peptide"
LQGGTPRSPL

SEQ ID NO: 17065 - protein, 9 aa, Artificial Sequence
  source: /note="Description of Artificial Sequence: Synthetic peptide"
LLQACSPSA

SEQ ID NO: 17066 - protein, 9 aa, Artificial Sequence
  source: /note="Description of Artificial Sequence: Synthetic peptide"
QACSPSACR

SEQ ID NO: 17067 - protein, 9 aa, Artificial Sequence
  source: /note="Description of Artificial Sequence: Synthetic peptide"
PPIKNTHPL

SEQ ID NO: 17068 - protein, 9 aa, Artificial Sequence
  source: /note="Description of Artificial Sequence: Synthetic peptide"
SPSACRCPC

SEQ ID NO: 17069 - protein, 9 aa, Artificial Sequence
  source: /note="Description of Artificial Sequence: Synthetic peptide"
LQACSPSAC

SEQ ID NO: 17070 - protein, 10 aa, Artificial Sequence
  source: /note="Description of Artificial Sequence: Synthetic peptide"
SPPIKNTHPL

SEQ ID NO: 17071 - protein, 9 aa, Artificial Sequence
  source: /note="Description of Artificial Sequence: Synthetic peptide"
LMNSVSPPA

SEQ ID NO: 17072 - protein, 9 aa, Artificial Sequence
  source: /note="Description of Artificial Sequence: Synthetic peptide"
SVSPPASIV

SEQ ID NO: 17073 - protein, 9 aa, Artificial Sequence
  source: /note="Description of Artificial Sequence: Synthetic peptide"
TFTCGIPGY

SEQ ID NO: 17074 - protein, 9 aa, Artificial Sequence
  source: /note="Description of Artificial Sequence: Synthetic peptide"
NSVSPPASI

SEQ ID NO: 17075 - protein, 9 aa, Artificial Sequence
  source: /note="Description of Artificial Sequence: Synthetic peptide"
FTCGIPGYS

SEQ ID NO: 17076 - protein, 9 aa, Artificial Sequence
  source: /note="Description of Artificial Sequence: Synthetic peptide"
SPFGHRAAW

SEQ ID NO: 17077 - protein, 9 aa, Artificial Sequence
  source: /note="Description of Artificial Sequence: Synthetic peptide"
SIVARESPF

SEQ ID NO: 17078 - protein, 9 aa, Artificial Sequence
  source: /note="Description of Artificial Sequence: Synthetic peptide"
RESPFGHRA

SEQ ID NO: 17079 - protein, 9 aa, Artificial Sequence
  source: /note="Description of Artificial Sequence: Synthetic peptide"
HRAAWEETF

SEQ ID NO: 17080 - protein, 9 aa, Artificial Sequence
  source: /note="Description of Artificial Sequence: Synthetic peptide"
SKEAEDTQM

SEQ ID NO: 17081 - protein, 9 aa, Artificial Sequence
  source: /note="Description of Artificial Sequence: Synthetic peptide"
WEETFTCGI

SEQ ID NO: 17082 - protein, 10 aa, Artificial Sequence
  source: /note="Description of Artificial Sequence: Synthetic peptide"
PLMNSVSPPA

SEQ ID NO: 17083 - protein, 10 aa, Artificial Sequence
  source: /note="Description of Artificial Sequence: Synthetic peptide"
FTCGIPGYSK

SEQ ID NO: 17084 - protein, 10 aa, Artificial Sequence
  source: /note="Description of Artificial Sequence: Synthetic peptide"
VARESPFGHR

SEQ ID NO: 17085 - protein, 10 aa, Artificial Sequence
  source: /note="Description of Artificial Sequence: Synthetic peptide"
ETFTCGIPGY

SEQ ID NO: 17086 - protein, 10 aa, Artificial Sequence
  source: /note="Description of Artificial Sequence: Synthetic peptide"
NSVSPPASIV

SEQ ID NO: 17087 - protein, 10 aa, Artificial Sequence
  source: /note="Description of Artificial Sequence: Synthetic peptide"
ASIVARESPF

SEQ ID NO: 17088 - protein, 10 aa, Artificial Sequence
  source: /note="Description of Artificial Sequence: Synthetic peptide"
LMNSVSPPAS

SEQ ID NO: 17089 - protein, 10 aa, Artificial Sequence
  source: /note="Description of Artificial Sequence: Synthetic peptide"
MNSVSPPASI

SEQ ID NO: 17090 - protein, 10 aa, Artificial Sequence
  source: /note="Description of Artificial Sequence: Synthetic peptide"
RESPFGHRAA

SEQ ID NO: 17091 - protein, 10 aa, Artificial Sequence
  source: /note="Description of Artificial Sequence: Synthetic peptide"
GHRAAWEETF

SEQ ID NO: 17092 - protein, 10 aa, Artificial Sequence
  source: /note="Description of Artificial Sequence: Synthetic peptide"
YSKEAEDTQM

SEQ ID NO: 17093 - protein, 9 aa, Artificial Sequence
  source: /note="Description of Artificial Sequence: Synthetic peptide"
KTYTQSSHL

SEQ ID NO: 17094 - protein, 9 aa, Artificial Sequence
  source: /note="Description of Artificial Sequence: Synthetic peptide"
TQSSHLKAH

SEQ ID NO: 17095 - protein, 10 aa, Artificial Sequence
  source: /note="Description of Artificial Sequence: Synthetic peptide"
KTYTQSSHLK

SEQ ID NO: 17096 - protein, 10 aa, Artificial Sequence
  source: /note="Description of Artificial Sequence: Synthetic peptide"
QSSHLKAHLR

SEQ ID NO: 17097 - protein, 10 aa, Artificial Sequence
  source: /note="Description of Artificial Sequence: Synthetic peptide"
GKTYTQSSHL

SEQ ID NO: 17098 - protein, 10 aa, Artificial Sequence
  source: /note="Description of Artificial Sequence: Synthetic peptide"
TQSSHLKAHL

SEQ ID NO: 17099 - protein, 9 aa, Artificial Sequence
  source: /note="Description of Artificial Sequence: Synthetic peptide"
RSDQLTRHY

SEQ ID NO: 17100 - protein, 9 aa, Artificial Sequence
  source: /note="Description of Artificial Sequence: Synthetic peptide"
FARSDQLTR

SEQ ID NO: 17101 - protein, 9 aa, Artificial Sequence
  source: /note="Description of Artificial Sequence: Synthetic peptide"
DQLTRHYRK

SEQ ID NO: 17102 - protein, 9 aa, Artificial Sequence
  source: /note="Description of Artificial Sequence: Synthetic peptide"
WRFARSDQL

SEQ ID NO: 17103 - protein, 10 aa, Artificial Sequence
  source: /note="Description of Artificial Sequence: Synthetic peptide"
RSDQLTRHYR

SEQ ID NO: 17104 - protein, 10 aa, Artificial Sequence
  source: /note="Description of Artificial Sequence: Synthetic peptide"
ARSDQLTRHY

SEQ ID NO: 17105 - protein, 9 aa, Artificial Sequence
  source: /note="Description of Artificial Sequence: Synthetic peptide"
KYRRDSALV

SEQ ID NO: 17106 - protein, 9 aa, Artificial Sequence
  source: /note="Description of Artificial Sequence: Synthetic peptide"
SALVVDQFF

SEQ ID NO: 17107 - protein, 9 aa, Artificial Sequence
  source: /note="Description of Artificial Sequence: Synthetic peptide"
KKYRRDSAL

SEQ ID NO: 17108 - protein, 9 aa, Artificial Sequence
  source: /note="Description of Artificial Sequence: Synthetic peptide"
YRRDSALVV

SEQ ID NO: 17109 - protein, 10 aa, Artificial Sequence
  source: /note="Description of Artificial Sequence: Synthetic peptide"
KYRRDSALVV

SEQ ID NO: 17110 - protein, 10 aa, Artificial Sequence
  source: /note="Description of Artificial Sequence: Synthetic peptide"
HKKYRRDSAL

SEQ ID NO: 17111 - protein, 10 aa, Artificial Sequence
  source: /note="Description of Artificial Sequence: Synthetic peptide"
KKYRRDSALV

SEQ ID NO: 17112 - protein, 10 aa, Artificial Sequence
  source: /note="Description of Artificial Sequence: Synthetic peptide"
RDSALVVDQF

SEQ ID NO: 17113 - protein, 9 aa, Artificial Sequence
  source: /note="Description of Artificial Sequence: Synthetic peptide"
KPRLSHTAC

SEQ ID NO: 17114 - protein, 10 aa, Artificial Sequence
  source: /note="Description of Artificial Sequence: Synthetic peptide"
KPRLSHTACA

SEQ ID NO: 17115 - protein, 10 aa, Artificial Sequence
  source: /note="Description of Artificial Sequence: Synthetic peptide"
TEKPRLSHTA

SEQ ID NO: 17116 - protein, 9 aa, Artificial Sequence
  source: /note="Description of Artificial Sequence: Synthetic peptide"
HTATVRAKK

SEQ ID NO: 17117 - protein, 9 aa, Artificial Sequence
  source: /note="Description of Artificial Sequence: Synthetic peptide"
TVRAKKIFV

SEQ ID NO: 17118 - protein, 9 aa, Artificial Sequence
  source: /note="Description of Artificial Sequence: Synthetic peptide"
RAKKIFVTG

SEQ ID NO: 17119 - protein, 9 aa, Artificial Sequence
  source: /note="Description of Artificial Sequence: Synthetic peptide"
KIFVTGGSL

SEQ ID NO: 17120 - protein, 10 aa, Artificial Sequence
  source: /note="Description of Artificial Sequence: Synthetic peptide"
KIFVTGGSLR

SEQ ID NO: 17121 - protein, 10 aa, Artificial Sequence
  source: /note="Description of Artificial Sequence: Synthetic peptide"
TVRAKKIFVT

SEQ ID NO: 17122 - protein, 10 aa, Artificial Sequence
  source: /note="Description of Artificial Sequence: Synthetic peptide"
RAKKIFVTGG

SEQ ID NO: 17123 - protein, 10 aa, Artificial Sequence
  source: /note="Description of Artificial Sequence: Synthetic peptide"
HTATVRAKKI

SEQ ID NO: 17124 - protein, 10 aa, Artificial Sequence
  source: /note="Description of Artificial Sequence: Synthetic peptide"
KKIFVTGGSL

SEQ ID NO: 17125 - protein, 9 aa, Artificial Sequence
  source: /note="Description of Artificial Sequence: Synthetic peptide"
NLTEMDKYV

SEQ ID NO: 17126 - protein, 9 aa, Artificial Sequence
  source: /note="Description of Artificial Sequence: Synthetic peptide"
EMDKYVNSF

SEQ ID NO: 17127 - protein, 9 aa, Artificial Sequence
  source: /note="Description of Artificial Sequence: Synthetic peptide"
ANTYNLTEM

SEQ ID NO: 17128 - protein, 9 aa, Artificial Sequence
  source: /note="Description of Artificial Sequence: Synthetic peptide"
TEMDKYVNS

SEQ ID NO: 17129 - protein, 10 aa, Artificial Sequence
  source: /note="Description of Artificial Sequence: Synthetic peptide"
EMDKYVNSFV

SEQ ID NO: 17130 - protein, 10 aa, Artificial Sequence
  source: /note="Description of Artificial Sequence: Synthetic peptide"
NTYNLTEMDK

SEQ ID NO: 17131 - protein, 10 aa, Artificial Sequence
  source: /note="Description of Artificial Sequence: Synthetic peptide"
TEMDKYVNSF

SEQ ID NO: 17132 - protein, 10 aa, Artificial Sequence
  source: /note="Description of Artificial Sequence: Synthetic peptide"
IANTYNLTEM

SEQ ID NO: 17133 - protein, 10 aa, Artificial Sequence
  source: /note="Description of Artificial Sequence: Synthetic peptide"
MDKYVNSFVL

SEQ ID NO: 17134 - protein, 9 aa, Artificial Sequence
  source: /note="Description of Artificial Sequence: Synthetic peptide"
WSRSWRSSR

SEQ ID NO: 17135 - protein, 9 aa, Artificial Sequence
  source: /note="Description of Artificial Sequence: Synthetic peptide"
SWRSSRCPC

SEQ ID NO: 17136 - protein, 9 aa, Artificial Sequence
  source: /note="Description of Artificial Sequence: Synthetic peptide"
TARPACSMR

SEQ ID NO: 17137 - protein, 9 aa, Artificial Sequence
  source: /note="Description of Artificial Sequence: Synthetic peptide"
DSLPPPWSR

SEQ ID NO: 17138 - protein, 9 aa, Artificial Sequence
  source: /note="Description of Artificial Sequence: Synthetic peptide"
TTARPACSM

SEQ ID NO: 17139 - protein, 9 aa, Artificial Sequence
  source: /note="Description of Artificial Sequence: Synthetic peptide"
RPACSMRLT

SEQ ID NO: 17140 - protein, 9 aa, Artificial Sequence
  source: /note="Description of Artificial Sequence: Synthetic peptide"
LLDSLPPPW

SEQ ID NO: 17141 - protein, 9 aa, Artificial Sequence
  source: /note="Description of Artificial Sequence: Synthetic peptide"
LPPPWSRSW

SEQ ID NO: 17142 - protein, 10 aa, Artificial Sequence
  source: /note="Description of Artificial Sequence: Synthetic peptide"
TTARPACSMR

SEQ ID NO: 17143 - protein, 10 aa, Artificial Sequence
  source: /note="Description of Artificial Sequence: Synthetic peptide"
RSWRSSRCPC

SEQ ID NO: 17144 - protein, 10 aa, Artificial Sequence
  source: /note="Description of Artificial Sequence: Synthetic peptide"
SWRSSRCPCC

SEQ ID NO: 17145 - protein, 10 aa, Artificial Sequence
  source: /note="Description of Artificial Sequence: Synthetic peptide"
SSRCPCCGWS

SEQ ID NO: 17146 - protein, 10 aa, Artificial Sequence
  source: /note="Description of Artificial Sequence: Synthetic peptide"
STTARPACSM

SEQ ID NO: 17147 - protein, 10 aa, Artificial Sequence
  source: /note="Description of Artificial Sequence: Synthetic peptide"
TARPACSMRL

SEQ ID NO: 17148 - protein, 10 aa, Artificial Sequence
  source: /note="Description of Artificial Sequence: Synthetic peptide"
RPACSMRLTS

SEQ ID NO: 17149 - protein, 10 aa, Artificial Sequence
  source: /note="Description of Artificial Sequence: Synthetic peptide"
ALLDSLPPPW

SEQ ID NO: 17150 - protein, 10 aa, Artificial Sequence
  source: /note="Description of Artificial Sequence: Synthetic peptide"
SLPPPWSRSW

SEQ ID NO: 17151 - protein, 10 aa, Artificial Sequence
  source: /note="Description of Artificial Sequence: Synthetic peptide"
RSSRCPCCGW

SEQ ID NO: 17152 - protein, 9 aa, Artificial Sequence
  source: /note="Description of Artificial Sequence: Synthetic peptide"
MSYLGNDHL

SEQ ID NO: 17153 - protein, 9 aa, Artificial Sequence
  source: /note="Description of Artificial Sequence: Synthetic peptide"
LMSYLGNDH

SEQ ID NO: 17154 - protein, 9 aa, Artificial Sequence
  source: /note="Description of Artificial Sequence: Synthetic peptide"
LGNDHLSRF

SEQ ID NO: 17155 - protein, 9 aa, Artificial Sequence
  source: /note="Description of Artificial Sequence: Synthetic peptide"
FEKLMSYLG

SEQ ID NO: 17156 - protein, 10 aa, Artificial Sequence
  source: /note="Description of Artificial Sequence: Synthetic peptide"
LMSYLGNDHL

SEQ ID NO: 17157 - protein, 10 aa, Artificial Sequence
  source: /note="Description of Artificial Sequence: Synthetic peptide"
YLGNDHLSRF

SEQ ID NO: 17158 - protein, 10 aa, Artificial Sequence
  source: /note="Description of Artificial Sequence: Synthetic peptide"
SYLGNDHLSR

SEQ ID NO: 17159 - protein, 9 aa, Artificial Sequence
  source: /note="Description of Artificial Sequence: Synthetic peptide"
KLCDIILRV

SEQ ID NO: 17160 - protein, 9 aa, Artificial Sequence
  source: /note="Description of Artificial Sequence: Synthetic peptide"
LNLLRQHHK

SEQ ID NO: 17161 - protein, 9 aa, Artificial Sequence
  source: /note="Description of Artificial Sequence: Synthetic peptide"
NLLRQHHKL

SEQ ID NO: 17162 - protein, 9 aa, Artificial Sequence
  source: /note="Description of Artificial Sequence: Synthetic peptide"
RQHHKLCDI

SEQ ID NO: 17163 - protein, 10 aa, Artificial Sequence
  source: /note="Description of Artificial Sequence: Synthetic peptide"
GLNLLRQHHK

SEQ ID NO: 17164 - protein, 10 aa, Artificial Sequence
  source: /note="Description of Artificial Sequence: Synthetic peptide"
RQHHKLCDII

SEQ ID NO: 17165 - protein, 9 aa, Artificial Sequence
  source: /note="Description of Artificial Sequence: Synthetic peptide"
SNCLGICSF

SEQ ID NO: 17166 - protein, 9 aa, Artificial Sequence
  source: /note="Description of Artificial Sequence: Synthetic peptide"
VLVHTQWVL

SEQ ID NO: 17167 - protein, 9 aa, Artificial Sequence
  source: /note="Description of Artificial Sequence: Synthetic peptide"
GVLVHTQWV

SEQ ID NO: 17168 - protein, 9 aa, Artificial Sequence
  source: /note="Description of Artificial Sequence: Synthetic peptide"
HTQWVLTAA

SEQ ID NO: 17169 - protein, 9 aa, Artificial Sequence
  source: /note="Description of Artificial Sequence: Synthetic peptide"
TQWVLTAAH

SEQ ID NO: 17170 - protein, 10 aa, Artificial Sequence
  source: /note="Description of Artificial Sequence: Synthetic peptide"
VHTQWVLTAA

SEQ ID NO: 17171 - protein, 9 aa, Artificial Sequence
  source: /note="Description of Artificial Sequence: Synthetic peptide"
YASGWGSIK

SEQ ID NO: 17172 - protein, 9 aa, Artificial Sequence
  source: /note="Description of Artificial Sequence: Synthetic peptide"
SIKPEEFLR

SEQ ID NO: 17173 - protein, 10 aa, Artificial Sequence
  source: /note="Description of Artificial Sequence: Synthetic peptide"
GSIKPEEFLR

SEQ ID NO: 17174 - protein, 10 aa, Artificial Sequence
  source: /note="Description of Artificial Sequence: Synthetic peptide"
GWGSIKPEEF

SEQ ID NO: 17175 - protein, 9 aa, Artificial Sequence
  source: /note="Description of Artificial Sequence: Synthetic peptide"
MLLHLARPA

SEQ ID NO: 17176 - protein, 9 aa, Artificial Sequence
  source: /note="Description of Artificial Sequence: Synthetic peptide"
LLHLARPAK

SEQ ID NO: 17177 - protein, 9 aa, Artificial Sequence
  source: /note="Description of Artificial Sequence: Synthetic peptide"
DIMLLHLAR

SEQ ID NO: 17178 - protein, 10 aa, Artificial Sequence
  source: /note="Description of Artificial Sequence: Synthetic peptide"
IMLLHLARPA

SEQ ID NO: 17179 - protein, 10 aa, Artificial Sequence
  source: /note="Description of Artificial Sequence: Synthetic peptide"
LLHLARPAKL

SEQ ID NO: 17180 - protein, 10 aa, Artificial Sequence
  source: /note="Description of Artificial Sequence: Synthetic peptide"
MLLHLARPAK

SEQ ID NO: 17181 - protein, 10 aa, Artificial Sequence
  source: /note="Description of Artificial Sequence: Synthetic peptide"
HDQDIMLLHL

SEQ ID NO: 17182 - protein, 9 aa, Artificial Sequence
  source: /note="Description of Artificial Sequence: Synthetic peptide"
QQNEVVVEL

SEQ ID NO: 17183 - protein, 9 aa, Artificial Sequence
  source: /note="Description of Artificial Sequence: Synthetic peptide"
TMRRQQNEV

SEQ ID NO: 17184 - protein, 9 aa, Artificial Sequence
  source: /note="Description of Artificial Sequence: Synthetic peptide"
RRQQNEVVV

SEQ ID NO: 17185 - protein, 9 aa, Artificial Sequence
  source: /note="Description of Artificial Sequence: Synthetic peptide"
RQQNEVVVE

SEQ ID NO: 17186 - protein, 10 aa, Artificial Sequence
  source: /note="Description of Artificial Sequence: Synthetic peptide"
TMRRQQNEVV

SEQ ID NO: 17187 - protein, 10 aa, Artificial Sequence
  source: /note="Description of Artificial Sequence: Synthetic peptide"
ETMRRQQNEV

SEQ ID NO: 17188 - protein, 10 aa, Artificial Sequence
  source: /note="Description of Artificial Sequence: Synthetic peptide"
MRRQQNEVVV

SEQ ID NO: 17189 - protein, 10 aa, Artificial Sequence
  source: /note="Description of Artificial Sequence: Synthetic peptide"
RQQNEVVVEL

SEQ ID NO: 17190 - protein, 9 aa, Artificial Sequence
  source: /note="Description of Artificial Sequence: Synthetic peptide"
GSKECLFLK

SEQ ID NO: 17191 - protein, 9 aa, Artificial Sequence
  source: /note="Description of Artificial Sequence: Synthetic peptide"
WPWRPRQCL

SEQ ID NO: 17192 - protein, 9 aa, Artificial Sequence
  source: /note="Description of Artificial Sequence: Synthetic peptide"
RPRQCLCWS

SEQ ID NO: 17193 - protein, 9 aa, Artificial Sequence
  source: /note="Description of Artificial Sequence: Synthetic peptide"
SERGSKECL

SEQ ID NO: 17194 - protein, 9 aa, Artificial Sequence
  source: /note="Description of Artificial Sequence: Synthetic peptide"
FPEPEGSGW

SEQ ID NO: 17195 - protein, 9 aa, Artificial Sequence
  source: /note="Description of Artificial Sequence: Synthetic peptide"
EPEGSGWPW

SEQ ID NO: 17196 - protein, 10 aa, Artificial Sequence
  source: /note="Description of Artificial Sequence: Synthetic peptide"
CLCWSERGSK

SEQ ID NO: 17197 - protein, 10 aa, Artificial Sequence
  source: /note="Description of Artificial Sequence: Synthetic peptide"
RGSKECLFLK

SEQ ID NO: 17198 - protein, 10 aa, Artificial Sequence
  source: /note="Description of Artificial Sequence: Synthetic peptide"
EGSGWPWRPR

SEQ ID NO: 17199 - protein, 10 aa, Artificial Sequence
  source: /note="Description of Artificial Sequence: Synthetic peptide"
SERGSKECLF

SEQ ID NO: 17200 - protein, 9 aa, Artificial Sequence
  source: /note="Description of Artificial Sequence: Synthetic peptide"
LDTGGQEEY

SEQ ID NO: 17201 - protein, 9 aa, Artificial Sequence
  source: /note="Description of Artificial Sequence: Synthetic peptide"
GGQEEYSAM

SEQ ID NO: 17202 - protein, 10 aa, Artificial Sequence
  source: /note="Description of Artificial Sequence: Synthetic peptide"
ILDTGGQEEY

SEQ ID NO: 17203 - protein, 9 aa, Artificial Sequence
  source: /note="Description of Artificial Sequence: Synthetic peptide"
LDTAGKEEY

SEQ ID NO: 17204 - protein, 9 aa, Artificial Sequence
  source: /note="Description of Artificial Sequence: Synthetic peptide"
AGKEEYSAM

SEQ ID NO: 17205 - protein, 10 aa, Artificial Sequence
  source: /note="Description of Artificial Sequence: Synthetic peptide"
ILDTAGKEEY

SEQ ID NO: 17206 - protein, 10 aa, Artificial Sequence
  source: /note="Description of Artificial Sequence: Synthetic peptide"
DTAGKEEYSA

SEQ ID NO: 17207 - protein, 9 aa, Artificial Sequence
  source: /note="Description of Artificial Sequence: Synthetic peptide"
LDTAGREEY

SEQ ID NO: 17208 - protein, 9 aa, Artificial Sequence
  source: /note="Description of Artificial Sequence: Synthetic peptide"
AGREEYSAM

SEQ ID NO: 17209 - protein, 10 aa, Artificial Sequence
  source: /note="Description of Artificial Sequence: Synthetic peptide"
ILDTAGREEY

SEQ ID NO: 17210 - protein, 10 aa, Artificial Sequence
  source: /note="Description of Artificial Sequence: Synthetic peptide"
AGREEYSAMR

SEQ ID NO: 17211 - protein, 10 aa, Artificial Sequence
  source: /note="Description of Artificial Sequence: Synthetic peptide"
DTAGREEYSA

SEQ ID NO: 17212 - protein, 9 aa, Artificial Sequence
  source: /note="Description of Artificial Sequence: Synthetic peptide"
LDTAGLEEY

SEQ ID NO: 17213 - protein, 9 aa, Artificial Sequence
  source: /note="Description of Artificial Sequence: Synthetic peptide"
AGLEEYSAM

SEQ ID NO: 17214 - protein, 10 aa, Artificial Sequence
  source: /note="Description of Artificial Sequence: Synthetic peptide"
ILDTAGLEEY

SEQ ID NO: 17215 - protein, 10 aa, Artificial Sequence
  source: /note="Description of Artificial Sequence: Synthetic peptide"
LLDILDTAGL

SEQ ID NO: 17216 - protein, 10 aa, Artificial Sequence
  source: /note="Description of Artificial Sequence: Synthetic peptide"
DTAGLEEYSA

SEQ ID NO: 17217 - protein, 9 aa, Artificial Sequence
  source: /note="Description of Artificial Sequence: Synthetic peptide"
LDTAGHEEY

SEQ ID NO: 17218 - protein, 9 aa, Artificial Sequence
  source: /note="Description of Artificial Sequence: Synthetic peptide"
AGHEEYSAM

SEQ ID NO: 17219 - protein, 10 aa, Artificial Sequence
  source: /note="Description of Artificial Sequence: Synthetic peptide"
ILDTAGHEEY

SEQ ID NO: 17220 - protein, 10 aa, Artificial Sequence
  source: /note="Description of Artificial Sequence: Synthetic peptide"
DTAGHEEYSA

SEQ ID NO: 17221 - protein, 9 aa, Artificial Sequence
  source: /note="Description of Artificial Sequence: Synthetic peptide"
LDTAGHEEY

SEQ ID NO: 17222 - protein, 9 aa, Artificial Sequence
  source: /note="Description of Artificial Sequence: Synthetic peptide"
AGHEEYSAM

SEQ ID NO: 17223 - protein, 10 aa, Artificial Sequence
  source: /note="Description of Artificial Sequence: Synthetic peptide"
ILDTAGHEEY

SEQ ID NO: 17224 - protein, 10 aa, Artificial Sequence
  source: /note="Description of Artificial Sequence: Synthetic peptide"
DTAGHEEYSA

SEQ ID NO: 17225 - protein, 9 aa, Artificial Sequence
  source: /note="Description of Artificial Sequence: Synthetic peptide"
LVVVGASGV

SEQ ID NO: 17226 - protein, 10 aa, Artificial Sequence
  source: /note="Description of Artificial Sequence: Synthetic peptide"
KLVVVGASGV

SEQ ID NO: 17227 - protein, 10 aa, Artificial Sequence
  source: /note="Description of Artificial Sequence: Synthetic peptide"
YKLVVVGASG

SEQ ID NO: 17228 - protein, 9 aa, Artificial Sequence
  source: /note="Description of Artificial Sequence: Synthetic peptide"
ARGVGKSAL

SEQ ID NO: 17229 - protein, 10 aa, Artificial Sequence
  source: /note="Description of Artificial Sequence: Synthetic peptide"
KLVVVGARGV

SEQ ID NO: 17230 - protein, 10 aa, Artificial Sequence
  source: /note="Description of Artificial Sequence: Synthetic peptide"
VVVGARGVGK

SEQ ID NO: 17231 - protein, 10 aa, Artificial Sequence
  source: /note="Description of Artificial Sequence: Synthetic peptide"
EYKLVVVGAR

SEQ ID NO: 17232 - protein, 10 aa, Artificial Sequence
  source: /note="Description of Artificial Sequence: Synthetic peptide"
GARGVGKSAL

SEQ ID NO: 17233 - protein, 10 aa, Artificial Sequence
  source: /note="Description of Artificial Sequence: Synthetic peptide"
RGVGKSALTI

SEQ ID NO: 17234 - protein, 9 aa, Artificial Sequence
  source: /note="Description of Artificial Sequence: Synthetic peptide"
LVVVGACGV

SEQ ID NO: 17235 - protein, 9 aa, Artificial Sequence
  source: /note="Description of Artificial Sequence: Synthetic peptide"
VVGACGVGK

SEQ ID NO: 17236 - protein, 10 aa, Artificial Sequence
  source: /note="Description of Artificial Sequence: Synthetic peptide"
KLVVVGACGV

SEQ ID NO: 17237 - protein, 10 aa, Artificial Sequence
  source: /note="Description of Artificial Sequence: Synthetic peptide"
VVVGACGVGK

SEQ ID NO: 17238 - protein, 9 aa, Artificial Sequence
  source: /note="Description of Artificial Sequence: Synthetic peptide"
LVVVGADGV

SEQ ID NO: 17239 - protein, 9 aa, Artificial Sequence
  source: /note="Description of Artificial Sequence: Synthetic peptide"
VVGADGVGK

SEQ ID NO: 17240 - protein, 10 aa, Artificial Sequence
  source: /note="Description of Artificial Sequence: Synthetic peptide"
KLVVVGADGV

SEQ ID NO: 17241 - protein, 10 aa, Artificial Sequence
  source: /note="Description of Artificial Sequence: Synthetic peptide"
VVVGADGVGK

SEQ ID NO: 17242 - protein, 9 aa, Artificial Sequence
  source: /note="Description of Artificial Sequence: Synthetic peptide"
LVVVGAAGV

SEQ ID NO: 17243 - protein, 9 aa, Artificial Sequence
  source: /note="Description of Artificial Sequence: Synthetic peptide"
VVGAAGVGK

SEQ ID NO: 17244 - protein, 9 aa, Artificial Sequence
  source: /note="Description of Artificial Sequence: Synthetic peptide"
YKLVVVGAA

SEQ ID NO: 17245 - protein, 10 aa, Artificial Sequence
  source: /note="Description of Artificial Sequence: Synthetic peptide"
KLVVVGAAGV

SEQ ID NO: 17246 - protein, 10 aa, Artificial Sequence
  source: /note="Description of Artificial Sequence: Synthetic peptide"
VVVGAAGVGK

SEQ ID NO: 17247 - protein, 10 aa, Artificial Sequence
  source: /note="Description of Artificial Sequence: Synthetic peptide"
YKLVVVGAAG

SEQ ID NO: 17248 - protein, 10 aa, Artificial Sequence
  source: /note="Description of Artificial Sequence: Synthetic peptide"
GAAGVGKSAL

SEQ ID NO: 17249 - protein, 9 aa, Artificial Sequence
  source: /note="Description of Artificial Sequence: Synthetic peptide"
LVVVGAVGV

SEQ ID NO: 17250 - protein, 9 aa, Artificial Sequence
  source: /note="Description of Artificial Sequence: Synthetic peptide"
VVGAVGVGK

SEQ ID NO: 17251 - protein, 9 aa, Artificial Sequence
  source: /note="Description of Artificial Sequence: Synthetic peptide"
YKLVVVGAV

SEQ ID NO: 17252 - protein, 10 aa, Artificial Sequence
  source: /note="Description of Artificial Sequence: Synthetic peptide"
KLVVVGAVGV

SEQ ID NO: 17253 - protein, 10 aa, Artificial Sequence
  source: /note="Description of Artificial Sequence: Synthetic peptide"
VVVGAVGVGK

SEQ ID NO: 17254 - protein, 10 aa, Artificial Sequence
  source: /note="Description of Artificial Sequence: Synthetic peptide"
GAVGVGKSAL

SEQ ID NO: 17255 - protein, 9 aa, Artificial Sequence
  source: /note="Description of Artificial Sequence: Synthetic peptide"
VVGAGCVGK

SEQ ID NO: 17256 - protein, 10 aa, Artificial Sequence
  source: /note="Description of Artificial Sequence: Synthetic peptide"
KLVVVGAGCV

SEQ ID NO: 17257 - protein, 10 aa, Artificial Sequence
  source: /note="Description of Artificial Sequence: Synthetic peptide"
VVVGAGCVGK

SEQ ID NO: 17258 - protein, 9 aa, Artificial Sequence
  source: /note="Description of Artificial Sequence: Synthetic peptide"
VVGAGDVGK

SEQ ID NO: 17259 - protein, 10 aa, Artificial Sequence
  source: /note="Description of Artificial Sequence: Synthetic peptide"
KLVVVGAGDV

SEQ ID NO: 17260 - protein, 10 aa, Artificial Sequence
  source: /note="Description of Artificial Sequence: Synthetic peptide"
VVVGAGDVGK

SEQ ID NO: 17261 - protein, 9 aa, Artificial Sequence
  source: /note="Description of Artificial Sequence: Synthetic peptide"
ETSTKTRQR

SEQ ID NO: 17262 - protein, 10 aa, Artificial Sequence
  source: /note="Description of Artificial Sequence: Synthetic peptide"
GIPFIETSTK

SEQ ID NO: 17263 - protein, 10 aa, Artificial Sequence
  source: /note="Description of Artificial Sequence: Synthetic peptide"
ETSTKTRQRV

SEQ ID NO: 17264 - protein, 9 aa, Artificial Sequence
  source: /note="Description of Artificial Sequence: Synthetic peptide"
RTQVNRLGG

SEQ ID NO: 17265 - protein, 9 aa, Artificial Sequence
  source: /note="Description of Artificial Sequence: Synthetic peptide"
TQVNRLGGR

SEQ ID NO: 17266 - protein, 10 aa, Artificial Sequence
  source: /note="Description of Artificial Sequence: Synthetic peptide"
RTQVNRLGGR

SEQ ID NO: 17267 - protein, 9 aa, Artificial Sequence
  source: /note="Description of Artificial Sequence: Synthetic peptide"
YMIKVEWQS

SEQ ID NO: 17268 - protein, 9 aa, Artificial Sequence
  source: /note="Description of Artificial Sequence: Synthetic peptide"
MIKVEWQSK

SEQ ID NO: 17269 - protein, 9 aa, Artificial Sequence
  source: /note="Description of Artificial Sequence: Synthetic peptide"
IKVEWQSKV

SEQ ID NO: 17270 - protein, 9 aa, Artificial Sequence
  source: /note="Description of Artificial Sequence: Synthetic peptide"
VEWQSKVDL

SEQ ID NO: 17271 - protein, 9 aa, Artificial Sequence
  source: /note="Description of Artificial Sequence: Synthetic peptide"
NAYMIKVEW

SEQ ID NO: 17272 - protein, 10 aa, Artificial Sequence
  source: /note="Description of Artificial Sequence: Synthetic peptide"
MIKVEWQSKV

SEQ ID NO: 17273 - protein, 10 aa, Artificial Sequence
  source: /note="Description of Artificial Sequence: Synthetic peptide"
YMIKVEWQSK

SEQ ID NO: 17274 - protein, 10 aa, Artificial Sequence
  source: /note="Description of Artificial Sequence: Synthetic peptide"
VEWQSKVDLL

SEQ ID NO: 17275 - protein, 9 aa, Artificial Sequence
  source: /note="Description of Artificial Sequence: Synthetic peptide"
WLWWWIWGL

SEQ ID NO: 17276 - protein, 9 aa, Artificial Sequence
  source: /note="Description of Artificial Sequence: Synthetic peptide"
GGFRHWWLW

SEQ ID NO: 17277 - protein, 9 aa, Artificial Sequence
  source: /note="Description of Artificial Sequence: Synthetic peptide"
GFRHWWLWW

SEQ ID NO: 17278 - protein, 9 aa, Artificial Sequence
  source: /note="Description of Artificial Sequence: Synthetic peptide"
FRHWWLWWW

SEQ ID NO: 17279 - protein, 9 aa, Artificial Sequence
  source: /note="Description of Artificial Sequence: Synthetic peptide"
RHWWLWWWI

SEQ ID NO: 17280 - protein, 9 aa, Artificial Sequence
  source: /note="Description of Artificial Sequence: Synthetic peptide"
HWWLWWWIW

SEQ ID NO: 17281 - protein, 9 aa, Artificial Sequence
  source: /note="Description of Artificial Sequence: Synthetic peptide"
LWWWIWGLL

SEQ ID NO: 17282 - protein, 9 aa, Artificial Sequence
  source: /note="Description of Artificial Sequence: Synthetic peptide"
WWIWGLLQW

SEQ ID NO: 17283 - protein, 9 aa, Artificial Sequence
  source: /note="Description of Artificial Sequence: Synthetic peptide"
CFGGAGGFR

SEQ ID NO: 17284 - protein, 9 aa, Artificial Sequence
  source: /note="Description of Artificial Sequence: Synthetic peptide"
GGAGGFRHW

SEQ ID NO: 17285 - protein, 10 aa, Artificial Sequence
  source: /note="Description of Artificial Sequence: Synthetic peptide"
WLWWWIWGLL

SEQ ID NO: 17286 - protein, 10 aa, Artificial Sequence
  source: /note="Description of Artificial Sequence: Synthetic peptide"
AGGFRHWWLW

SEQ ID NO: 17287 - protein, 10 aa, Artificial Sequence
  source: /note="Description of Artificial Sequence: Synthetic peptide"
GFRHWWLWWW

SEQ ID NO: 17288 - protein, 10 aa, Artificial Sequence
  source: /note="Description of Artificial Sequence: Synthetic peptide"
RHWWLWWWIW

SEQ ID NO: 17289 - protein, 10 aa, Artificial Sequence
  source: /note="Description of Artificial Sequence: Synthetic peptide"
WWLWWWIWGL

SEQ ID NO: 17290 - protein, 10 aa, Artificial Sequence
  source: /note="Description of Artificial Sequence: Synthetic peptide"
WWWIWGLLQW

SEQ ID NO: 17291 - protein, 10 aa, Artificial Sequence
  source: /note="Description of Artificial Sequence: Synthetic peptide"
FGGAGGFRHW

SEQ ID NO: 17292 - protein, 9 aa, Artificial Sequence
  source: /note="Description of Artificial Sequence: Synthetic peptide"
VLDTKWTPL

SEQ ID NO: 17293 - protein, 10 aa, Artificial Sequence
  source: /note="Description of Artificial Sequence: Synthetic peptide"
KVLDTKWTPL

SEQ ID NO: 17294 - protein, 9 aa, Artificial Sequence
  source: /note="Description of Artificial Sequence: Synthetic peptide"
RSYTSGPGA

SEQ ID NO: 17295 - protein, 9 aa, Artificial Sequence
  source: /note="Description of Artificial Sequence: Synthetic peptide"
GARISSSSF

SEQ ID NO: 17296 - protein, 9 aa, Artificial Sequence
  source: /note="Description of Artificial Sequence: Synthetic peptide"
SYTSGPGAR

SEQ ID NO: 17297 - protein, 9 aa, Artificial Sequence
  source: /note="Description of Artificial Sequence: Synthetic peptide"
YTSGPGARI

SEQ ID NO: 17298 - protein, 10 aa, Artificial Sequence
  source: /note="Description of Artificial Sequence: Synthetic peptide"
RSYTSGPGAR

SEQ ID NO: 17299 - protein, 10 aa, Artificial Sequence
  source: /note="Description of Artificial Sequence: Synthetic peptide"
SYTSGPGARI

SEQ ID NO: 17300 - protein, 10 aa, Artificial Sequence
  source: /note="Description of Artificial Sequence: Synthetic peptide"
GARISSSSFS

SEQ ID NO: 17301 - protein, 9 aa, Artificial Sequence
  source: /note="Description of Artificial Sequence: Synthetic peptide"
VSTRVRWCR

SEQ ID NO: 17302 - protein, 9 aa, Artificial Sequence
  source: /note="Description of Artificial Sequence: Synthetic peptide"
STRVRWCRP

SEQ ID NO: 17303 - protein, 9 aa, Artificial Sequence
  source: /note="Description of Artificial Sequence: Synthetic peptide"
RVRWCRPDC

SEQ ID NO: 17304 - protein, 9 aa, Artificial Sequence
  source: /note="Description of Artificial Sequence: Synthetic peptide"
GAVSTRVRW

SEQ ID NO: 17305 - protein, 10 aa, Artificial Sequence
  source: /note="Description of Artificial Sequence: Synthetic peptide"
AVSTRVRWCR

SEQ ID NO: 17306 - protein, 10 aa, Artificial Sequence
  source: /note="Description of Artificial Sequence: Synthetic peptide"
STRVRWCRPD

SEQ ID NO: 17307 - protein, 10 aa, Artificial Sequence
  source: /note="Description of Artificial Sequence: Synthetic peptide"
RVRWCRPDCR

SEQ ID NO: 17308 - protein, 10 aa, Artificial Sequence
  source: /note="Description of Artificial Sequence: Synthetic peptide"
SGAVSTRVRW

SEQ ID NO: 17309 - protein, 9 aa, Artificial Sequence
  source: /note="Description of Artificial Sequence: Synthetic peptide"
CQSESTQQI

SEQ ID NO: 17310 - protein, 9 aa, Artificial Sequence
  source: /note="Description of Artificial Sequence: Synthetic peptide"
ESTQQIGFV

SEQ ID NO: 17311 - protein, 9 aa, Artificial Sequence
  source: /note="Description of Artificial Sequence: Synthetic peptide"
SESTQQIGF

SEQ ID NO: 17312 - protein, 10 aa, Artificial Sequence
  source: /note="Description of Artificial Sequence: Synthetic peptide"
QSESTQQIGF

SEQ ID NO: 17313 - protein, 10 aa, Artificial Sequence
  source: /note="Description of Artificial Sequence: Synthetic peptide"
QQIGFVAQSC

SEQ ID NO: 17314 - protein, 10 aa, Artificial Sequence
  source: /note="Description of Artificial Sequence: Synthetic peptide"
SESTQQIGFV

SEQ ID NO: 17315 - protein, 9 aa, Artificial Sequence
  source: /note="Description of Artificial Sequence: Synthetic peptide"
VSRCCRPQC

SEQ ID NO: 17316 - protein, 9 aa, Artificial Sequence
  source: /note="Description of Artificial Sequence: Synthetic peptide"
CESCCCRPC

SEQ ID NO: 17317 - protein, 9 aa, Artificial Sequence
  source: /note="Description of Artificial Sequence: Synthetic peptide"
TCCRTTCFR

SEQ ID NO: 17318 - protein, 10 aa, Artificial Sequence
  source: /note="Description of Artificial Sequence: Synthetic peptide"
TTCCRTTCFR

SEQ ID NO: 17319 - protein, 10 aa, Artificial Sequence
  source: /note="Description of Artificial Sequence: Synthetic peptide"
SVCCQPSCCR

SEQ ID NO: 17320 - protein, 9 aa, Artificial Sequence
  source: /note="Description of Artificial Sequence: Synthetic peptide"
CSDQGCGQV

SEQ ID NO: 17321 - protein, 9 aa, Artificial Sequence
  source: /note="Description of Artificial Sequence: Synthetic peptide"
SDQGCGQVL

SEQ ID NO: 17322 - protein, 10 aa, Artificial Sequence
  source: /note="Description of Artificial Sequence: Synthetic peptide"
QVLCQETCCR

SEQ ID NO: 17323 - protein, 9 aa, Artificial Sequence
  source: /note="Description of Artificial Sequence: Synthetic peptide"
GGCGSCGGY

SEQ ID NO: 17324 - protein, 10 aa, Artificial Sequence
  source: /note="Description of Artificial Sequence: Synthetic peptide"
KGGCGSCGGY

SEQ ID NO: 17325 - protein, 9 aa, Artificial Sequence
  source: /note="Description of Artificial Sequence: Synthetic peptide"
MPTRAPQVI

SEQ ID NO: 17326 - protein, 10 aa, Artificial Sequence
  source: /note="Description of Artificial Sequence: Synthetic peptide"
FPDVVPVPEM

SEQ ID NO: 17327 - protein, 10 aa, Artificial Sequence
  source: /note="Description of Artificial Sequence: Synthetic peptide"
MPTRAPQVIL

SEQ ID NO: 17328 - protein, 10 aa, Artificial Sequence
  source: /note="Description of Artificial Sequence: Synthetic peptide"
PEMPTRAPQV

SEQ ID NO: 17329 - protein, 9 aa, Artificial Sequence
  source: /note="Description of Artificial Sequence: Synthetic peptide"
LLTQSQVSV

SEQ ID NO: 17330 - protein, 9 aa, Artificial Sequence
  source: /note="Description of Artificial Sequence: Synthetic peptide"
QVSVSWSPA

SEQ ID NO: 17331 - protein, 9 aa, Artificial Sequence
  source: /note="Description of Artificial Sequence: Synthetic peptide"
TQSQVSVSW

SEQ ID NO: 17332 - protein, 9 aa, Artificial Sequence
  source: /note="Description of Artificial Sequence: Synthetic peptide"
SQVSVSWSP

SEQ ID NO: 17333 - protein, 10 aa, Artificial Sequence
  source: /note="Description of Artificial Sequence: Synthetic peptide"
HLLTQSQVSV

SEQ ID NO: 17334 - protein, 10 aa, Artificial Sequence
  source: /note="Description of Artificial Sequence: Synthetic peptide"
SQVSVSWSPA

SEQ ID NO: 17335 - protein, 10 aa, Artificial Sequence
  source: /note="Description of Artificial Sequence: Synthetic peptide"
LTQSQVSVSW

SEQ ID NO: 17336 - protein, 9 aa, Artificial Sequence
  source: /note="Description of Artificial Sequence: Synthetic peptide"
MMGQNGNLY

SEQ ID NO: 17337 - protein, 9 aa, Artificial Sequence
  source: /note="Description of Artificial Sequence: Synthetic peptide"
VMMGQNGNL

SEQ ID NO: 17338 - protein, 9 aa, Artificial Sequence
  source: /note="Description of Artificial Sequence: Synthetic peptide"
HIKQDERVM

SEQ ID NO: 17339 - protein, 9 aa, Artificial Sequence
  source: /note="Description of Artificial Sequence: Synthetic peptide"
IKQDERVMM

SEQ ID NO: 17340 - protein, 10 aa, Artificial Sequence
  source: /note="Description of Artificial Sequence: Synthetic peptide"
VMMGQNGNLY

SEQ ID NO: 17341 - protein, 10 aa, Artificial Sequence
  source: /note="Description of Artificial Sequence: Synthetic peptide"
MMGQNGNLYF

SEQ ID NO: 17342 - protein, 10 aa, Artificial Sequence
  source: /note="Description of Artificial Sequence: Synthetic peptide"
RVMMGQNGNL

SEQ ID NO: 17343 - protein, 10 aa, Artificial Sequence
  source: /note="Description of Artificial Sequence: Synthetic peptide"
LHIKQDERVM

SEQ ID NO: 17344 - protein, 9 aa, Artificial Sequence
  source: /note="Description of Artificial Sequence: Synthetic peptide"
HVRNAPSAA

SEQ ID NO: 17345 - protein, 9 aa, Artificial Sequence
  source: /note="Description of Artificial Sequence: Synthetic peptide"
SAATSSIAI

SEQ ID NO: 17346 - protein, 9 aa, Artificial Sequence
  source: /note="Description of Artificial Sequence: Synthetic peptide"
APSAATSSI

SEQ ID NO: 17347 - protein, 9 aa, Artificial Sequence
  source: /note="Description of Artificial Sequence: Synthetic peptide"
LHVRNAPSA

SEQ ID NO: 17348 - protein, 10 aa, Artificial Sequence
  source: /note="Description of Artificial Sequence: Synthetic peptide"
ILHVRNAPSA

SEQ ID NO: 17349 - protein, 10 aa, Artificial Sequence
  source: /note="Description of Artificial Sequence: Synthetic peptide"
HVRNAPSAAT

SEQ ID NO: 17350 - protein, 10 aa, Artificial Sequence
  source: /note="Description of Artificial Sequence: Synthetic peptide"
NAPSAATSSI

SEQ ID NO: 17351 - protein, 10 aa, Artificial Sequence
  source: /note="Description of Artificial Sequence: Synthetic peptide"
APSAATSSIA

SEQ ID NO: 17352 - protein, 10 aa, Artificial Sequence
  source: /note="Description of Artificial Sequence: Synthetic peptide"
LHVRNAPSAA

SEQ ID NO: 17353 - protein, 9 aa, Artificial Sequence
  source: /note="Description of Artificial Sequence: Synthetic peptide"
VLMDYLKAC

SEQ ID NO: 17354 - protein, 9 aa, Artificial Sequence
  source: /note="Description of Artificial Sequence: Synthetic peptide"
LMDYLKACK

SEQ ID NO: 17355 - protein, 9 aa, Artificial Sequence
  source: /note="Description of Artificial Sequence: Synthetic peptide"
KFVLMDYLK

SEQ ID NO: 17356 - protein, 9 aa, Artificial Sequence
  source: /note="Description of Artificial Sequence: Synthetic peptide"
KDKFVLMDY

SEQ ID NO: 17357 - protein, 9 aa, Artificial Sequence
  source: /note="Description of Artificial Sequence: Synthetic peptide"
YRKDKFVLM

SEQ ID NO: 17358 - protein, 10 aa, Artificial Sequence
  source: /note="Description of Artificial Sequence: Synthetic peptide"
LMDYLKACKL

SEQ ID NO: 17359 - protein, 10 aa, Artificial Sequence
  source: /note="Description of Artificial Sequence: Synthetic peptide"
VLMDYLKACK

SEQ ID NO: 17360 - protein, 10 aa, Artificial Sequence
  source: /note="Description of Artificial Sequence: Synthetic peptide"
KGYRKDKFVL

SEQ ID NO: 17361 - protein, 10 aa, Artificial Sequence
  source: /note="Description of Artificial Sequence: Synthetic peptide"
RKDKFVLMDY

SEQ ID NO: 17362 - protein, 9 aa, Artificial Sequence
  source: /note="Description of Artificial Sequence: Synthetic peptide"
LLSAVTARA

SEQ ID NO: 17363 - protein, 9 aa, Artificial Sequence
  source: /note="Description of Artificial Sequence: Synthetic peptide"
RLLSAVTAR

SEQ ID NO: 17364 - protein, 9 aa, Artificial Sequence
  source: /note="Description of Artificial Sequence: Synthetic peptide"
YRLLSAVTA

SEQ ID NO: 17365 - protein, 10 aa, Artificial Sequence
  source: /note="Description of Artificial Sequence: Synthetic peptide"
RLLSAVTARA

SEQ ID NO: 17366 - protein, 10 aa, Artificial Sequence
  source: /note="Description of Artificial Sequence: Synthetic peptide"
LLSAVTARAA

SEQ ID NO: 17367 - protein, 10 aa, Artificial Sequence
  source: /note="Description of Artificial Sequence: Synthetic peptide"
MYRLLSAVTA

SEQ ID NO: 17368 - protein, 10 aa, Artificial Sequence
  source: /note="Description of Artificial Sequence: Synthetic peptide"
LSAVTARAAA

SEQ ID NO: 17369 - protein, 9 aa, Artificial Sequence
  source: /note="Description of Artificial Sequence: Synthetic peptide"
TLPELICTM

SEQ ID NO: 17370 - protein, 9 aa, Artificial Sequence
  source: /note="Description of Artificial Sequence: Synthetic peptide"
IDGYGGITL

SEQ ID NO: 17371 - protein, 10 aa, Artificial Sequence
  source: /note="Description of Artificial Sequence: Synthetic peptide"
GYGGITLPEL

SEQ ID NO: 17372 - protein, 10 aa, Artificial Sequence
  source: /note="Description of Artificial Sequence: Synthetic peptide"
TLPELICTMF

SEQ ID NO: 17373 - protein, 10 aa, Artificial Sequence
  source: /note="Description of Artificial Sequence: Synthetic peptide"
ITLPELICTM

SEQ ID NO: 17374 - protein, 9 aa, Artificial Sequence
  source: /note="Description of Artificial Sequence: Synthetic peptide"
GVKCEECEY

SEQ ID NO: 17375 - protein, 10 aa, Artificial Sequence
  source: /note="Description of Artificial Sequence: Synthetic peptide"
CEYGHWGYDA

SEQ ID NO: 17376 - protein, 10 aa, Artificial Sequence
  source: /note="Description of Artificial Sequence: Synthetic peptide"
EECEYGHWGY

SEQ ID NO: 17377 - protein, 9 aa, Artificial Sequence
  source: /note="Description of Artificial Sequence: Synthetic peptide"
ELDDIIKNV

SEQ ID NO: 17378 - protein, 9 aa, Artificial Sequence
  source: /note="Description of Artificial Sequence: Synthetic peptide"
NVSGIYAEI

SEQ ID NO: 17379 - protein, 9 aa, Artificial Sequence
  source: /note="Description of Artificial Sequence: Synthetic peptide"
IIKNVSGIY

SEQ ID NO: 17380 - protein, 9 aa, Artificial Sequence
  source: /note="Description of Artificial Sequence: Synthetic peptide"
DIIKNVSGI

SEQ ID NO: 17381 - protein, 9 aa, Artificial Sequence
  source: /note="Description of Artificial Sequence: Synthetic peptide"
IKNVSGIYA

SEQ ID NO: 17382 - protein, 10 aa, Artificial Sequence
  source: /note="Description of Artificial Sequence: Synthetic peptide"
IIKNVSGIYA

SEQ ID NO: 17383 - protein, 10 aa, Artificial Sequence
  source: /note="Description of Artificial Sequence: Synthetic peptide"
DIIKNVSGIY

SEQ ID NO: 17384 - protein, 10 aa, Artificial Sequence
  source: /note="Description of Artificial Sequence: Synthetic peptide"
KNVSGIYAEI

SEQ ID NO: 17385 - protein, 10 aa, Artificial Sequence
  source: /note="Description of Artificial Sequence: Synthetic peptide"
SELDDIIKNV

SEQ ID NO: 17386 - protein, 9 aa, Artificial Sequence
  source: /note="Description of Artificial Sequence: Synthetic peptide"
VNYVSEANK

SEQ ID NO: 17387 - protein, 9 aa, Artificial Sequence
  source: /note="Description of Artificial Sequence: Synthetic peptide"
YVSEANKTA

SEQ ID NO: 17388 - protein, 9 aa, Artificial Sequence
  source: /note="Description of Artificial Sequence: Synthetic peptide"
EANKTAEFA

SEQ ID NO: 17389 - protein, 9 aa, Artificial Sequence
  source: /note="Description of Artificial Sequence: Synthetic peptide"
SEANKTAEF

SEQ ID NO: 17390 - protein, 10 aa, Artificial Sequence
  source: /note="Description of Artificial Sequence: Synthetic peptide"
IVNYVSEANK

SEQ ID NO: 17391 - protein, 10 aa, Artificial Sequence
  source: /note="Description of Artificial Sequence: Synthetic peptide"
EANKTAEFAL

SEQ ID NO: 17392 - protein, 10 aa, Artificial Sequence
  source: /note="Description of Artificial Sequence: Synthetic peptide"
VSEANKTAEF

SEQ ID NO: 17393 - protein, 10 aa, Artificial Sequence
  source: /note="Description of Artificial Sequence: Synthetic peptide"
SEANKTAEFA

SEQ ID NO: 17394 - protein, 9 aa, Artificial Sequence
  source: /note="Description of Artificial Sequence: Synthetic peptide"
SLDNGTVII

SEQ ID NO: 17395 - protein, 9 aa, Artificial Sequence
  source: /note="Description of Artificial Sequence: Synthetic peptide"
VIIDVKGIK

SEQ ID NO: 17396 - protein, 9 aa, Artificial Sequence
  source: /note="Description of Artificial Sequence: Synthetic peptide"
TVIIDVKGI

SEQ ID NO: 17397 - protein, 10 aa, Artificial Sequence
  source: /note="Description of Artificial Sequence: Synthetic peptide"
VIIDVKGIKV

SEQ ID NO: 17398 - protein, 10 aa, Artificial Sequence
  source: /note="Description of Artificial Sequence: Synthetic peptide"
TVIIDVKGIK

SEQ ID NO: 17399 - protein, 10 aa, Artificial Sequence
  source: /note="Description of Artificial Sequence: Synthetic peptide"
ISLDNGTVII

SEQ ID NO: 17400 - protein, 9 aa, Artificial Sequence
  source: /note="Description of Artificial Sequence: Synthetic peptide"
QLRSPRGPR

SEQ ID NO: 17401 - protein, 9 aa, Artificial Sequence
  source: /note="Description of Artificial Sequence: Synthetic peptide"
LQSQLRSPR

SEQ ID NO: 17402 - protein, 9 aa, Artificial Sequence
  source: /note="Description of Artificial Sequence: Synthetic peptide"
SPRGPRHET

SEQ ID NO: 17403 - protein, 10 aa, Artificial Sequence
  source: /note="Description of Artificial Sequence: Synthetic peptide"
SQLRSPRGPR

SEQ ID NO: 17404 - protein, 10 aa, Artificial Sequence
  source: /note="Description of Artificial Sequence: Synthetic peptide"
QLRSPRGPRH

SEQ ID NO: 17405 - protein, 10 aa, Artificial Sequence
  source: /note="Description of Artificial Sequence: Synthetic peptide"
DLQSQLRSPR

SEQ ID NO: 17406 - protein, 10 aa, Artificial Sequence
  source: /note="Description of Artificial Sequence: Synthetic peptide"
SPRGPRHETA

SEQ ID NO: 17407 - protein, 9 aa, Artificial Sequence
  source: /note="Description of Artificial Sequence: Synthetic peptide"
GEPVPWNPV

SEQ ID NO: 17408 - protein, 9 aa, Artificial Sequence
  source: /note="Description of Artificial Sequence: Synthetic peptide"
VVLGEPVPW

SEQ ID NO: 17409 - protein, 10 aa, Artificial Sequence
  source: /note="Description of Artificial Sequence: Synthetic peptide"
HVVLGEPVPW

SEQ ID NO: 17410 - protein, 10 aa, Artificial Sequence
  source: /note="Description of Artificial Sequence: Synthetic peptide"
EPVPWNPVTW

SEQ ID NO: 17411 - protein, 9 aa, Artificial Sequence
  source: /note="Description of Artificial Sequence: Synthetic peptide"
VFPSWKFLK

SEQ ID NO: 17412 - protein, 9 aa, Artificial Sequence
  source: /note="Description of Artificial Sequence: Synthetic peptide"
KHPVFPSWK

SEQ ID NO: 17413 - protein, 9 aa, Artificial Sequence
  source: /note="Description of Artificial Sequence: Synthetic peptide"
FPSWKFLKV

SEQ ID NO: 17414 - protein, 9 aa, Artificial Sequence
  source: /note="Description of Artificial Sequence: Synthetic peptide"
HPVFPSWKF

SEQ ID NO: 17415 - protein, 9 aa, Artificial Sequence
  source: /note="Description of Artificial Sequence: Synthetic peptide"
LKHPVFPSW

SEQ ID NO: 17416 - protein, 9 aa, Artificial Sequence
  source: /note="Description of Artificial Sequence: Synthetic peptide"
WKFLKVKDY

SEQ ID NO: 17417 - protein, 10 aa, Artificial Sequence
  source: /note="Description of Artificial Sequence: Synthetic peptide"
PVFPSWKFLK

SEQ ID NO: 17418 - protein, 10 aa, Artificial Sequence
  source: /note="Description of Artificial Sequence: Synthetic peptide"
KHPVFPSWKF

SEQ ID NO: 17419 - protein, 10 aa, Artificial Sequence
  source: /note="Description of Artificial Sequence: Synthetic peptide"
VFPSWKFLKV

SEQ ID NO: 17420 - protein, 10 aa, Artificial Sequence
  source: /note="Description of Artificial Sequence: Synthetic peptide"
SWKFLKVKDY

SEQ ID NO: 17421 - protein, 10 aa, Artificial Sequence
  source: /note="Description of Artificial Sequence: Synthetic peptide"
HPVFPSWKFL

SEQ ID NO: 17422 - protein, 10 aa, Artificial Sequence
  source: /note="Description of Artificial Sequence: Synthetic peptide"
ILKHPVFPSW

SEQ ID NO: 17423 - protein, 9 aa, Artificial Sequence
  source: /note="Description of Artificial Sequence: Synthetic peptide"
TYGRQEGQY

SEQ ID NO: 17424 - protein, 9 aa, Artificial Sequence
  source: /note="Description of Artificial Sequence: Synthetic peptide"
YGRQEGQYL

SEQ ID NO: 17425 - protein, 10 aa, Artificial Sequence
  source: /note="Description of Artificial Sequence: Synthetic peptide"
KTYGRQEGQY

SEQ ID NO: 17426 - protein, 10 aa, Artificial Sequence
  source: /note="Description of Artificial Sequence: Synthetic peptide"
TYGRQEGQYL

SEQ ID NO: 17427 - protein, 10 aa, Artificial Sequence
  source: /note="Description of Artificial Sequence: Synthetic peptide"
RQEGQYLRPG

SEQ ID NO: 17428 - protein, 9 aa, Artificial Sequence
  source: /note="Description of Artificial Sequence: Synthetic peptide"
APPHPSLAT

SEQ ID NO: 17429 - protein, 10 aa, Artificial Sequence
  source: /note="Description of Artificial Sequence: Synthetic peptide"
SLATRDQTGA

SEQ ID NO: 17430 - protein, 10 aa, Artificial Sequence
  source: /note="Description of Artificial Sequence: Synthetic peptide"
ATYVPVAPPH

SEQ ID NO: 17431 - protein, 10 aa, Artificial Sequence
  source: /note="Description of Artificial Sequence: Synthetic peptide"
ATRDQTGACL

SEQ ID NO: 17432 - protein, 10 aa, Artificial Sequence
  source: /note="Description of Artificial Sequence: Synthetic peptide"
VPVAPPHPSL

SEQ ID NO: 17433 - protein, 9 aa, Artificial Sequence
  source: /note="Description of Artificial Sequence: Synthetic peptide"
CILYHRWIV

SEQ ID NO: 17434 - protein, 9 aa, Artificial Sequence
  source: /note="Description of Artificial Sequence: Synthetic peptide"
VLKKHWNSA

SEQ ID NO: 17435 - protein, 9 aa, Artificial Sequence
  source: /note="Description of Artificial Sequence: Synthetic peptide"
YLGRTLLVT

SEQ ID NO: 17436 - protein, 9 aa, Artificial Sequence
  source: /note="Description of Artificial Sequence: Synthetic peptide"
ILYHRWIVT

SEQ ID NO: 17437 - protein, 9 aa, Artificial Sequence
  source: /note="Description of Artificial Sequence: Synthetic peptide"
VTSMCQSQR

SEQ ID NO: 17438 - protein, 9 aa, Artificial Sequence
  source: /note="Description of Artificial Sequence: Synthetic peptide"
AYLGRTLLV

SEQ ID NO: 17439 - protein, 9 aa, Artificial Sequence
  source: /note="Description of Artificial Sequence: Synthetic peptide"
RTLLVTCIL

SEQ ID NO: 17440 - protein, 9 aa, Artificial Sequence
  source: /note="Description of Artificial Sequence: Synthetic peptide"
LYHRWIVTS

SEQ ID NO: 17441 - protein, 9 aa, Artificial Sequence
  source: /note="Description of Artificial Sequence: Synthetic peptide"
SAYLGRTLL

SEQ ID NO: 17442 - protein, 9 aa, Artificial Sequence
  source: /note="Description of Artificial Sequence: Synthetic peptide"
RWLTSTTSR

SEQ ID NO: 17443 - protein, 9 aa, Artificial Sequence
  source: /note="Description of Artificial Sequence: Synthetic peptide"
STTSRSSAL

SEQ ID NO: 17444 - protein, 9 aa, Artificial Sequence
  source: /note="Description of Artificial Sequence: Synthetic peptide"
TTSRSSALM

SEQ ID NO: 17445 - protein, 9 aa, Artificial Sequence
  source: /note="Description of Artificial Sequence: Synthetic peptide"
LKKHWNSAY

SEQ ID NO: 17446 - protein, 9 aa, Artificial Sequence
  source: /note="Description of Artificial Sequence: Synthetic peptide"
TLLVTCILY

SEQ ID NO: 17447 - protein, 9 aa, Artificial Sequence
  source: /note="Description of Artificial Sequence: Synthetic peptide"
HWNSAYLGR

SEQ ID NO: 17448 - protein, 9 aa, Artificial Sequence
  source: /note="Description of Artificial Sequence: Synthetic peptide"
LVTCILYHR

SEQ ID NO: 17449 - protein, 9 aa, Artificial Sequence
  source: /note="Description of Artificial Sequence: Synthetic peptide"
YHRWIVTSM

SEQ ID NO: 17450 - protein, 9 aa, Artificial Sequence
  source: /note="Description of Artificial Sequence: Synthetic peptide"
KKHWNSAYL

SEQ ID NO: 17451 - protein, 9 aa, Artificial Sequence
  source: /note="Description of Artificial Sequence: Synthetic peptide"
NSAYLGRTL

SEQ ID NO: 17452 - protein, 9 aa, Artificial Sequence
  source: /note="Description of Artificial Sequence: Synthetic peptide"
SMCQSQRWL

SEQ ID NO: 17453 - protein, 9 aa, Artificial Sequence
  source: /note="Description of Artificial Sequence: Synthetic peptide"
CQSQRWLTS

SEQ ID NO: 17454 - protein, 9 aa, Artificial Sequence
  source: /note="Description of Artificial Sequence: Synthetic peptide"
SQRWLTSTT

SEQ ID NO: 17455 - protein, 9 aa, Artificial Sequence
  source: /note="Description of Artificial Sequence: Synthetic peptide"
TSRSSALMW

SEQ ID NO: 17456 - protein, 9 aa, Artificial Sequence
  source: /note="Description of Artificial Sequence: Synthetic peptide"
TSMCQSQRW

SEQ ID NO: 17457 - protein, 10 aa, Artificial Sequence
  source: /note="Description of Artificial Sequence: Synthetic peptide"
SAYLGRTLLV

SEQ ID NO: 17458 - protein, 10 aa, Artificial Sequence
  source: /note="Description of Artificial Sequence: Synthetic peptide"
RTLLVTCILY

SEQ ID NO: 17459 - protein, 10 aa, Artificial Sequence
  source: /note="Description of Artificial Sequence: Synthetic peptide"
LYHRWIVTSM

SEQ ID NO: 17460 - protein, 10 aa, Artificial Sequence
  source: /note="Description of Artificial Sequence: Synthetic peptide"
STTSRSSALM

SEQ ID NO: 17461 - protein, 10 aa, Artificial Sequence
  source: /note="Description of Artificial Sequence: Synthetic peptide"
VLKKHWNSAY

SEQ ID NO: 17462 - protein, 10 aa, Artificial Sequence
  source: /note="Description of Artificial Sequence: Synthetic peptide"
LLVTCILYHR

SEQ ID NO: 17463 - protein, 10 aa, Artificial Sequence
  source: /note="Description of Artificial Sequence: Synthetic peptide"
IVTSMCQSQR

SEQ ID NO: 17464 - protein, 10 aa, Artificial Sequence
  source: /note="Description of Artificial Sequence: Synthetic peptide"
EVLKKHWNSA

SEQ ID NO: 17465 - protein, 10 aa, Artificial Sequence
  source: /note="Description of Artificial Sequence: Synthetic peptide"
NSAYLGRTLL

SEQ ID NO: 17466 - protein, 10 aa, Artificial Sequence
  source: /note="Description of Artificial Sequence: Synthetic peptide"
LKKHWNSAYL

SEQ ID NO: 17467 - protein, 10 aa, Artificial Sequence
  source: /note="Description of Artificial Sequence: Synthetic peptide"
WNSAYLGRTL

SEQ ID NO: 17468 - protein, 10 aa, Artificial Sequence
  source: /note="Description of Artificial Sequence: Synthetic peptide"
CQSQRWLTST

SEQ ID NO: 17469 - protein, 10 aa, Artificial Sequence
  source: /note="Description of Artificial Sequence: Synthetic peptide"
SQRWLTSTTS

SEQ ID NO: 17470 - protein, 10 aa, Artificial Sequence
  source: /note="Description of Artificial Sequence: Synthetic peptide"
REVLKKHWNS

SEQ ID NO: 17471 - protein, 10 aa, Artificial Sequence
  source: /note="Description of Artificial Sequence: Synthetic peptide"
TTSRSSALMW

SEQ ID NO: 17472 - protein, 9 aa, Artificial Sequence
  source: /note="Description of Artificial Sequence: Synthetic peptide"
ATGYSGFKK

SEQ ID NO: 17473 - protein, 9 aa, Artificial Sequence
  source: /note="Description of Artificial Sequence: Synthetic peptide"
RLASFLHHH

SEQ ID NO: 17474 - protein, 9 aa, Artificial Sequence
  source: /note="Description of Artificial Sequence: Synthetic peptide"
GFEGRLASF

SEQ ID NO: 17475 - protein, 9 aa, Artificial Sequence
  source: /note="Description of Artificial Sequence: Synthetic peptide"
FPATGYSGF

SEQ ID NO: 17476 - protein, 9 aa, Artificial Sequence
  source: /note="Description of Artificial Sequence: Synthetic peptide"
LDYFPATGY

SEQ ID NO: 17477 - protein, 9 aa, Artificial Sequence
  source: /note="Description of Artificial Sequence: Synthetic peptide"
FEGRLASFL

SEQ ID NO: 17478 - protein, 10 aa, Artificial Sequence
  source: /note="Description of Artificial Sequence: Synthetic peptide"
WLDYFPATGY

SEQ ID NO: 17479 - protein, 10 aa, Artificial Sequence
  source: /note="Description of Artificial Sequence: Synthetic peptide"
YFPATGYSGF

SEQ ID NO: 17480 - protein, 10 aa, Artificial Sequence
  source: /note="Description of Artificial Sequence: Synthetic peptide"
NGFEGRLASF

SEQ ID NO: 17481 - protein, 10 aa, Artificial Sequence
  source: /note="Description of Artificial Sequence: Synthetic peptide"
AEHWLDYFPA

SEQ ID NO: 17482 - protein, 10 aa, Artificial Sequence
  source: /note="Description of Artificial Sequence: Synthetic peptide"
FKKNGFEGRL

SEQ ID NO: 17483 - protein, 9 aa, Artificial Sequence
  source: /note="Description of Artificial Sequence: Synthetic peptide"
AALLVLWGV

SEQ ID NO: 17484 - protein, 9 aa, Artificial Sequence
  source: /note="Description of Artificial Sequence: Synthetic peptide"
VLWGVAASL

SEQ ID NO: 17485 - protein, 9 aa, Artificial Sequence
  source: /note="Description of Artificial Sequence: Synthetic peptide"
LLVLWGVAA

SEQ ID NO: 17486 - protein, 10 aa, Artificial Sequence
  source: /note="Description of Artificial Sequence: Synthetic peptide"
GAALLVLWGV

SEQ ID NO: 17487 - protein, 10 aa, Artificial Sequence
  source: /note="Description of Artificial Sequence: Synthetic peptide"
ALLVLWGVAA

SEQ ID NO: 17488 - protein, 10 aa, Artificial Sequence
  source: /note="Description of Artificial Sequence: Synthetic peptide"
LVLWGVAASL

SEQ ID NO: 17489 - protein, 10 aa, Artificial Sequence
  source: /note="Description of Artificial Sequence: Synthetic peptide"
WPGAALLVLW

SEQ ID NO: 17490 - protein, 9 aa, Artificial Sequence
  source: /note="Description of Artificial Sequence: Synthetic peptide"
VITWFQNWR

SEQ ID NO: 17491 - protein, 9 aa, Artificial Sequence
  source: /note="Description of Artificial Sequence: Synthetic peptide"
QVITWFQNW

SEQ ID NO: 17492 - protein, 9 aa, Artificial Sequence
  source: /note="Description of Artificial Sequence: Synthetic peptide"
WFQNWRAKL

SEQ ID NO: 17493 - protein, 9 aa, Artificial Sequence
  source: /note="Description of Artificial Sequence: Synthetic peptide"
TWFQNWRAK

SEQ ID NO: 17494 - protein, 9 aa, Artificial Sequence
  source: /note="Description of Artificial Sequence: Synthetic peptide"
ITWFQNWRA

SEQ ID NO: 17495 - protein, 10 aa, Artificial Sequence
  source: /note="Description of Artificial Sequence: Synthetic peptide"
ITWFQNWRAK

SEQ ID NO: 17496 - protein, 10 aa, Artificial Sequence
  source: /note="Description of Artificial Sequence: Synthetic peptide"
QVITWFQNWR

SEQ ID NO: 17497 - protein, 10 aa, Artificial Sequence
  source: /note="Description of Artificial Sequence: Synthetic peptide"
TWFQNWRAKL

SEQ ID NO: 17498 - protein, 10 aa, Artificial Sequence
  source: /note="Description of Artificial Sequence: Synthetic peptide"
WFQNWRAKLK

SEQ ID NO: 17499 - protein, 10 aa, Artificial Sequence
  source: /note="Description of Artificial Sequence: Synthetic peptide"
NWRAKLKRDL

SEQ ID NO: 17500 - protein, 10 aa, Artificial Sequence
  source: /note="Description of Artificial Sequence: Synthetic peptide"
AQVITWFQNW

SEQ ID NO: 17501 - protein, 10 aa, Artificial Sequence
  source: /note="Description of Artificial Sequence: Synthetic peptide"
RVNKPAIPQT

SEQ ID NO: 17502 - protein, 9 aa, Artificial Sequence
  source: /note="Description of Artificial Sequence: Synthetic peptide"
QLLKLLLQL

SEQ ID NO: 17503 - protein, 9 aa, Artificial Sequence
  source: /note="Description of Artificial Sequence: Synthetic peptide"
LLLQLQPPL

SEQ ID NO: 17504 - protein, 9 aa, Artificial Sequence
  source: /note="Description of Artificial Sequence: Synthetic peptide"
QLQPPLPRA

SEQ ID NO: 17505 - protein, 10 aa, Artificial Sequence
  source: /note="Description of Artificial Sequence: Synthetic peptide"
KLLLQLQPPL

SEQ ID NO: 17506 - protein, 10 aa, Artificial Sequence
  source: /note="Description of Artificial Sequence: Synthetic peptide"
QLQPPLPRAL

SEQ ID NO: 17507 - protein, 10 aa, Artificial Sequence
  source: /note="Description of Artificial Sequence: Synthetic peptide"
LQLLKLLLQL

SEQ ID NO: 17508 - protein, 10 aa, Artificial Sequence
  source: /note="Description of Artificial Sequence: Synthetic peptide"
LQLQPPLPRA

SEQ ID NO: 17509 - protein, 9 aa, Artificial Sequence
  source: /note="Description of Artificial Sequence: Synthetic peptide"
SSNPYLLSY

SEQ ID NO: 17510 - protein, 9 aa, Artificial Sequence
  source: /note="Description of Artificial Sequence: Synthetic peptide"
LLSYPSDSL

SEQ ID NO: 17511 - protein, 9 aa, Artificial Sequence
  source: /note="Description of Artificial Sequence: Synthetic peptide"
SYPSDSLEL

SEQ ID NO: 17512 - protein, 9 aa, Artificial Sequence
  source: /note="Description of Artificial Sequence: Synthetic peptide"
YPSDSLELM

SEQ ID NO: 17513 - protein, 9 aa, Artificial Sequence
  source: /note="Description of Artificial Sequence: Synthetic peptide"
NPYLLSYPS

SEQ ID NO: 17514 - protein, 10 aa, Artificial Sequence
  source: /note="Description of Artificial Sequence: Synthetic peptide"
LSSNPYLLSY

SEQ ID NO: 17515 - protein, 10 aa, Artificial Sequence
  source: /note="Description of Artificial Sequence: Synthetic peptide"
YLLSYPSDSL

SEQ ID NO: 17516 - protein, 10 aa, Artificial Sequence
  source: /note="Description of Artificial Sequence: Synthetic peptide"
SYPSDSLELM

SEQ ID NO: 17517 - protein, 10 aa, Artificial Sequence
  source: /note="Description of Artificial Sequence: Synthetic peptide"
LSYPSDSLEL

SEQ ID NO: 17518 - protein, 10 aa, Artificial Sequence
  source: /note="Description of Artificial Sequence: Synthetic peptide"
YPSDSLELMV

SEQ ID NO: 17519 - protein, 10 aa, Artificial Sequence
  source: /note="Description of Artificial Sequence: Synthetic peptide"
ILLLLLLLLF

SEQ ID NO: 17520 - protein, 9 aa, Artificial Sequence
  source: /note="Description of Artificial Sequence: Synthetic peptide"
APPPPPRSL

SEQ ID NO: 17521 - protein, 10 aa, Artificial Sequence
  source: /note="Description of Artificial Sequence: Synthetic peptide"
PPPPPRSLPL

SEQ ID NO: 17522 - protein, 9 aa, Artificial Sequence
  source: /note="Description of Artificial Sequence: Synthetic peptide"
GIMFFSTTL

SEQ ID NO: 17523 - protein, 9 aa, Artificial Sequence
  source: /note="Description of Artificial Sequence: Synthetic peptide"
MFFSTTLFV

SEQ ID NO: 17524 - protein, 9 aa, Artificial Sequence
  source: /note="Description of Artificial Sequence: Synthetic peptide"
FFSTTLFVV

SEQ ID NO: 17525 - protein, 9 aa, Artificial Sequence
  source: /note="Description of Artificial Sequence: Synthetic peptide"
IMFFSTTLF

SEQ ID NO: 17526 - protein, 9 aa, Artificial Sequence
  source: /note="Description of Artificial Sequence: Synthetic peptide"
FSTTLFVVL

SEQ ID NO: 17527 - protein, 9 aa, Artificial Sequence
  source: /note="Description of Artificial Sequence: Synthetic peptide"
STTLFVVLA

SEQ ID NO: 17528 - protein, 9 aa, Artificial Sequence
  source: /note="Description of Artificial Sequence: Synthetic peptide"
TTLFVVLAL

SEQ ID NO: 17529 - protein, 10 aa, Artificial Sequence
  source: /note="Description of Artificial Sequence: Synthetic peptide"
IMFFSTTLFV

SEQ ID NO: 17530 - protein, 10 aa, Artificial Sequence
  source: /note="Description of Artificial Sequence: Synthetic peptide"
MFFSTTLFVV

SEQ ID NO: 17531 - protein, 10 aa, Artificial Sequence
  source: /note="Description of Artificial Sequence: Synthetic peptide"
GIMFFSTTLF

SEQ ID NO: 17532 - protein, 10 aa, Artificial Sequence
  source: /note="Description of Artificial Sequence: Synthetic peptide"
FFSTTLFVVL

SEQ ID NO: 17533 - protein, 10 aa, Artificial Sequence
  source: /note="Description of Artificial Sequence: Synthetic peptide"
FSAGIMFFST

SEQ ID NO: 17534 - protein, 10 aa, Artificial Sequence
  source: /note="Description of Artificial Sequence: Synthetic peptide"
FSTTLFVVLA

SEQ ID NO: 17535 - protein, 10 aa, Artificial Sequence
  source: /note="Description of Artificial Sequence: Synthetic peptide"
STTLFVVLAL

SEQ ID NO: 17536 - protein, 10 aa, Artificial Sequence
  source: /note="Description of Artificial Sequence: Synthetic peptide"
TTLFVVLALA

SEQ ID NO: 17537 - protein, 10 aa, Artificial Sequence
  source: /note="Description of Artificial Sequence: Synthetic peptide"
AGIMFFSTTL

SEQ ID NO: 17538 - protein, 9 aa, Artificial Sequence
  source: /note="Description of Artificial Sequence: Synthetic peptide"
NAIHPGDHI

SEQ ID NO: 17539 - protein, 9 aa, Artificial Sequence
  source: /note="Description of Artificial Sequence: Synthetic peptide"
HPGDHILEI

SEQ ID NO: 17540 - protein, 9 aa, Artificial Sequence
  source: /note="Description of Artificial Sequence: Synthetic peptide"
AIHPGDHIL

SEQ ID NO: 17541 - protein, 10 aa, Artificial Sequence
  source: /note="Description of Artificial Sequence: Synthetic peptide"
HILEINGTPV

SEQ ID NO: 17542 - protein, 9 aa, Artificial Sequence
  source: /note="Description of Artificial Sequence: Synthetic peptide"
RVEWGKIWR

SEQ ID NO: 17543 - protein, 9 aa, Artificial Sequence
  source: /note="Description of Artificial Sequence: Synthetic peptide"
IWRLMGKPR

SEQ ID NO: 17544 - protein, 9 aa, Artificial Sequence
  source: /note="Description of Artificial Sequence: Synthetic peptide"
VEWGKIWRL

SEQ ID NO: 17545 - protein, 10 aa, Artificial Sequence
  source: /note="Description of Artificial Sequence: Synthetic peptide"
WGKIWRLMGK

SEQ ID NO: 17546 - protein, 10 aa, Artificial Sequence
  source: /note="Description of Artificial Sequence: Synthetic peptide"
KIWRLMGKPR

SEQ ID NO: 17547 - protein, 10 aa, Artificial Sequence
  source: /note="Description of Artificial Sequence: Synthetic peptide"
IWRLMGKPRR

SEQ ID NO: 17548 - protein, 10 aa, Artificial Sequence
  source: /note="Description of Artificial Sequence: Synthetic peptide"
VEWGKIWRLM

SEQ ID NO: 17549 - protein, 9 aa, Artificial Sequence
  source: /note="Description of Artificial Sequence: Synthetic peptide"
SQFKDLPDK

SEQ ID NO: 17550 - protein, 9 aa, Artificial Sequence
  source: /note="Description of Artificial Sequence: Synthetic peptide"
LPDKIPLPL

SEQ ID NO: 17551 - protein, 9 aa, Artificial Sequence
  source: /note="Description of Artificial Sequence: Synthetic peptide"
KDLPDKIPL

SEQ ID NO: 17552 - protein, 10 aa, Artificial Sequence
  source: /note="Description of Artificial Sequence: Synthetic peptide"
VSQFKDLPDK

SEQ ID NO: 17553 - protein, 10 aa, Artificial Sequence
  source: /note="Description of Artificial Sequence: Synthetic peptide"
SQFKDLPDKI

SEQ ID NO: 17554 - protein, 10 aa, Artificial Sequence
  source: /note="Description of Artificial Sequence: Synthetic peptide"
FKDLPDKIPL

SEQ ID NO: 17555 - protein, 10 aa, Artificial Sequence
  source: /note="Description of Artificial Sequence: Synthetic peptide"
LPDKIPLPLV

SEQ ID NO: 17556 - protein, 9 aa, Artificial Sequence
  source: /note="Description of Artificial Sequence: Synthetic peptide"
KTKIREKKL

SEQ ID NO: 17557 - protein, 9 aa, Artificial Sequence
  source: /note="Description of Artificial Sequence: Synthetic peptide"
FTCKKTKIR

SEQ ID NO: 17558 - protein, 10 aa, Artificial Sequence
  source: /note="Description of Artificial Sequence: Synthetic peptide"
FYFTCKKTKI

SEQ ID NO: 17559 - protein, 10 aa, Artificial Sequence
  source: /note="Description of Artificial Sequence: Synthetic peptide"
SFYFTCKKTK

SEQ ID NO: 17560 - protein, 10 aa, Artificial Sequence
  source: /note="Description of Artificial Sequence: Synthetic peptide"
TCKKTKIREK

SEQ ID NO: 17561 - protein, 10 aa, Artificial Sequence
  source: /note="Description of Artificial Sequence: Synthetic peptide"
YFTCKKTKIR

SEQ ID NO: 17562 - protein, 9 aa, Artificial Sequence
  source: /note="Description of Artificial Sequence: Synthetic peptide"
FMMFGYDQK

SEQ ID NO: 17563 - protein, 9 aa, Artificial Sequence
  source: /note="Description of Artificial Sequence: Synthetic peptide"
DQKNLNMSR

SEQ ID NO: 17564 - protein, 9 aa, Artificial Sequence
  source: /note="Description of Artificial Sequence: Synthetic peptide"
MMFGYDQKN

SEQ ID NO: 17565 - protein, 10 aa, Artificial Sequence
  source: /note="Description of Artificial Sequence: Synthetic peptide"
MMFGYDQKNL

SEQ ID NO: 17566 - protein, 10 aa, Artificial Sequence
  source: /note="Description of Artificial Sequence: Synthetic peptide"
LFMMFGYDQK

SEQ ID NO: 17567 - protein, 10 aa, Artificial Sequence
  source: /note="Description of Artificial Sequence: Synthetic peptide"
FGYDQKNLNM

SEQ ID NO: 17568 - protein, 10 aa, Artificial Sequence
  source: /note="Description of Artificial Sequence: Synthetic peptide"
KKAPEPSQEL

SEQ ID NO: 17569 - protein, 9 aa, Artificial Sequence
  source: /note="Description of Artificial Sequence: Synthetic peptide"
GKWPHGAVC

SEQ ID NO: 17570 - protein, 10 aa, Artificial Sequence
  source: /note="Description of Artificial Sequence: Synthetic peptide"
GKWPHGAVCV

SEQ ID NO: 17571 - protein, 9 aa, Artificial Sequence
  source: /note="Description of Artificial Sequence: Synthetic peptide"
LQEVLSSRM

SEQ ID NO: 17572 - protein, 10 aa, Artificial Sequence
  source: /note="Description of Artificial Sequence: Synthetic peptide"
GLQEVLSSRM

SEQ ID NO: 17573 - protein, 9 aa, Artificial Sequence
  source: /note="Description of Artificial Sequence: Synthetic peptide"
DNIKPPAER

SEQ ID NO: 17574 - protein, 10 aa, Artificial Sequence
  source: /note="Description of Artificial Sequence: Synthetic peptide"
NIKPPAERLR

SEQ ID NO: 17575 - protein, 10 aa, Artificial Sequence
  source: /note="Description of Artificial Sequence: Synthetic peptide"
PPAERLRGPL

SEQ ID NO: 17576 - protein, 9 aa, Artificial Sequence
  source: /note="Description of Artificial Sequence: Synthetic peptide"
SLRSPWALS

SEQ ID NO: 17577 - protein, 9 aa, Artificial Sequence
  source: /note="Description of Artificial Sequence: Synthetic peptide"
APDASQASL

SEQ ID NO: 17578 - protein, 9 aa, Artificial Sequence
  source: /note="Description of Artificial Sequence: Synthetic peptide"
SQASLRSPW

SEQ ID NO: 17579 - protein, 9 aa, Artificial Sequence
  source: /note="Description of Artificial Sequence: Synthetic peptide"
ASLRSPWAL

SEQ ID NO: 17580 - protein, 10 aa, Artificial Sequence
  source: /note="Description of Artificial Sequence: Synthetic peptide"
SLRSPWALSV

SEQ ID NO: 17581 - protein, 10 aa, Artificial Sequence
  source: /note="Description of Artificial Sequence: Synthetic peptide"
SQASLRSPWA

SEQ ID NO: 17582 - protein, 10 aa, Artificial Sequence
  source: /note="Description of Artificial Sequence: Synthetic peptide"
ASQASLRSPW

SEQ ID NO: 17583 - protein, 10 aa, Artificial Sequence
  source: /note="Description of Artificial Sequence: Synthetic peptide"
AARTCMGAPG

SEQ ID NO: 17584 - protein, 10 aa, Artificial Sequence
  source: /note="Description of Artificial Sequence: Synthetic peptide"
RTCMGAPGSL

SEQ ID NO: 17585 - protein, 10 aa, Artificial Sequence
  source: /note="Description of Artificial Sequence: Synthetic peptide"
VPAARTCMGA

SEQ ID NO: 17586 - protein, 10 aa, Artificial Sequence
  source: /note="Description of Artificial Sequence: Synthetic peptide"
YSVPAARTCM

SEQ ID NO: 17587 - protein, 9 aa, Artificial Sequence
  source: /note="Description of Artificial Sequence: Synthetic peptide"
RMEPEGPEY

SEQ ID NO: 17588 - protein, 10 aa, Artificial Sequence
  source: /note="Description of Artificial Sequence: Synthetic peptide"
RMEPEGPEYW

SEQ ID NO: 17589 - protein, 9 aa, Artificial Sequence
  source: /note="Description of Artificial Sequence: Synthetic peptide"
KVNRENAGV

SEQ ID NO: 17590 - protein, 9 aa, Artificial Sequence
  source: /note="Description of Artificial Sequence: Synthetic peptide"
VNRENAGVK

SEQ ID NO: 17591 - protein, 10 aa, Artificial Sequence
  source: /note="Description of Artificial Sequence: Synthetic peptide"
KVNRENAGVK

SEQ ID NO: 17592 - protein, 10 aa, Artificial Sequence
  source: /note="Description of Artificial Sequence: Synthetic peptide"
RENAGVKRSA

SEQ ID NO: 17593 - protein, 9 aa, Artificial Sequence
  source: /note="Description of Artificial Sequence: Synthetic peptide"
GLLHIFFLA

SEQ ID NO: 17594 - protein, 9 aa, Artificial Sequence
  source: /note="Description of Artificial Sequence: Synthetic peptide"
LLHIFFLAA

SEQ ID NO: 17595 - protein, 9 aa, Artificial Sequence
  source: /note="Description of Artificial Sequence: Synthetic peptide"
HIFFLAAFA

SEQ ID NO: 17596 - protein, 9 aa, Artificial Sequence
  source: /note="Description of Artificial Sequence: Synthetic peptide"
IFAGLLHIF

SEQ ID NO: 17597 - protein, 9 aa, Artificial Sequence
  source: /note="Description of Artificial Sequence: Synthetic peptide"
IFFLAAFAW

SEQ ID NO: 17598 - protein, 9 aa, Artificial Sequence
  source: /note="Description of Artificial Sequence: Synthetic peptide"
LHIFFLAAF

SEQ ID NO: 17599 - protein, 9 aa, Artificial Sequence
  source: /note="Description of Artificial Sequence: Synthetic peptide"
FAGLLHIFF

SEQ ID NO: 17600 - protein, 10 aa, Artificial Sequence
  source: /note="Description of Artificial Sequence: Synthetic peptide"
GLLHIFFLAA

SEQ ID NO: 17601 - protein, 10 aa, Artificial Sequence
  source: /note="Description of Artificial Sequence: Synthetic peptide"
IFAGLLHIFF

SEQ ID NO: 17602 - protein, 10 aa, Artificial Sequence
  source: /note="Description of Artificial Sequence: Synthetic peptide"
IFFLAAFAWM

SEQ ID NO: 17603 - protein, 10 aa, Artificial Sequence
  source: /note="Description of Artificial Sequence: Synthetic peptide"
CPIFAGLLHI

SEQ ID NO: 17604 - protein, 10 aa, Artificial Sequence
  source: /note="Description of Artificial Sequence: Synthetic peptide"
LLHIFFLAAF

SEQ ID NO: 17605 - protein, 10 aa, Artificial Sequence
  source: /note="Description of Artificial Sequence: Synthetic peptide"
PIFAGLLHIF

SEQ ID NO: 17606 - protein, 10 aa, Artificial Sequence
  source: /note="Description of Artificial Sequence: Synthetic peptide"
HIFFLAAFAW

SEQ ID NO: 17607 - protein, 9 aa, Artificial Sequence
  source: /note="Description of Artificial Sequence: Synthetic peptide"
DIRVAFVLY

SEQ ID NO: 17608 - protein, 9 aa, Artificial Sequence
  source: /note="Description of Artificial Sequence: Synthetic peptide"
KQNGRNGDI

SEQ ID NO: 17609 - protein, 9 aa, Artificial Sequence
  source: /note="Description of Artificial Sequence: Synthetic peptide"
RNGDIRVAF

SEQ ID NO: 17610 - protein, 9 aa, Artificial Sequence
  source: /note="Description of Artificial Sequence: Synthetic peptide"
GDIRVAFVL

SEQ ID NO: 17611 - protein, 10 aa, Artificial Sequence
  source: /note="Description of Artificial Sequence: Synthetic peptide"
GRNGDIRVAF

SEQ ID NO: 17612 - protein, 10 aa, Artificial Sequence
  source: /note="Description of Artificial Sequence: Synthetic peptide"
GDIRVAFVLY

SEQ ID NO: 17613 - protein, 9 aa, Artificial Sequence
  source: /note="Description of Artificial Sequence: Synthetic peptide"
YSKHTMTGY

SEQ ID NO: 17614 - protein, 9 aa, Artificial Sequence
  source: /note="Description of Artificial Sequence: Synthetic peptide"
CSFWSYSKH

SEQ ID NO: 17615 - protein, 9 aa, Artificial Sequence
  source: /note="Description of Artificial Sequence: Synthetic peptide"
HTMTGYWST

SEQ ID NO: 17616 - protein, 9 aa, Artificial Sequence
  source: /note="Description of Artificial Sequence: Synthetic peptide"
FWSYSKHTM

SEQ ID NO: 17617 - protein, 9 aa, Artificial Sequence
  source: /note="Description of Artificial Sequence: Synthetic peptide"
SKHTMTGYW

SEQ ID NO: 17618 - protein, 10 aa, Artificial Sequence
  source: /note="Description of Artificial Sequence: Synthetic peptide"
SFWSYSKHTM

SEQ ID NO: 17619 - protein, 10 aa, Artificial Sequence
  source: /note="Description of Artificial Sequence: Synthetic peptide"
SYSKHTMTGY

SEQ ID NO: 17620 - protein, 10 aa, Artificial Sequence
  source: /note="Description of Artificial Sequence: Synthetic peptide"
WSYSKHTMTG

SEQ ID NO: 17621 - protein, 10 aa, Artificial Sequence
  source: /note="Description of Artificial Sequence: Synthetic peptide"
YSKHTMTGYW

SEQ ID NO: 17622 - protein, 9 aa, Artificial Sequence
  source: /note="Description of Artificial Sequence: Synthetic peptide"
RMWNDTVQK

SEQ ID NO: 17623 - protein, 9 aa, Artificial Sequence
  source: /note="Description of Artificial Sequence: Synthetic peptide"
VQKQSESSF

SEQ ID NO: 17624 - protein, 10 aa, Artificial Sequence
  source: /note="Description of Artificial Sequence: Synthetic peptide"
TVQKQSESSF

SEQ ID NO: 17625 - protein, 10 aa, Artificial Sequence
  source: /note="Description of Artificial Sequence: Synthetic peptide"
RMWNDTVQKQ

SEQ ID NO: 17626 - protein, 10 aa, Artificial Sequence
  source: /note="Description of Artificial Sequence: Synthetic peptide"
VQKQSESSFI

SEQ ID NO: 17627 - protein, 10 aa, Artificial Sequence
  source: /note="Description of Artificial Sequence: Synthetic peptide"
FENQDIHSAL

SEQ ID NO: 17628 - protein, 9 aa, Artificial Sequence
  source: /note="Description of Artificial Sequence: Synthetic peptide"
SLCAYAVTY

SEQ ID NO: 17629 - protein, 9 aa, Artificial Sequence
  source: /note="Description of Artificial Sequence: Synthetic peptide"
DASLCAYAV

SEQ ID NO: 17630 - protein, 9 aa, Artificial Sequence
  source: /note="Description of Artificial Sequence: Synthetic peptide"
CKDASLCAY

SEQ ID NO: 17631 - protein, 10 aa, Artificial Sequence
  source: /note="Description of Artificial Sequence: Synthetic peptide"
SLCAYAVTYT

SEQ ID NO: 17632 - protein, 10 aa, Artificial Sequence
  source: /note="Description of Artificial Sequence: Synthetic peptide"
RAFPCKDASL

SEQ ID NO: 17633 - protein, 10 aa, Artificial Sequence
  source: /note="Description of Artificial Sequence: Synthetic peptide"
ASLCAYAVTY

SEQ ID NO: 17634 - protein, 10 aa, Artificial Sequence
  source: /note="Description of Artificial Sequence: Synthetic peptide"
FPCKDASLCA

SEQ ID NO: 17635 - protein, 10 aa, Artificial Sequence
  source: /note="Description of Artificial Sequence: Synthetic peptide"
KDASLCAYAV

SEQ ID NO: 17636 - protein, 9 aa, Artificial Sequence
  source: /note="Description of Artificial Sequence: Synthetic peptide"
RVSIQSSPG

SEQ ID NO: 17637 - protein, 9 aa, Artificial Sequence
  source: /note="Description of Artificial Sequence: Synthetic peptide"
IQSSPGSSQ

SEQ ID NO: 17638 - protein, 10 aa, Artificial Sequence
  source: /note="Description of Artificial Sequence: Synthetic peptide"
QSSPGSSQLV

SEQ ID NO: 17639 - protein, 10 aa, Artificial Sequence
  source: /note="Description of Artificial Sequence: Synthetic peptide"
IQSSPGSSQL

SEQ ID NO: 17640 - protein, 10 aa, Artificial Sequence
  source: /note="Description of Artificial Sequence: Synthetic peptide"
SPGSSQLVHI

SEQ ID NO: 17641 - protein, 9 aa, Artificial Sequence
  source: /note="Description of Artificial Sequence: Synthetic peptide"
LSVTSSKLY

SEQ ID NO: 17642 - protein, 9 aa, Artificial Sequence
  source: /note="Description of Artificial Sequence: Synthetic peptide"
TLSVTSSKL

SEQ ID NO: 17643 - protein, 9 aa, Artificial Sequence
  source: /note="Description of Artificial Sequence: Synthetic peptide"
GTLSVTSSK

SEQ ID NO: 17644 - protein, 9 aa, Artificial Sequence
  source: /note="Description of Artificial Sequence: Synthetic peptide"
TSSKLYFEV

SEQ ID NO: 17645 - protein, 9 aa, Artificial Sequence
  source: /note="Description of Artificial Sequence: Synthetic peptide"
SVTSSKLYF

SEQ ID NO: 17646 - protein, 10 aa, Artificial Sequence
  source: /note="Description of Artificial Sequence: Synthetic peptide"
VTSSKLYFEV

SEQ ID NO: 17647 - protein, 10 aa, Artificial Sequence
  source: /note="Description of Artificial Sequence: Synthetic peptide"
KGTLSVTSSK

SEQ ID NO: 17648 - protein, 10 aa, Artificial Sequence
  source: /note="Description of Artificial Sequence: Synthetic peptide"
TLSVTSSKLY

SEQ ID NO: 17649 - protein, 10 aa, Artificial Sequence
  source: /note="Description of Artificial Sequence: Synthetic peptide"
LSVTSSKLYF

SEQ ID NO: 17650 - protein, 10 aa, Artificial Sequence
  source: /note="Description of Artificial Sequence: Synthetic peptide"
FLGACKKLGV

SEQ ID NO: 17651 - protein, 9 aa, Artificial Sequence
  source: /note="Description of Artificial Sequence: Synthetic peptide"
ILNKNQLTL

SEQ ID NO: 17652 - protein, 9 aa, Artificial Sequence
  source: /note="Description of Artificial Sequence: Synthetic peptide"
NLHHLILNK

SEQ ID NO: 17653 - protein, 10 aa, Artificial Sequence
  source: /note="Description of Artificial Sequence: Synthetic peptide"
ILNKNQLTLI

SEQ ID NO: 17654 - protein, 10 aa, Artificial Sequence
  source: /note="Description of Artificial Sequence: Synthetic peptide"
SNLHHLILNK

SEQ ID NO: 17655 - protein, 10 aa, Artificial Sequence
  source: /note="Description of Artificial Sequence: Synthetic peptide"
LILNKNQLTL

SEQ ID NO: 17656 - protein, 9 aa, Artificial Sequence
  source: /note="Description of Artificial Sequence: Synthetic peptide"
LLLLWLVLL

SEQ ID NO: 17657 - protein, 9 aa, Artificial Sequence
  source: /note="Description of Artificial Sequence: Synthetic peptide"
LLWLVLLRL

SEQ ID NO: 17658 - protein, 9 aa, Artificial Sequence
  source: /note="Description of Artificial Sequence: Synthetic peptide"
LVLLRLEPV

SEQ ID NO: 17659 - protein, 9 aa, Artificial Sequence
  source: /note="Description of Artificial Sequence: Synthetic peptide"
LLLWLVLLR

SEQ ID NO: 17660 - protein, 10 aa, Artificial Sequence
  source: /note="Description of Artificial Sequence: Synthetic peptide"
LLLWLVLLRL

SEQ ID NO: 17661 - protein, 10 aa, Artificial Sequence
  source: /note="Description of Artificial Sequence: Synthetic peptide"
WLVLLRLEPV

SEQ ID NO: 17662 - protein, 10 aa, Artificial Sequence
  source: /note="Description of Artificial Sequence: Synthetic peptide"
SPCLLLLWLV

SEQ ID NO: 17663 - protein, 9 aa, Artificial Sequence
  source: /note="Description of Artificial Sequence: Synthetic peptide"
LLLLWLLLV

SEQ ID NO: 17664 - protein, 9 aa, Artificial Sequence
  source: /note="Description of Artificial Sequence: Synthetic peptide"
LLWLLLVRL

SEQ ID NO: 17665 - protein, 9 aa, Artificial Sequence
  source: /note="Description of Artificial Sequence: Synthetic peptide"
LLLVRLEPV

SEQ ID NO: 17666 - protein, 9 aa, Artificial Sequence
  source: /note="Description of Artificial Sequence: Synthetic peptide"
VRLEPVTAA

SEQ ID NO: 17667 - protein, 10 aa, Artificial Sequence
  source: /note="Description of Artificial Sequence: Synthetic peptide"
CLLLLWLLLV

SEQ ID NO: 17668 - protein, 10 aa, Artificial Sequence
  source: /note="Description of Artificial Sequence: Synthetic peptide"
LLLWLLLVRL

SEQ ID NO: 17669 - protein, 10 aa, Artificial Sequence
  source: /note="Description of Artificial Sequence: Synthetic peptide"
WLLLVRLEPV

SEQ ID NO: 17670 - protein, 9 aa, Artificial Sequence
  source: /note="Description of Artificial Sequence: Synthetic peptide"
ATRTPGGCH

SEQ ID NO: 17671 - protein, 10 aa, Artificial Sequence
  source: /note="Description of Artificial Sequence: Synthetic peptide"
ATRTPGGCHT

SEQ ID NO: 17672 - protein, 10 aa, Artificial Sequence
  source: /note="Description of Artificial Sequence: Synthetic peptide"
TPGGCHTDEF

SEQ ID NO: 17673 - protein, 9 aa, Artificial Sequence
  source: /note="Description of Artificial Sequence: Synthetic peptide"
TLYGGGGLL

SEQ ID NO: 17674 - protein, 9 aa, Artificial Sequence
  source: /note="Description of Artificial Sequence: Synthetic peptide"
WLRPTSGPA

SEQ ID NO: 17675 - protein, 9 aa, Artificial Sequence
  source: /note="Description of Artificial Sequence: Synthetic peptide"
PVRPMGARA

SEQ ID NO: 17676 - protein, 9 aa, Artificial Sequence
  source: /note="Description of Artificial Sequence: Synthetic peptide"
FAVTLYGGR

SEQ ID NO: 17677 - protein, 9 aa, Artificial Sequence
  source: /note="Description of Artificial Sequence: Synthetic peptide"
PATMSPWYR

SEQ ID NO: 17678 - protein, 9 aa, Artificial Sequence
  source: /note="Description of Artificial Sequence: Synthetic peptide"
TTPPASPWL

SEQ ID NO: 17679 - protein, 9 aa, Artificial Sequence
  source: /note="Description of Artificial Sequence: Synthetic peptide"
TTGPCPAPA

SEQ ID NO: 17680 - protein, 9 aa, Artificial Sequence
  source: /note="Description of Artificial Sequence: Synthetic peptide"
RPTSGPATM

SEQ ID NO: 17681 - protein, 9 aa, Artificial Sequence
  source: /note="Description of Artificial Sequence: Synthetic peptide"
PPASPWLPI

SEQ ID NO: 17682 - protein, 9 aa, Artificial Sequence
  source: /note="Description of Artificial Sequence: Synthetic peptide"
RPMGARAPA

SEQ ID NO: 17683 - protein, 9 aa, Artificial Sequence
  source: /note="Description of Artificial Sequence: Synthetic peptide"
YRGPTPSPL

SEQ ID NO: 17684 - protein, 9 aa, Artificial Sequence
  source: /note="Description of Artificial Sequence: Synthetic peptide"
CTTPPASPW

SEQ ID NO: 17685 - protein, 9 aa, Artificial Sequence
  source: /note="Description of Artificial Sequence: Synthetic peptide"
WLPIPVRPM

SEQ ID NO: 17686 - protein, 9 aa, Artificial Sequence
  source: /note="Description of Artificial Sequence: Synthetic peptide"
GPATMSPWY

SEQ ID NO: 17687 - protein, 10 aa, Artificial Sequence
  source: /note="Description of Artificial Sequence: Synthetic peptide"
TLYGGRSTGL

SEQ ID NO: 17688 - protein, 10 aa, Artificial Sequence
  source: /note="Description of Artificial Sequence: Synthetic peptide"
GLTGEQTHWL

SEQ ID NO: 17689 - protein, 10 aa, Artificial Sequence
  source: /note="Description of Artificial Sequence: Synthetic peptide"
TMSPWYRGPT

SEQ ID NO: 17690 - protein, 10 aa, Artificial Sequence
  source: /note="Description of Artificial Sequence: Synthetic peptide"
WYRGPTPSPL

SEQ ID NO: 17691 - protein, 10 aa, Artificial Sequence
  source: /note="Description of Artificial Sequence: Synthetic peptide"
HWLRPTSGPA

SEQ ID NO: 17692 - protein, 10 aa, Artificial Sequence
  source: /note="Description of Artificial Sequence: Synthetic peptide"
GARAPAPTCV

SEQ ID NO: 17693 - protein, 10 aa, Artificial Sequence
  source: /note="Description of Artificial Sequence: Synthetic peptide"
SGPATMSPWY

SEQ ID NO: 17694 - protein, 10 aa, Artificial Sequence
  source: /note="Description of Artificial Sequence: Synthetic peptide"
PFAVTLYGGR

SEQ ID NO: 17695 - protein, 10 aa, Artificial Sequence
  source: /note="Description of Artificial Sequence: Synthetic peptide"
LTGEQTHWLR

SEQ ID NO: 17696 - protein, 10 aa, Artificial Sequence
  source: /note="Description of Artificial Sequence: Synthetic peptide"
CTTPPASPWL

SEQ ID NO: 17697 - protein, 10 aa, Artificial Sequence
  source: /note="Description of Artificial Sequence: Synthetic peptide"
TTTGPCPAPA

SEQ ID NO: 17698 - protein, 10 aa, Artificial Sequence
  source: /note="Description of Artificial Sequence: Synthetic peptide"
SPWYRGPTPS

SEQ ID NO: 17699 - protein, 10 aa, Artificial Sequence
  source: /note="Description of Artificial Sequence: Synthetic peptide"
TPPASPWLPI

SEQ ID NO: 17700 - protein, 10 aa, Artificial Sequence
  source: /note="Description of Artificial Sequence: Synthetic peptide"
LPIPVRPMGA

SEQ ID NO: 17701 - protein, 10 aa, Artificial Sequence
  source: /note="Description of Artificial Sequence: Synthetic peptide"
IPVRPMGARA

SEQ ID NO: 17702 - protein, 10 aa, Artificial Sequence
  source: /note="Description of Artificial Sequence: Synthetic peptide"
RPMGARAPAP

SEQ ID NO: 17703 - protein, 10 aa, Artificial Sequence
  source: /note="Description of Artificial Sequence: Synthetic peptide"
APAPTCVSST

SEQ ID NO: 17704 - protein, 10 aa, Artificial Sequence
  source: /note="Description of Artificial Sequence: Synthetic peptide"
WLRPTSGPAT

SEQ ID NO: 17705 - protein, 10 aa, Artificial Sequence
  source: /note="Description of Artificial Sequence: Synthetic peptide"
LRPTSGPATM

SEQ ID NO: 17706 - protein, 10 aa, Artificial Sequence
  source: /note="Description of Artificial Sequence: Synthetic peptide"
TSGPATMSPW

SEQ ID NO: 17707 - protein, 10 aa, Artificial Sequence
  source: /note="Description of Artificial Sequence: Synthetic peptide"
RCTTPPASPW

SEQ ID NO: 17708 - protein, 10 aa, Artificial Sequence
  source: /note="Description of Artificial Sequence: Synthetic peptide"
GEQTHWLRPT

SEQ ID NO: 17709 - protein, 9 aa, Artificial Sequence
  source: /note="Description of Artificial Sequence: Synthetic peptide"
TLLLLLGGA

SEQ ID NO: 17710 - protein, 9 aa, Artificial Sequence
  source: /note="Description of Artificial Sequence: Synthetic peptide"
RGSGGYSAM

SEQ ID NO: 17711 - protein, 9 aa, Artificial Sequence
  source: /note="Description of Artificial Sequence: Synthetic peptide"
CPGRGSGGY

SEQ ID NO: 17712 - protein, 10 aa, Artificial Sequence
  source: /note="Description of Artificial Sequence: Synthetic peptide"
GRGSGGYSAM

SEQ ID NO: 17713 - protein, 9 aa, Artificial Sequence
  source: /note="Description of Artificial Sequence: Synthetic peptide"
GTCYGDYVK

SEQ ID NO: 17714 - protein, 10 aa, Artificial Sequence
  source: /note="Description of Artificial Sequence: Synthetic peptide"
KLDGTCYGDY

SEQ ID NO: 17715 - protein, 10 aa, Artificial Sequence
  source: /note="Description of Artificial Sequence: Synthetic peptide"
TDFKLDGTCY

SEQ ID NO: 17716 - protein, 10 aa, Artificial Sequence
  source: /note="Description of Artificial Sequence: Synthetic peptide"
TCYGDYVKIY

SEQ ID NO: 17717 - protein, 10 aa, Artificial Sequence
  source: /note="Description of Artificial Sequence: Synthetic peptide"
CSNCQCIPAK

SEQ ID NO: 17718 - protein, 9 aa, Artificial Sequence
  source: /note="Description of Artificial Sequence: Synthetic peptide"
RYGIFFWTD

SEQ ID NO: 17719 - protein, 9 aa, Artificial Sequence
  source: /note="Description of Artificial Sequence: Synthetic peptide"
ALDPRYGIF

SEQ ID NO: 17720 - protein, 9 aa, Artificial Sequence
  source: /note="Description of Artificial Sequence: Synthetic peptide"
YGIFFWTDW

SEQ ID NO: 17721 - protein, 9 aa, Artificial Sequence
  source: /note="Description of Artificial Sequence: Synthetic peptide"
DPRYGIFFW

SEQ ID NO: 17722 - protein, 10 aa, Artificial Sequence
  source: /note="Description of Artificial Sequence: Synthetic peptide"
GIFFWTDWDA

SEQ ID NO: 17723 - protein, 10 aa, Artificial Sequence
  source: /note="Description of Artificial Sequence: Synthetic peptide"
IALDPRYGIF

SEQ ID NO: 17724 - protein, 10 aa, Artificial Sequence
  source: /note="Description of Artificial Sequence: Synthetic peptide"
RYGIFFWTDW

SEQ ID NO: 17725 - protein, 10 aa, Artificial Sequence
  source: /note="Description of Artificial Sequence: Synthetic peptide"
FFWTDWDANF

SEQ ID NO: 17726 - protein, 10 aa, Artificial Sequence
  source: /note="Description of Artificial Sequence: Synthetic peptide"
ALDPRYGIFF

SEQ ID NO: 17727 - protein, 9 aa, Artificial Sequence
  source: /note="Description of Artificial Sequence: Synthetic peptide"
TSISDRPGK

SEQ ID NO: 17728 - protein, 9 aa, Artificial Sequence
  source: /note="Description of Artificial Sequence: Synthetic peptide"
DGFTSISDR

SEQ ID NO: 17729 - protein, 9 aa, Artificial Sequence
  source: /note="Description of Artificial Sequence: Synthetic peptide"
SISDRPGKR

SEQ ID NO: 17730 - protein, 10 aa, Artificial Sequence
  source: /note="Description of Artificial Sequence: Synthetic peptide"
FTSISDRPGK

SEQ ID NO: 17731 - protein, 10 aa, Artificial Sequence
  source: /note="Description of Artificial Sequence: Synthetic peptide"
TSISDRPGKR

SEQ ID NO: 17732 - protein, 9 aa, Artificial Sequence
  source: /note="Description of Artificial Sequence: Synthetic peptide"
IVVDPTVGY

SEQ ID NO: 17733 - protein, 9 aa, Artificial Sequence
  source: /note="Description of Artificial Sequence: Synthetic peptide"
LGHPRGIVV

SEQ ID NO: 17734 - protein, 10 aa, Artificial Sequence
  source: /note="Description of Artificial Sequence: Synthetic peptide"
VVDPTVGYLF

SEQ ID NO: 17735 - protein, 10 aa, Artificial Sequence
  source: /note="Description of Artificial Sequence: Synthetic peptide"
IVVDPTVGYL

SEQ ID NO: 17736 - protein, 10 aa, Artificial Sequence
  source: /note="Description of Artificial Sequence: Synthetic peptide"
GIVVDPTVGY

SEQ ID NO: 17737 - protein, 10 aa, Artificial Sequence
  source: /note="Description of Artificial Sequence: Synthetic peptide"
HPRGIVVDPT

SEQ ID NO: 17738 - protein, 9 aa, Artificial Sequence
  source: /note="Description of Artificial Sequence: Synthetic peptide"
VLGNPSFFV

SEQ ID NO: 17739 - protein, 9 aa, Artificial Sequence
  source: /note="Description of Artificial Sequence: Synthetic peptide"
VPVLGNPSF

SEQ ID NO: 17740 - protein, 9 aa, Artificial Sequence
  source: /note="Description of Artificial Sequence: Synthetic peptide"
QEDVMVPVL

SEQ ID NO: 17741 - protein, 10 aa, Artificial Sequence
  source: /note="Description of Artificial Sequence: Synthetic peptide"
VPVLGNPSFF

SEQ ID NO: 17742 - protein, 10 aa, Artificial Sequence
  source: /note="Description of Artificial Sequence: Synthetic peptide"
MVPVLGNPSF

SEQ ID NO: 17743 - protein, 10 aa, Artificial Sequence
  source: /note="Description of Artificial Sequence: Synthetic peptide"
TQEDVMVPVL

SEQ ID NO: 17744 - protein, 9 aa, Artificial Sequence
  source: /note="Description of Artificial Sequence: Synthetic peptide"
SVSDIIYFT

SEQ ID NO: 17745 - protein, 9 aa, Artificial Sequence
  source: /note="Description of Artificial Sequence: Synthetic peptide"
IIYFTQNLA

SEQ ID NO: 17746 - protein, 9 aa, Artificial Sequence
  source: /note="Description of Artificial Sequence: Synthetic peptide"
DIIYFTQNL

SEQ ID NO: 17747 - protein, 9 aa, Artificial Sequence
  source: /note="Description of Artificial Sequence: Synthetic peptide"
LDYDSVSDI

SEQ ID NO: 17748 - protein, 9 aa, Artificial Sequence
  source: /note="Description of Artificial Sequence: Synthetic peptide"
YDSVSDIIY

SEQ ID NO: 17749 - protein, 10 aa, Artificial Sequence
  source: /note="Description of Artificial Sequence: Synthetic peptide"
DSVSDIIYFT

SEQ ID NO: 17750 - protein, 10 aa, Artificial Sequence
  source: /note="Description of Artificial Sequence: Synthetic peptide"
DIIYFTQNLA

SEQ ID NO: 17751 - protein, 10 aa, Artificial Sequence
  source: /note="Description of Artificial Sequence: Synthetic peptide"
LDYDSVSDII

SEQ ID NO: 17752 - protein, 10 aa, Artificial Sequence
  source: /note="Description of Artificial Sequence: Synthetic peptide"
YDSVSDIIYF

SEQ ID NO: 17753 - protein, 10 aa, Artificial Sequence
  source: /note="Description of Artificial Sequence: Synthetic peptide"
SDIIYFTQNL

SEQ ID NO: 17754 - protein, 9 aa, Artificial Sequence
  source: /note="Description of Artificial Sequence: Synthetic peptide"
CQNGCCISK

SEQ ID NO: 17755 - protein, 10 aa, Artificial Sequence
  source: /note="Description of Artificial Sequence: Synthetic peptide"
HLFPPPPPPC

SEQ ID NO: 17756 - protein, 9 aa, Artificial Sequence
  source: /note="Description of Artificial Sequence: Synthetic peptide"
FDVTDNQIY

SEQ ID NO: 17757 - protein, 9 aa, Artificial Sequence
  source: /note="Description of Artificial Sequence: Synthetic peptide"
QIYWTDISL

SEQ ID NO: 17758 - protein, 10 aa, Artificial Sequence
  source: /note="Description of Artificial Sequence: Synthetic peptide"
NQIYWTDISL

SEQ ID NO: 17759 - protein, 10 aa, Artificial Sequence
  source: /note="Description of Artificial Sequence: Synthetic peptide"
QIYWTDISLK

SEQ ID NO: 17760 - protein, 9 aa, Artificial Sequence
  source: /note="Description of Artificial Sequence: Synthetic peptide"
KLSSKNLKL

SEQ ID NO: 17761 - protein, 10 aa, Artificial Sequence
  source: /note="Description of Artificial Sequence: Synthetic peptide"
FTKLSSKNLK

SEQ ID NO: 17762 - protein, 10 aa, Artificial Sequence
  source: /note="Description of Artificial Sequence: Synthetic peptide"
TKLSSKNLKL

SEQ ID NO: 17763 - protein, 9 aa, Artificial Sequence
  source: /note="Description of Artificial Sequence: Synthetic peptide"
ELCPVAMWV

SEQ ID NO: 17764 - protein, 9 aa, Artificial Sequence
  source: /note="Description of Artificial Sequence: Synthetic peptide"
WVAEGHNKM

SEQ ID NO: 17765 - protein, 9 aa, Artificial Sequence
  source: /note="Description of Artificial Sequence: Synthetic peptide"
QELCPVAMW

SEQ ID NO: 17766 - protein, 10 aa, Artificial Sequence
  source: /note="Description of Artificial Sequence: Synthetic peptide"
AMWVAEGHNK

SEQ ID NO: 17767 - protein, 10 aa, Artificial Sequence
  source: /note="Description of Artificial Sequence: Synthetic peptide"
MWVAEGHNKM

SEQ ID NO: 17768 - protein, 10 aa, Artificial Sequence
  source: /note="Description of Artificial Sequence: Synthetic peptide"
ELCPVAMWVA

SEQ ID NO: 17769 - protein, 10 aa, Artificial Sequence
  source: /note="Description of Artificial Sequence: Synthetic peptide"
WVAEGHNKML

SEQ ID NO: 17770 - protein, 10 aa, Artificial Sequence
  source: /note="Description of Artificial Sequence: Synthetic peptide"
QELCPVAMWV

SEQ ID NO: 17771 - protein, 9 aa, Artificial Sequence
  source: /note="Description of Artificial Sequence: Synthetic peptide"
NAWDNLNRI

SEQ ID NO: 17772 - protein, 9 aa, Artificial Sequence
  source: /note="Description of Artificial Sequence: Synthetic peptide"
CLRKCQNAW

SEQ ID NO: 17773 - protein, 10 aa, Artificial Sequence
  source: /note="Description of Artificial Sequence: Synthetic peptide"
RKCQNAWDNL

SEQ ID NO: 17774 - protein, 9 aa, Artificial Sequence
  source: /note="Description of Artificial Sequence: Synthetic peptide"
FLRASNAES

SEQ ID NO: 17775 - protein, 9 aa, Artificial Sequence
  source: /note="Description of Artificial Sequence: Synthetic peptide"
RASNAESRK

SEQ ID NO: 17776 - protein, 9 aa, Artificial Sequence
  source: /note="Description of Artificial Sequence: Synthetic peptide"
STVNKFLRA

SEQ ID NO: 17777 - protein, 10 aa, Artificial Sequence
  source: /note="Description of Artificial Sequence: Synthetic peptide"
FLRASNAESR

SEQ ID NO: 17778 - protein, 9 aa, Artificial Sequence
  source: /note="Description of Artificial Sequence: Synthetic peptide"
FSQEHKAAV

SEQ ID NO: 17779 - protein, 10 aa, Artificial Sequence
  source: /note="Description of Artificial Sequence: Synthetic peptide"
SQEHKAAVSV

SEQ ID NO: 17780 - protein, 9 aa, Artificial Sequence
  source: /note="Description of Artificial Sequence: Synthetic peptide"
HLDSPSVSV

SEQ ID NO: 17781 - protein, 10 aa, Artificial Sequence
  source: /note="Description of Artificial Sequence: Synthetic peptide"
HLDSPSVSVK

SEQ ID NO: 17782 - protein, 10 aa, Artificial Sequence
  source: /note="Description of Artificial Sequence: Synthetic peptide"
QTHHLDSPSV

SEQ ID NO: 17783 - protein, 10 aa, Artificial Sequence
  source: /note="Description of Artificial Sequence: Synthetic peptide"
HQTHHLDSPS

SEQ ID NO: 17784 - protein, 9 aa, Artificial Sequence
  source: /note="Description of Artificial Sequence: Synthetic peptide"
SSRCWAGAW

SEQ ID NO: 17785 - protein, 10 aa, Artificial Sequence
  source: /note="Description of Artificial Sequence: Synthetic peptide"
ELRQDPPSSR

SEQ ID NO: 17786 - protein, 10 aa, Artificial Sequence
  source: /note="Description of Artificial Sequence: Synthetic peptide"
RQDPPSSRCW

SEQ ID NO: 17787 - protein, 9 aa, Artificial Sequence
  source: /note="Description of Artificial Sequence: Synthetic peptide"
HSREQQPYE

SEQ ID NO: 17788 - protein, 9 aa, Artificial Sequence
  source: /note="Description of Artificial Sequence: Synthetic peptide"
SQSLQHHSR

SEQ ID NO: 17789 - protein, 9 aa, Artificial Sequence
  source: /note="Description of Artificial Sequence: Synthetic peptide"
HHSREQQPY

SEQ ID NO: 17790 - protein, 10 aa, Artificial Sequence
  source: /note="Description of Artificial Sequence: Synthetic peptide"
LMGSQSLQHH

SEQ ID NO: 17791 - protein, 10 aa, Artificial Sequence
  source: /note="Description of Artificial Sequence: Synthetic peptide"
QHHSREQQPY

SEQ ID NO: 17792 - protein, 9 aa, Artificial Sequence
  source: /note="Description of Artificial Sequence: Synthetic peptide"
VVVAAEAEV

SEQ ID NO: 17793 - protein, 9 aa, Artificial Sequence
  source: /note="Description of Artificial Sequence: Synthetic peptide"
EAAAVVVAA

SEQ ID NO: 17794 - protein, 9 aa, Artificial Sequence
  source: /note="Description of Artificial Sequence: Synthetic peptide"
MEAAAVVVA

SEQ ID NO: 17795 - protein, 10 aa, Artificial Sequence
  source: /note="Description of Artificial Sequence: Synthetic peptide"
AVVVAAEAEV

SEQ ID NO: 17796 - protein, 10 aa, Artificial Sequence
  source: /note="Description of Artificial Sequence: Synthetic peptide"
MEAAAVVVAA

SEQ ID NO: 17797 - protein, 9 aa, Artificial Sequence
  source: /note="Description of Artificial Sequence: Synthetic peptide"
LEILRCGPL

SEQ ID NO: 17798 - protein, 9 aa, Artificial Sequence
  source: /note="Description of Artificial Sequence: Synthetic peptide"
GPLDTLQQV

SEQ ID NO: 17799 - protein, 10 aa, Artificial Sequence
  source: /note="Description of Artificial Sequence: Synthetic peptide"
ILRCGPLDTL

SEQ ID NO: 17800 - protein, 9 aa, Artificial Sequence
  source: /note="Description of Artificial Sequence: Synthetic peptide"
KKKTAGKNY

SEQ ID NO: 17801 - protein, 10 aa, Artificial Sequence
  source: /note="Description of Artificial Sequence: Synthetic peptide"
FFHKKKTAGK

SEQ ID NO: 17802 - protein, 10 aa, Artificial Sequence
  source: /note="Description of Artificial Sequence: Synthetic peptide"
HKKKTAGKNY

SEQ ID NO: 17803 - protein, 9 aa, Artificial Sequence
  source: /note="Description of Artificial Sequence: Synthetic peptide"
LQWNRIRYI

SEQ ID NO: 17804 - protein, 9 aa, Artificial Sequence
  source: /note="Description of Artificial Sequence: Synthetic peptide"
RIRYISQGL

SEQ ID NO: 17805 - protein, 9 aa, Artificial Sequence
  source: /note="Description of Artificial Sequence: Synthetic peptide"
YISQGLTWT

SEQ ID NO: 17806 - protein, 9 aa, Artificial Sequence
  source: /note="Description of Artificial Sequence: Synthetic peptide"
RYISQGLTW

SEQ ID NO: 17807 - protein, 9 aa, Artificial Sequence
  source: /note="Description of Artificial Sequence: Synthetic peptide"
YLQWNRIRY

SEQ ID NO: 17808 - protein, 10 aa, Artificial Sequence
  source: /note="Description of Artificial Sequence: Synthetic peptide"
YLQWNRIRYI

SEQ ID NO: 17809 - protein, 10 aa, Artificial Sequence
  source: /note="Description of Artificial Sequence: Synthetic peptide"
IYLQWNRIRY

SEQ ID NO: 17810 - protein, 10 aa, Artificial Sequence
  source: /note="Description of Artificial Sequence: Synthetic peptide"
YISQGLTWTW

SEQ ID NO: 17811 - protein, 10 aa, Artificial Sequence
  source: /note="Description of Artificial Sequence: Synthetic peptide"
RIRYISQGLT

SEQ ID NO: 17812 - protein, 10 aa, Artificial Sequence
  source: /note="Description of Artificial Sequence: Synthetic peptide"
LQWNRIRYIS

SEQ ID NO: 17813 - protein, 10 aa, Artificial Sequence
  source: /note="Description of Artificial Sequence: Synthetic peptide"
NRIRYISQGL

SEQ ID NO: 17814 - protein, 10 aa, Artificial Sequence
  source: /note="Description of Artificial Sequence: Synthetic peptide"
IRYISQGLTW

SEQ ID NO: 17815 - protein, 9 aa, Artificial Sequence
  source: /note="Description of Artificial Sequence: Synthetic peptide"
LLRHLPLLR

SEQ ID NO: 17816 - protein, 9 aa, Artificial Sequence
  source: /note="Description of Artificial Sequence: Synthetic peptide"
LPLLRHLDL

SEQ ID NO: 17817 - protein, 9 aa, Artificial Sequence
  source: /note="Description of Artificial Sequence: Synthetic peptide"
DLLRHLPLL

SEQ ID NO: 17818 - protein, 9 aa, Artificial Sequence
  source: /note="Description of Artificial Sequence: Synthetic peptide"
RDLLRHLPL

SEQ ID NO: 17819 - protein, 9 aa, Artificial Sequence
  source: /note="Description of Artificial Sequence: Synthetic peptide"
RHLPLLRHL

SEQ ID NO: 17820 - protein, 10 aa, Artificial Sequence
  source: /note="Description of Artificial Sequence: Synthetic peptide"
DLLRHLPLLR

SEQ ID NO: 17821 - protein, 10 aa, Artificial Sequence
  source: /note="Description of Artificial Sequence: Synthetic peptide"
RDLLRHLPLL

SEQ ID NO: 17822 - protein, 10 aa, Artificial Sequence
  source: /note="Description of Artificial Sequence: Synthetic peptide"
LRHLPLLRHL

SEQ ID NO: 17823 - protein, 9 aa, Artificial Sequence
  source: /note="Description of Artificial Sequence: Synthetic peptide"
SLSLRSNRV

SEQ ID NO: 17824 - protein, 9 aa, Artificial Sequence
  source: /note="Description of Artificial Sequence: Synthetic peptide"
VQNLDRLTF

SEQ ID NO: 17825 - protein, 9 aa, Artificial Sequence
  source: /note="Description of Artificial Sequence: Synthetic peptide"
LRSNRVQNL

SEQ ID NO: 17826 - protein, 10 aa, Artificial Sequence
  source: /note="Description of Artificial Sequence: Synthetic peptide"
SLRSNRVQNL

SEQ ID NO: 17827 - protein, 10 aa, Artificial Sequence
  source: /note="Description of Artificial Sequence: Synthetic peptide"
RSNRVQNLDR

SEQ ID NO: 17828 - protein, 10 aa, Artificial Sequence
  source: /note="Description of Artificial Sequence: Synthetic peptide"
RVQNLDRLTF

SEQ ID NO: 17829 - protein, 10 aa, Artificial Sequence
  source: /note="Description of Artificial Sequence: Synthetic peptide"
RSLSLRSNRV

SEQ ID NO: 17830 - protein, 9 aa, Artificial Sequence
  source: /note="Description of Artificial Sequence: Synthetic peptide"
LLTAYGYML

SEQ ID NO: 17831 - protein, 9 aa, Artificial Sequence
  source: /note="Description of Artificial Sequence: Synthetic peptide"
TAYGYMLGF

SEQ ID NO: 17832 - protein, 9 aa, Artificial Sequence
  source: /note="Description of Artificial Sequence: Synthetic peptide"
AYGYMLGFM

SEQ ID NO: 17833 - protein, 9 aa, Artificial Sequence
  source: /note="Description of Artificial Sequence: Synthetic peptide"
GYMLGFMTA

SEQ ID NO: 17834 - protein, 9 aa, Artificial Sequence
  source: /note="Description of Artificial Sequence: Synthetic peptide"
YMLGFMTAH

SEQ ID NO: 17835 - protein, 10 aa, Artificial Sequence
  source: /note="Description of Artificial Sequence: Synthetic peptide"
LTAYGYMLGF

SEQ ID NO: 17836 - protein, 10 aa, Artificial Sequence
  source: /note="Description of Artificial Sequence: Synthetic peptide"
YMLGFMTAHG

SEQ ID NO: 17837 - protein, 10 aa, Artificial Sequence
  source: /note="Description of Artificial Sequence: Synthetic peptide"
TAYGYMLGFM

SEQ ID NO: 17838 - protein, 10 aa, Artificial Sequence
  source: /note="Description of Artificial Sequence: Synthetic peptide"
YGYMLGFMTA

SEQ ID NO: 17839 - protein, 9 aa, Artificial Sequence
  source: /note="Description of Artificial Sequence: Synthetic peptide"
EISLETSPK

SEQ ID NO: 17840 - protein, 9 aa, Artificial Sequence
  source: /note="Description of Artificial Sequence: Synthetic peptide"
QEIVIEISL

SEQ ID NO: 17841 - protein, 9 aa, Artificial Sequence
  source: /note="Description of Artificial Sequence: Synthetic peptide"
LETSPKSSA

SEQ ID NO: 17842 - protein, 10 aa, Artificial Sequence
  source: /note="Description of Artificial Sequence: Synthetic peptide"
NQEIVIEISL

SEQ ID NO: 17843 - protein, 10 aa, Artificial Sequence
  source: /note="Description of Artificial Sequence: Synthetic peptide"
LETSPKSSAL

SEQ ID NO: 17844 - protein, 9 aa, Artificial Sequence
  source: /note="Description of Artificial Sequence: Synthetic peptide"
VLLTAPLFL

SEQ ID NO: 17845 - protein, 9 aa, Artificial Sequence
  source: /note="Description of Artificial Sequence: Synthetic peptide"
LTAPLFLHF

SEQ ID NO: 17846 - protein, 9 aa, Artificial Sequence
  source: /note="Description of Artificial Sequence: Synthetic peptide"
LAVLLTAPL

SEQ ID NO: 17847 - protein, 9 aa, Artificial Sequence
  source: /note="Description of Artificial Sequence: Synthetic peptide"
TAPLFLHFL

SEQ ID NO: 17848 - protein, 9 aa, Artificial Sequence
  source: /note="Description of Artificial Sequence: Synthetic peptide"
AVLLTAPLF

SEQ ID NO: 17849 - protein, 10 aa, Artificial Sequence
  source: /note="Description of Artificial Sequence: Synthetic peptide"
LTAPLFLHFL

SEQ ID NO: 17850 - protein, 10 aa, Artificial Sequence
  source: /note="Description of Artificial Sequence: Synthetic peptide"
DLAVLLTAPL

SEQ ID NO: 17851 - protein, 10 aa, Artificial Sequence
  source: /note="Description of Artificial Sequence: Synthetic peptide"
LLTAPLFLHF

SEQ ID NO: 17852 - protein, 10 aa, Artificial Sequence
  source: /note="Description of Artificial Sequence: Synthetic peptide"
TAPLFLHFLA

SEQ ID NO: 17853 - protein, 10 aa, Artificial Sequence
  source: /note="Description of Artificial Sequence: Synthetic peptide"
LAVLLTAPLF

SEQ ID NO: 17854 - protein, 10 aa, Artificial Sequence
  source: /note="Description of Artificial Sequence: Synthetic peptide"
IEELGTEGKV

SEQ ID NO: 17855 - protein, 9 aa, Artificial Sequence
  source: /note="Description of Artificial Sequence: Synthetic peptide"
SYSKIKHLL

SEQ ID NO: 17856 - protein, 9 aa, Artificial Sequence
  source: /note="Description of Artificial Sequence: Synthetic peptide"
YSKIKHLLL

SEQ ID NO: 17857 - protein, 10 aa, Artificial Sequence
  source: /note="Description of Artificial Sequence: Synthetic peptide"
SYSKIKHLLL

SEQ ID NO: 17858 - protein, 10 aa, Artificial Sequence
  source: /note="Description of Artificial Sequence: Synthetic peptide"
LSYSKIKHLL

SEQ ID NO: 17859 - protein, 9 aa, Artificial Sequence
  source: /note="Description of Artificial Sequence: Synthetic peptide"
DMYECLCVA

SEQ ID NO: 17860 - protein, 10 aa, Artificial Sequence
  source: /note="Description of Artificial Sequence: Synthetic peptide"
YECLCVANEV

SEQ ID NO: 17861 - protein, 9 aa, Artificial Sequence
  source: /note="Description of Artificial Sequence: Synthetic peptide"
VTLPLNLSV

SEQ ID NO: 17862 - protein, 10 aa, Artificial Sequence
  source: /note="Description of Artificial Sequence: Synthetic peptide"
SVTLPLNLSV

SEQ ID NO: 17863 - protein, 9 aa, Artificial Sequence
  source: /note="Description of Artificial Sequence: Synthetic peptide"
EEKLVFIET

SEQ ID NO: 17864 - protein, 10 aa, Artificial Sequence
  source: /note="Description of Artificial Sequence: Synthetic peptide"
KLQEGCEEKL

SEQ ID NO: 17865 - protein, 10 aa, Artificial Sequence
  source: /note="Description of Artificial Sequence: Synthetic peptide"
KLVFIETGTA

SEQ ID NO: 17866 - protein, 10 aa, Artificial Sequence
  source: /note="Description of Artificial Sequence: Synthetic peptide"
QEGCEEKLVF

SEQ ID NO: 17867 - protein, 10 aa, Artificial Sequence
  source: /note="Description of Artificial Sequence: Synthetic peptide"
CEEKLVFIET

SEQ ID NO: 17868 - protein, 9 aa, Artificial Sequence
  source: /note="Description of Artificial Sequence: Synthetic peptide"
HIANHICNL

SEQ ID NO: 17869 - protein, 9 aa, Artificial Sequence
  source: /note="Description of Artificial Sequence: Synthetic peptide"
HSIHIANHI

SEQ ID NO: 17870 - protein, 9 aa, Artificial Sequence
  source: /note="Description of Artificial Sequence: Synthetic peptide"
EEDRLHSIH

SEQ ID NO: 17871 - protein, 10 aa, Artificial Sequence
  source: /note="Description of Artificial Sequence: Synthetic peptide"
HIANHICNLI

SEQ ID NO: 17872 - protein, 10 aa, Artificial Sequence
  source: /note="Description of Artificial Sequence: Synthetic peptide"
RLHSIHIANH

SEQ ID NO: 17873 - protein, 10 aa, Artificial Sequence
  source: /note="Description of Artificial Sequence: Synthetic peptide"
FEEDRLHSIH

SEQ ID NO: 17874 - protein, 10 aa, Artificial Sequence
  source: /note="Description of Artificial Sequence: Synthetic peptide"
IHIANHICNL

SEQ ID NO: 17875 - protein, 10 aa, Artificial Sequence
  source: /note="Description of Artificial Sequence: Synthetic peptide"
EEDRLHSIHI

SEQ ID NO: 17876 - protein, 9 aa, Artificial Sequence
  source: /note="Description of Artificial Sequence: Synthetic peptide"
KLEGLELEV

SEQ ID NO: 17877 - protein, 10 aa, Artificial Sequence
  source: /note="Description of Artificial Sequence: Synthetic peptide"
GKLEGLELEV

SEQ ID NO: 17878 - protein, 9 aa, Artificial Sequence
  source: /note="Description of Artificial Sequence: Synthetic peptide"
SSLSLESWR

SEQ ID NO: 17879 - protein, 9 aa, Artificial Sequence
  source: /note="Description of Artificial Sequence: Synthetic peptide"
HTMPTSAAH

SEQ ID NO: 17880 - protein, 9 aa, Artificial Sequence
  source: /note="Description of Artificial Sequence: Synthetic peptide"
SWRRTWRRS

SEQ ID NO: 17881 - protein, 9 aa, Artificial Sequence
  source: /note="Description of Artificial Sequence: Synthetic peptide"
ESWRRTWRR

SEQ ID NO: 17882 - protein, 9 aa, Artificial Sequence
  source: /note="Description of Artificial Sequence: Synthetic peptide"
ESSGHTMPT

SEQ ID NO: 17883 - protein, 9 aa, Artificial Sequence
  source: /note="Description of Artificial Sequence: Synthetic peptide"
SPPAQAVML

SEQ ID NO: 17884 - protein, 9 aa, Artificial Sequence
  source: /note="Description of Artificial Sequence: Synthetic peptide"
MPESSGHTM

SEQ ID NO: 17885 - protein, 9 aa, Artificial Sequence
  source: /note="Description of Artificial Sequence: Synthetic peptide"
AAHHQSSSL

SEQ ID NO: 17886 - protein, 9 aa, Artificial Sequence
  source: /note="Description of Artificial Sequence: Synthetic peptide"
TESPPAQAV

SEQ ID NO: 17887 - protein, 9 aa, Artificial Sequence
  source: /note="Description of Artificial Sequence: Synthetic peptide"
HHQSSSLSL

SEQ ID NO: 17888 - protein, 9 aa, Artificial Sequence
  source: /note="Description of Artificial Sequence: Synthetic peptide"
SSSLSLESW

SEQ ID NO: 17889 - protein, 9 aa, Artificial Sequence
  source: /note="Description of Artificial Sequence: Synthetic peptide"
SLESWRRTW

SEQ ID NO: 17890 - protein, 10 aa, Artificial Sequence
  source: /note="Description of Artificial Sequence: Synthetic peptide"
RMPESSGHTM

SEQ ID NO: 17891 - protein, 10 aa, Artificial Sequence
  source: /note="Description of Artificial Sequence: Synthetic peptide"
SSSLSLESWR

SEQ ID NO: 17892 - protein, 10 aa, Artificial Sequence
  source: /note="Description of Artificial Sequence: Synthetic peptide"
SSLSLESWRR

SEQ ID NO: 17893 - protein, 10 aa, Artificial Sequence
  source: /note="Description of Artificial Sequence: Synthetic peptide"
MLRMPESSGH

SEQ ID NO: 17894 - protein, 10 aa, Artificial Sequence
  source: /note="Description of Artificial Sequence: Synthetic peptide"
HTMPTSAAHH

SEQ ID NO: 17895 - protein, 10 aa, Artificial Sequence
  source: /note="Description of Artificial Sequence: Synthetic peptide"
SLESWRRTWR

SEQ ID NO: 17896 - protein, 10 aa, Artificial Sequence
  source: /note="Description of Artificial Sequence: Synthetic peptide"
SAAHHQSSSL

SEQ ID NO: 17897 - protein, 10 aa, Artificial Sequence
  source: /note="Description of Artificial Sequence: Synthetic peptide"
TESPPAQAVM

SEQ ID NO: 17898 - protein, 10 aa, Artificial Sequence
  source: /note="Description of Artificial Sequence: Synthetic peptide"
AHHQSSSLSL

SEQ ID NO: 17899 - protein, 10 aa, Artificial Sequence
  source: /note="Description of Artificial Sequence: Synthetic peptide"
HQSSSLSLES

SEQ ID NO: 17900 - protein, 10 aa, Artificial Sequence
  source: /note="Description of Artificial Sequence: Synthetic peptide"
QSSSLSLESW

SEQ ID NO: 17901 - protein, 10 aa, Artificial Sequence
  source: /note="Description of Artificial Sequence: Synthetic peptide"
LSLESWRRTW

SEQ ID NO: 17902 - protein, 10 aa, Artificial Sequence
  source: /note="Description of Artificial Sequence: Synthetic peptide"
MPTSAAHHQS

SEQ ID NO: 17903 - protein, 9 aa, Artificial Sequence
  source: /note="Description of Artificial Sequence: Synthetic peptide"
VLDAGCYQK

SEQ ID NO: 17904 - protein, 9 aa, Artificial Sequence
  source: /note="Description of Artificial Sequence: Synthetic peptide"
MVVLDAGCY

SEQ ID NO: 17905 - protein, 9 aa, Artificial Sequence
  source: /note="Description of Artificial Sequence: Synthetic peptide"
DAGCYQKLR

SEQ ID NO: 17906 - protein, 10 aa, Artificial Sequence
  source: /note="Description of Artificial Sequence: Synthetic peptide"
VLDAGCYQKL

SEQ ID NO: 17907 - protein, 10 aa, Artificial Sequence
  source: /note="Description of Artificial Sequence: Synthetic peptide"
VVLDAGCYQK

SEQ ID NO: 17908 - protein, 10 aa, Artificial Sequence
  source: /note="Description of Artificial Sequence: Synthetic peptide"
KMVVLDAGCY

SEQ ID NO: 17909 - protein, 9 aa, Artificial Sequence
  source: /note="Description of Artificial Sequence: Synthetic peptide"
CGRLIAGAR

SEQ ID NO: 17910 - protein, 10 aa, Artificial Sequence
  source: /note="Description of Artificial Sequence: Synthetic peptide"
SQCGRLIAGA

SEQ ID NO: 17911 - protein, 10 aa, Artificial Sequence
  source: /note="Description of Artificial Sequence: Synthetic peptide"
RLIAGARCPP

SEQ ID NO: 17912 - protein, 9 aa, Artificial Sequence
  source: /note="Description of Artificial Sequence: Synthetic peptide"
GEDSMSPHY

SEQ ID NO: 17913 - protein, 9 aa, Artificial Sequence
  source: /note="Description of Artificial Sequence: Synthetic peptide"
SMSPHYFPQ

SEQ ID NO: 17914 - protein, 10 aa, Artificial Sequence
  source: /note="Description of Artificial Sequence: Synthetic peptide"
SMSPHYFPQS

SEQ ID NO: 17915 - protein, 10 aa, Artificial Sequence
  source: /note="Description of Artificial Sequence: Synthetic peptide"
QGEDSMSPHY

SEQ ID NO: 17916 - protein, 10 aa, Artificial Sequence
  source: /note="Description of Artificial Sequence: Synthetic peptide"
SPHYFPQSPL

SEQ ID NO: 17917 - protein, 10 aa, Artificial Sequence
  source: /note="Description of Artificial Sequence: Synthetic peptide"
GEDSMSPHYF

SEQ ID NO: 17918 - protein, 9 aa, Artificial Sequence
  source: /note="Description of Artificial Sequence: Synthetic peptide"
IPVSSSSST

SEQ ID NO: 17919 - protein, 9 aa, Artificial Sequence
  source: /note="Description of Artificial Sequence: Synthetic peptide"
VSSSSSTLL

SEQ ID NO: 17920 - protein, 10 aa, Artificial Sequence
  source: /note="Description of Artificial Sequence: Synthetic peptide"
IPVSSSSSTL

SEQ ID NO: 17921 - protein, 9 aa, Artificial Sequence
  source: /note="Description of Artificial Sequence: Synthetic peptide"
ASDGSDTSM

SEQ ID NO: 17922 - protein, 10 aa, Artificial Sequence
  source: /note="Description of Artificial Sequence: Synthetic peptide"
SMPPTPGEGA

SEQ ID NO: 17923 - protein, 10 aa, Artificial Sequence
  source: /note="Description of Artificial Sequence: Synthetic peptide"
TASDGSDTSM

SEQ ID NO: 17924 - protein, 9 aa, Artificial Sequence
  source: /note="Description of Artificial Sequence: Synthetic peptide"
MLVVDAPSA

SEQ ID NO: 17925 - protein, 9 aa, Artificial Sequence
  source: /note="Description of Artificial Sequence: Synthetic peptide"
LVVDAPSAL

SEQ ID NO: 17926 - protein, 9 aa, Artificial Sequence
  source: /note="Description of Artificial Sequence: Synthetic peptide"
TLSVSTLPR

SEQ ID NO: 17927 - protein, 9 aa, Artificial Sequence
  source: /note="Description of Artificial Sequence: Synthetic peptide"
VVDAPSALR

SEQ ID NO: 17928 - protein, 9 aa, Artificial Sequence
  source: /note="Description of Artificial Sequence: Synthetic peptide"
VSTLPRPFR

SEQ ID NO: 17929 - protein, 9 aa, Artificial Sequence
  source: /note="Description of Artificial Sequence: Synthetic peptide"
TLPRPFRTR

SEQ ID NO: 17930 - protein, 9 aa, Artificial Sequence
  source: /note="Description of Artificial Sequence: Synthetic peptide"
PFRTRMTWR

SEQ ID NO: 17931 - protein, 9 aa, Artificial Sequence
  source: /note="Description of Artificial Sequence: Synthetic peptide"
SALRRQSTL

SEQ ID NO: 17932 - protein, 9 aa, Artificial Sequence
  source: /note="Description of Artificial Sequence: Synthetic peptide"
LPRPFRTRM

SEQ ID NO: 17933 - protein, 9 aa, Artificial Sequence
  source: /note="Description of Artificial Sequence: Synthetic peptide"
RPFRTRMTW

SEQ ID NO: 17934 - protein, 9 aa, Artificial Sequence
  source: /note="Description of Artificial Sequence: Synthetic peptide"
LRRQSTLSV

SEQ ID NO: 17935 - protein, 9 aa, Artificial Sequence
  source: /note="Description of Artificial Sequence: Synthetic peptide"
RQSTLSVST

SEQ ID NO: 17936 - protein, 9 aa, Artificial Sequence
  source: /note="Description of Artificial Sequence: Synthetic peptide"
QSTLSVSTL

SEQ ID NO: 17937 - protein, 9 aa, Artificial Sequence
  source: /note="Description of Artificial Sequence: Synthetic peptide"
SVSTLPRPF

SEQ ID NO: 17938 - protein, 10 aa, Artificial Sequence
  source: /note="Description of Artificial Sequence: Synthetic peptide"
SMLVVDAPSA

SEQ ID NO: 17939 - protein, 10 aa, Artificial Sequence
  source: /note="Description of Artificial Sequence: Synthetic peptide"
MLVVDAPSAL

SEQ ID NO: 17940 - protein, 10 aa, Artificial Sequence
  source: /note="Description of Artificial Sequence: Synthetic peptide"
ALRRQSTLSV

SEQ ID NO: 17941 - protein, 10 aa, Artificial Sequence
  source: /note="Description of Artificial Sequence: Synthetic peptide"
RQSTLSVSTL

SEQ ID NO: 17942 - protein, 10 aa, Artificial Sequence
  source: /note="Description of Artificial Sequence: Synthetic peptide"
STLSVSTLPR

SEQ ID NO: 17943 - protein, 10 aa, Artificial Sequence
  source: /note="Description of Artificial Sequence: Synthetic peptide"
LVVDAPSALR

SEQ ID NO: 17944 - protein, 10 aa, Artificial Sequence
  source: /note="Description of Artificial Sequence: Synthetic peptide"
VVDAPSALRR

SEQ ID NO: 17945 - protein, 10 aa, Artificial Sequence
  source: /note="Description of Artificial Sequence: Synthetic peptide"
SVSTLPRPFR

SEQ ID NO: 17946 - protein, 10 aa, Artificial Sequence
  source: /note="Description of Artificial Sequence: Synthetic peptide"
STLPRPFRTR

SEQ ID NO: 17947 - protein, 10 aa, Artificial Sequence
  source: /note="Description of Artificial Sequence: Synthetic peptide"
RPFRTRMTWR

SEQ ID NO: 17948 - protein, 10 aa, Artificial Sequence
  source: /note="Description of Artificial Sequence: Synthetic peptide"
APSALRRQST

SEQ ID NO: 17949 - protein, 10 aa, Artificial Sequence
  source: /note="Description of Artificial Sequence: Synthetic peptide"
LPRPFRTRMT

SEQ ID NO: 17950 - protein, 10 aa, Artificial Sequence
  source: /note="Description of Artificial Sequence: Synthetic peptide"
LSVSTLPRPF

SEQ ID NO: 17951 - protein, 10 aa, Artificial Sequence
  source: /note="Description of Artificial Sequence: Synthetic peptide"
RRQSTLSVST

SEQ ID NO: 17952 - protein, 9 aa, Artificial Sequence
  source: /note="Description of Artificial Sequence: Synthetic peptide"
YVLRLAEDV

SEQ ID NO: 17953 - protein, 9 aa, Artificial Sequence
  source: /note="Description of Artificial Sequence: Synthetic peptide"
VPAERCGKM

SEQ ID NO: 17954 - protein, 10 aa, Artificial Sequence
  source: /note="Description of Artificial Sequence: Synthetic peptide"
RLAEDVPAER

SEQ ID NO: 17955 - protein, 9 aa, Artificial Sequence
  source: /note="Description of Artificial Sequence: Synthetic peptide"
GGRRVCLFL

SEQ ID NO: 17956 - protein, 9 aa, Artificial Sequence
  source: /note="Description of Artificial Sequence: Synthetic peptide"
GRRVCLFLK

SEQ ID NO: 17957 - protein, 10 aa, Artificial Sequence
  source: /note="Description of Artificial Sequence: Synthetic peptide"
GGRRVCLFLK

SEQ ID NO: 17958 - protein, 10 aa, Artificial Sequence
  source: /note="Description of Artificial Sequence: Synthetic peptide"
IKNGGRRVCL

SEQ ID NO: 17959 - protein, 10 aa, Artificial Sequence
  source: /note="Description of Artificial Sequence: Synthetic peptide"
KNGGRRVCLF

SEQ ID NO: 17960 - protein, 9 aa, Artificial Sequence
  source: /note="Description of Artificial Sequence: Synthetic peptide"
EFMQVKSVI

SEQ ID NO: 17961 - protein, 9 aa, Artificial Sequence
  source: /note="Description of Artificial Sequence: Synthetic peptide"
MQVKSVIPD

SEQ ID NO: 17962 - protein, 9 aa, Artificial Sequence
  source: /note="Description of Artificial Sequence: Synthetic peptide"
DEFMQVKSV

SEQ ID NO: 17963 - protein, 10 aa, Artificial Sequence
  source: /note="Description of Artificial Sequence: Synthetic peptide"
MQVKSVIPDG

SEQ ID NO: 17964 - protein, 10 aa, Artificial Sequence
  source: /note="Description of Artificial Sequence: Synthetic peptide"
DEFMQVKSVI

SEQ ID NO: 17965 - protein, 9 aa, Artificial Sequence
  source: /note="Description of Artificial Sequence: Synthetic peptide"
STATPNSPI

SEQ ID NO: 17966 - protein, 10 aa, Artificial Sequence
  source: /note="Description of Artificial Sequence: Synthetic peptide"
STATPNSPIA

SEQ ID NO: 17967 - protein, 10 aa, Artificial Sequence
  source: /note="Description of Artificial Sequence: Synthetic peptide"
SPLAQPSTAT

SEQ ID NO: 17968 - protein, 10 aa, Artificial Sequence
  source: /note="Description of Artificial Sequence: Synthetic peptide"
QQSPLAQPST

SEQ ID NO: 17969 - protein, 9 aa, Artificial Sequence
  source: /note="Description of Artificial Sequence: Synthetic peptide"
LLHYTQQQK

SEQ ID NO: 17970 - protein, 10 aa, Artificial Sequence
  source: /note="Description of Artificial Sequence: Synthetic peptide"
SLLHYTQQQK

SEQ ID NO: 17971 - protein, 10 aa, Artificial Sequence
  source: /note="Description of Artificial Sequence: Synthetic peptide"
STATATLQLL

SEQ ID NO: 17972 - protein, 9 aa, Artificial Sequence
  source: /note="Description of Artificial Sequence: Synthetic peptide"
SPSPPPTQV

SEQ ID NO: 17973 - protein, 9 aa, Artificial Sequence
  source: /note="Description of Artificial Sequence: Synthetic peptide"
LLNVSPGGA

SEQ ID NO: 17974 - protein, 9 aa, Artificial Sequence
  source: /note="Description of Artificial Sequence: Synthetic peptide"
RGHDRPWRR

SEQ ID NO: 17975 - protein, 9 aa, Artificial Sequence
  source: /note="Description of Artificial Sequence: Synthetic peptide"
VSRVIRPLR

SEQ ID NO: 17976 - protein, 9 aa, Artificial Sequence
  source: /note="Description of Artificial Sequence: Synthetic peptide"
DGAPGLFLR

SEQ ID NO: 17977 - protein, 9 aa, Artificial Sequence
  source: /note="Description of Artificial Sequence: Synthetic peptide"
DVSRVIRPL

SEQ ID NO: 17978 - protein, 9 aa, Artificial Sequence
  source: /note="Description of Artificial Sequence: Synthetic peptide"
GPQDGAPGL

SEQ ID NO: 17979 - protein, 9 aa, Artificial Sequence
  source: /note="Description of Artificial Sequence: Synthetic peptide"
RPWRRGCQG

SEQ ID NO: 17980 - protein, 9 aa, Artificial Sequence
  source: /note="Description of Artificial Sequence: Synthetic peptide"
RPLRHQTWA

SEQ ID NO: 17981 - protein, 9 aa, Artificial Sequence
  source: /note="Description of Artificial Sequence: Synthetic peptide"
FLRGHDRPW

SEQ ID NO: 17982 - protein, 10 aa, Artificial Sequence
  source: /note="Description of Artificial Sequence: Synthetic peptide"
YLLNVSPGGA

SEQ ID NO: 17983 - protein, 10 aa, Artificial Sequence
  source: /note="Description of Artificial Sequence: Synthetic peptide"
LFLRGHDRPW

SEQ ID NO: 17984 - protein, 10 aa, Artificial Sequence
  source: /note="Description of Artificial Sequence: Synthetic peptide"
QGRKEGPLPR

SEQ ID NO: 17985 - protein, 10 aa, Artificial Sequence
  source: /note="Description of Artificial Sequence: Synthetic peptide"
RARSPDHQDV

SEQ ID NO: 17986 - protein, 10 aa, Artificial Sequence
  source: /note="Description of Artificial Sequence: Synthetic peptide"
VSRVIRPLRH

SEQ ID NO: 17987 - protein, 10 aa, Artificial Sequence
  source: /note="Description of Artificial Sequence: Synthetic peptide"
FLRGHDRPWR

SEQ ID NO: 17988 - protein, 10 aa, Artificial Sequence
  source: /note="Description of Artificial Sequence: Synthetic peptide"
DVSRVIRPLR

SEQ ID NO: 17989 - protein, 10 aa, Artificial Sequence
  source: /note="Description of Artificial Sequence: Synthetic peptide"
VIRPLRHQTW

SEQ ID NO: 17990 - protein, 9 aa, Artificial Sequence
  source: /note="Description of Artificial Sequence: Synthetic peptide"
LTPPAVPPV

SEQ ID NO: 17991 - protein, 10 aa, Artificial Sequence
  source: /note="Description of Artificial Sequence: Synthetic peptide"
SLTPPAVPPV

SEQ ID NO: 17992 - protein, 9 aa, Artificial Sequence
  source: /note="Description of Artificial Sequence: Synthetic peptide"
ETADKITRT

SEQ ID NO: 17993 - protein, 10 aa, Artificial Sequence
  source: /note="Description of Artificial Sequence: Synthetic peptide"
STYCYETADK

SEQ ID NO: 17994 - protein, 10 aa, Artificial Sequence
  source: /note="Description of Artificial Sequence: Synthetic peptide"
TYCYETADKI

SEQ ID NO: 17995 - protein, 9 aa, Artificial Sequence
  source: /note="Description of Artificial Sequence: Synthetic peptide"
RTLACVCAL

SEQ ID NO: 17996 - protein, 9 aa, Artificial Sequence
  source: /note="Description of Artificial Sequence: Synthetic peptide"
TLACVCALL

SEQ ID NO: 17997 - protein, 9 aa, Artificial Sequence
  source: /note="Description of Artificial Sequence: Synthetic peptide"
AERTLACVC

SEQ ID NO: 17998 - protein, 10 aa, Artificial Sequence
  source: /note="Description of Artificial Sequence: Synthetic peptide"
RTLACVCALL

SEQ ID NO: 17999 - protein, 10 aa, Artificial Sequence
  source: /note="Description of Artificial Sequence: Synthetic peptide"
TLACVCALLV

SEQ ID NO: 18000 - protein, 10 aa, Artificial Sequence
  source: /note="Description of Artificial Sequence: Synthetic peptide"
LACVCALLVW

SEQ ID NO: 18001 - protein, 10 aa, Artificial Sequence
  source: /note="Description of Artificial Sequence: Synthetic peptide"
AERTLACVCA

SEQ ID NO: 18002 - protein, 9 aa, Artificial Sequence
  source: /note="Description of Artificial Sequence: Synthetic peptide"
SALIENSSI

SEQ ID NO: 18003 - protein, 9 aa, Artificial Sequence
  source: /note="Description of Artificial Sequence: Synthetic peptide"
IENSSIQEL

SEQ ID NO: 18004 - protein, 10 aa, Artificial Sequence
  source: /note="Description of Artificial Sequence: Synthetic peptide"
IENSSIQELF

SEQ ID NO: 18005 - protein, 9 aa, Artificial Sequence
  source: /note="Description of Artificial Sequence: Synthetic peptide"
SLQEIHFKT

SEQ ID NO: 18006 - protein, 9 aa, Artificial Sequence
  source: /note="Description of Artificial Sequence: Synthetic peptide"
LSLQEIHFK

SEQ ID NO: 18007 - protein, 9 aa, Artificial Sequence
  source: /note="Description of Artificial Sequence: Synthetic peptide"
KNRSSGPLS

SEQ ID NO: 18008 - protein, 9 aa, Artificial Sequence
  source: /note="Description of Artificial Sequence: Synthetic peptide"
HFKTCYQIY

SEQ ID NO: 18009 - protein, 9 aa, Artificial Sequence
  source: /note="Description of Artificial Sequence: Synthetic peptide"
KKNRSSGPL

SEQ ID NO: 18010 - protein, 9 aa, Artificial Sequence
  source: /note="Description of Artificial Sequence: Synthetic peptide"
NRSSGPLSL

SEQ ID NO: 18011 - protein, 9 aa, Artificial Sequence
  source: /note="Description of Artificial Sequence: Synthetic peptide"
QEIHFKTCY

SEQ ID NO: 18012 - protein, 9 aa, Artificial Sequence
  source: /note="Description of Artificial Sequence: Synthetic peptide"
IHFKTCYQI

SEQ ID NO: 18013 - protein, 10 aa, Artificial Sequence
  source: /note="Description of Artificial Sequence: Synthetic peptide"
KNRSSGPLSL

SEQ ID NO: 18014 - protein, 10 aa, Artificial Sequence
  source: /note="Description of Artificial Sequence: Synthetic peptide"
IHFKTCYQIY

SEQ ID NO: 18015 - protein, 10 aa, Artificial Sequence
  source: /note="Description of Artificial Sequence: Synthetic peptide"
EIHFKTCYQI

SEQ ID NO: 18016 - protein, 10 aa, Artificial Sequence
  source: /note="Description of Artificial Sequence: Synthetic peptide"
AKKNRSSGPL

SEQ ID NO: 18017 - protein, 10 aa, Artificial Sequence
  source: /note="Description of Artificial Sequence: Synthetic peptide"
LQEIHFKTCY

SEQ ID NO: 18018 - protein, 9 aa, Artificial Sequence
  source: /note="Description of Artificial Sequence: Synthetic peptide"
TQNQKVGEL

SEQ ID NO: 18019 - protein, 10 aa, Artificial Sequence
  source: /note="Description of Artificial Sequence: Synthetic peptide"
TQNQKVGELK

SEQ ID NO: 18020 - protein, 10 aa, Artificial Sequence
  source: /note="Description of Artificial Sequence: Synthetic peptide"
EAFLTQNQKV

SEQ ID NO: 18021 - protein, 9 aa, Artificial Sequence
  source: /note="Description of Artificial Sequence: Synthetic peptide"
TQNQKVGEL

SEQ ID NO: 18022 - protein, 10 aa, Artificial Sequence
  source: /note="Description of Artificial Sequence: Synthetic peptide"
TQNQKVGELK

SEQ ID NO: 18023 - protein, 10 aa, Artificial Sequence
  source: /note="Description of Artificial Sequence: Synthetic peptide"
EAFLTQNQKV

SEQ ID NO: 18024 - protein, 9 aa, Artificial Sequence
  source: /note="Description of Artificial Sequence: Synthetic peptide"
NSSYIVGFY

SEQ ID NO: 18025 - protein, 9 aa, Artificial Sequence
  source: /note="Description of Artificial Sequence: Synthetic peptide"
SYIVGFYGA

SEQ ID NO: 18026 - protein, 9 aa, Artificial Sequence
  source: /note="Description of Artificial Sequence: Synthetic peptide"
VLHECNSSY

SEQ ID NO: 18027 - protein, 9 aa, Artificial Sequence
  source: /note="Description of Artificial Sequence: Synthetic peptide"
HECNSSYIV

SEQ ID NO: 18028 - protein, 9 aa, Artificial Sequence
  source: /note="Description of Artificial Sequence: Synthetic peptide"
CNSSYIVGF

SEQ ID NO: 18029 - protein, 10 aa, Artificial Sequence
  source: /note="Description of Artificial Sequence: Synthetic peptide"
CNSSYIVGFY

SEQ ID NO: 18030 - protein, 10 aa, Artificial Sequence
  source: /note="Description of Artificial Sequence: Synthetic peptide"
VLHECNSSYI

SEQ ID NO: 18031 - protein, 10 aa, Artificial Sequence
  source: /note="Description of Artificial Sequence: Synthetic peptide"
SYIVGFYGAF

SEQ ID NO: 18032 - protein, 10 aa, Artificial Sequence
  source: /note="Description of Artificial Sequence: Synthetic peptide"
SSYIVGFYGA

SEQ ID NO: 18033 - protein, 10 aa, Artificial Sequence
  source: /note="Description of Artificial Sequence: Synthetic peptide"
QVLHECNSSY

SEQ ID NO: 18034 - protein, 9 aa, Artificial Sequence
  source: /note="Description of Artificial Sequence: Synthetic peptide"
MSTLFDKFY

SEQ ID NO: 18035 - protein, 9 aa, Artificial Sequence
  source: /note="Description of Artificial Sequence: Synthetic peptide"
STLFDKFYK

SEQ ID NO: 18036 - protein, 9 aa, Artificial Sequence
  source: /note="Description of Artificial Sequence: Synthetic peptide"
TLFDKFYKY

SEQ ID NO: 18037 - protein, 9 aa, Artificial Sequence
  source: /note="Description of Artificial Sequence: Synthetic peptide"
ELMSTLFDK

SEQ ID NO: 18038 - protein, 9 aa, Artificial Sequence
  source: /note="Description of Artificial Sequence: Synthetic peptide"
LMSTLFDKF

SEQ ID NO: 18039 - protein, 9 aa, Artificial Sequence
  source: /note="Description of Artificial Sequence: Synthetic peptide"
ICMELMSTL

SEQ ID NO: 18040 - protein, 9 aa, Artificial Sequence
  source: /note="Description of Artificial Sequence: Synthetic peptide"
CMELMSTLF

SEQ ID NO: 18041 - protein, 10 aa, Artificial Sequence
  source: /note="Description of Artificial Sequence: Synthetic peptide"
LMSTLFDKFY

SEQ ID NO: 18042 - protein, 10 aa, Artificial Sequence
  source: /note="Description of Artificial Sequence: Synthetic peptide"
STLFDKFYKY

SEQ ID NO: 18043 - protein, 10 aa, Artificial Sequence
  source: /note="Description of Artificial Sequence: Synthetic peptide"
LFDKFYKYVY

SEQ ID NO: 18044 - protein, 10 aa, Artificial Sequence
  source: /note="Description of Artificial Sequence: Synthetic peptide"
TLFDKFYKYV

SEQ ID NO: 18045 - protein, 10 aa, Artificial Sequence
  source: /note="Description of Artificial Sequence: Synthetic peptide"
WICMELMSTL

SEQ ID NO: 18046 - protein, 10 aa, Artificial Sequence
  source: /note="Description of Artificial Sequence: Synthetic peptide"
MSTLFDKFYK

SEQ ID NO: 18047 - protein, 10 aa, Artificial Sequence
  source: /note="Description of Artificial Sequence: Synthetic peptide"
ICMELMSTLF

SEQ ID NO: 18048 - protein, 10 aa, Artificial Sequence
  source: /note="Description of Artificial Sequence: Synthetic peptide"
ELMSTLFDKF

SEQ ID NO: 18049 - protein, 9 aa, Artificial Sequence
  source: /note="Description of Artificial Sequence: Synthetic peptide"
IIGQLVDSI

SEQ ID NO: 18050 - protein, 9 aa, Artificial Sequence
  source: /note="Description of Artificial Sequence: Synthetic peptide"
IKLCDFGII

SEQ ID NO: 18051 - protein, 10 aa, Artificial Sequence
  source: /note="Description of Artificial Sequence: Synthetic peptide"
GIIGQLVDSI

SEQ ID NO: 18052 - protein, 9 aa, Artificial Sequence
  source: /note="Description of Artificial Sequence: Synthetic peptide"
SIAKTRCWL

SEQ ID NO: 18053 - protein, 9 aa, Artificial Sequence
  source: /note="Description of Artificial Sequence: Synthetic peptide"
DVHSDVWSL

SEQ ID NO: 18054 - protein, 10 aa, Artificial Sequence
  source: /note="Description of Artificial Sequence: Synthetic peptide"
RQGYDVHSDV

SEQ ID NO: 18055 - protein, 10 aa, Artificial Sequence
  source: /note="Description of Artificial Sequence: Synthetic peptide"
QGYDVHSDVW

SEQ ID NO: 18056 - protein, 10 aa, Artificial Sequence
  source: /note="Description of Artificial Sequence: Synthetic peptide"
YDVHSDVWSL

SEQ ID NO: 18057 - protein, 10 aa, Artificial Sequence
  source: /note="Description of Artificial Sequence: Synthetic peptide"
RALEERRSQR

SEQ ID NO: 18058 - protein, 9 aa, Artificial Sequence
  source: /note="Description of Artificial Sequence: Synthetic peptide"
LIDCCWNFL

SEQ ID NO: 18059 - protein, 9 aa, Artificial Sequence
  source: /note="Description of Artificial Sequence: Synthetic peptide"
FLLNFILIL

SEQ ID NO: 18060 - protein, 9 aa, Artificial Sequence
  source: /note="Description of Artificial Sequence: Synthetic peptide"
FILILSVLM

SEQ ID NO: 18061 - protein, 9 aa, Artificial Sequence
  source: /note="Description of Artificial Sequence: Synthetic peptide"
VLMFHKLSL

SEQ ID NO: 18062 - protein, 9 aa, Artificial Sequence
  source: /note="Description of Artificial Sequence: Synthetic peptide"
LMFHKLSLL

SEQ ID NO: 18063 - protein, 9 aa, Artificial Sequence
  source: /note="Description of Artificial Sequence: Synthetic peptide"
KLSLLKSGI

SEQ ID NO: 18064 - protein, 9 aa, Artificial Sequence
  source: /note="Description of Artificial Sequence: Synthetic peptide"
ILSVLMFHK

SEQ ID NO: 18065 - protein, 9 aa, Artificial Sequence
  source: /note="Description of Artificial Sequence: Synthetic peptide"
MFHKLSLLK

SEQ ID NO: 18066 - protein, 9 aa, Artificial Sequence
  source: /note="Description of Artificial Sequence: Synthetic peptide"
CLIDCCWNF

SEQ ID NO: 18067 - protein, 9 aa, Artificial Sequence
  source: /note="Description of Artificial Sequence: Synthetic peptide"
CWNFLLNFI

SEQ ID NO: 18068 - protein, 9 aa, Artificial Sequence
  source: /note="Description of Artificial Sequence: Synthetic peptide"
NFLLNFILI

SEQ ID NO: 18069 - protein, 9 aa, Artificial Sequence
  source: /note="Description of Artificial Sequence: Synthetic peptide"
ILILSVLMF

SEQ ID NO: 18070 - protein, 9 aa, Artificial Sequence
  source: /note="Description of Artificial Sequence: Synthetic peptide"
CCWNFLLNF

SEQ ID NO: 18071 - protein, 9 aa, Artificial Sequence
  source: /note="Description of Artificial Sequence: Synthetic peptide"
WNFLLNFIL

SEQ ID NO: 18072 - protein, 9 aa, Artificial Sequence
  source: /note="Description of Artificial Sequence: Synthetic peptide"
LSVLMFHKL

SEQ ID NO: 18073 - protein, 10 aa, Artificial Sequence
  source: /note="Description of Artificial Sequence: Synthetic peptide"
CLIDCCWNFL

SEQ ID NO: 18074 - protein, 10 aa, Artificial Sequence
  source: /note="Description of Artificial Sequence: Synthetic peptide"
LIDCCWNFLL

SEQ ID NO: 18075 - protein, 10 aa, Artificial Sequence
  source: /note="Description of Artificial Sequence: Synthetic peptide"
FLLNFILILS

SEQ ID NO: 18076 - protein, 10 aa, Artificial Sequence
  source: /note="Description of Artificial Sequence: Synthetic peptide"
LLNFILILSV

SEQ ID NO: 18077 - protein, 10 aa, Artificial Sequence
  source: /note="Description of Artificial Sequence: Synthetic peptide"
ILSVLMFHKL

SEQ ID NO: 18078 - protein, 10 aa, Artificial Sequence
  source: /note="Description of Artificial Sequence: Synthetic peptide"
VLMFHKLSLL

SEQ ID NO: 18079 - protein, 10 aa, Artificial Sequence
  source: /note="Description of Artificial Sequence: Synthetic peptide"
LILSVLMFHK

SEQ ID NO: 18080 - protein, 10 aa, Artificial Sequence
  source: /note="Description of Artificial Sequence: Synthetic peptide"
LMFHKLSLLK

SEQ ID NO: 18081 - protein, 10 aa, Artificial Sequence
  source: /note="Description of Artificial Sequence: Synthetic peptide"
CWNFLLNFIL

SEQ ID NO: 18082 - protein, 10 aa, Artificial Sequence
  source: /note="Description of Artificial Sequence: Synthetic peptide"
NFLLNFILIL

SEQ ID NO: 18083 - protein, 10 aa, Artificial Sequence
  source: /note="Description of Artificial Sequence: Synthetic peptide"
NFILILSVLM

SEQ ID NO: 18084 - protein, 10 aa, Artificial Sequence
  source: /note="Description of Artificial Sequence: Synthetic peptide"
SVLMFHKLSL

SEQ ID NO: 18085 - protein, 10 aa, Artificial Sequence
  source: /note="Description of Artificial Sequence: Synthetic peptide"
LNFILILSVL

SEQ ID NO: 18086 - protein, 10 aa, Artificial Sequence
  source: /note="Description of Artificial Sequence: Synthetic peptide"
FILILSVLMF

SEQ ID NO: 18087 - protein, 10 aa, Artificial Sequence
  source: /note="Description of Artificial Sequence: Synthetic peptide"
HKLSLLKSGI

SEQ ID NO: 18088 - protein, 9 aa, Artificial Sequence
  source: /note="Description of Artificial Sequence: Synthetic peptide"
SVINYTEQL

SEQ ID NO: 18089 - protein, 9 aa, Artificial Sequence
  source: /note="Description of Artificial Sequence: Synthetic peptide"
AFKESVINY

SEQ ID NO: 18090 - protein, 10 aa, Artificial Sequence
  source: /note="Description of Artificial Sequence: Synthetic peptide"
SVINYTEQLL

SEQ ID NO: 18091 - protein, 10 aa, Artificial Sequence
  source: /note="Description of Artificial Sequence: Synthetic peptide"
KYGAFKESVI

SEQ ID NO: 18092 - protein, 10 aa, Artificial Sequence
  source: /note="Description of Artificial Sequence: Synthetic peptide"
GAFKESVINY

SEQ ID NO: 18093 - protein, 10 aa, Artificial Sequence
  source: /note="Description of Artificial Sequence: Synthetic peptide"
ESVINYTEQL

SEQ ID NO: 18094 - protein, 9 aa, Artificial Sequence
  source: /note="Description of Artificial Sequence: Synthetic peptide"
WSCSQVGIK

SEQ ID NO: 18095 - protein, 9 aa, Artificial Sequence
  source: /note="Description of Artificial Sequence: Synthetic peptide"
RLKNCRFWS

SEQ ID NO: 18096 - protein, 9 aa, Artificial Sequence
  source: /note="Description of Artificial Sequence: Synthetic peptide"
GIKRNWCRR

SEQ ID NO: 18097 - protein, 9 aa, Artificial Sequence
  source: /note="Description of Artificial Sequence: Synthetic peptide"
VGIKRNWCR

SEQ ID NO: 18098 - protein, 9 aa, Artificial Sequence
  source: /note="Description of Artificial Sequence: Synthetic peptide"
GQRLKNCRF

SEQ ID NO: 18099 - protein, 9 aa, Artificial Sequence
  source: /note="Description of Artificial Sequence: Synthetic peptide"
CRFWSCSQV

SEQ ID NO: 18100 - protein, 9 aa, Artificial Sequence
  source: /note="Description of Artificial Sequence: Synthetic peptide"
SQVGIKRNW

SEQ ID NO: 18101 - protein, 10 aa, Artificial Sequence
  source: /note="Description of Artificial Sequence: Synthetic peptide"
LIDSTGQRLK

SEQ ID NO: 18102 - protein, 10 aa, Artificial Sequence
  source: /note="Description of Artificial Sequence: Synthetic peptide"
RFWSCSQVGI

SEQ ID NO: 18103 - protein, 10 aa, Artificial Sequence
  source: /note="Description of Artificial Sequence: Synthetic peptide"
RLKNCRFWSC

SEQ ID NO: 18104 - protein, 10 aa, Artificial Sequence
  source: /note="Description of Artificial Sequence: Synthetic peptide"
GIKRNWCRRV

SEQ ID NO: 18105 - protein, 10 aa, Artificial Sequence
  source: /note="Description of Artificial Sequence: Synthetic peptide"
GTITGDNCIY

SEQ ID NO: 18106 - protein, 10 aa, Artificial Sequence
  source: /note="Description of Artificial Sequence: Synthetic peptide"
STGQRLKNCR

SEQ ID NO: 18107 - protein, 10 aa, Artificial Sequence
  source: /note="Description of Artificial Sequence: Synthetic peptide"
QVGIKRNWCR

SEQ ID NO: 18108 - protein, 10 aa, Artificial Sequence
  source: /note="Description of Artificial Sequence: Synthetic peptide"
VGIKRNWCRR

SEQ ID NO: 18109 - protein, 10 aa, Artificial Sequence
  source: /note="Description of Artificial Sequence: Synthetic peptide"
GQRLKNCRFW

SEQ ID NO: 18110 - protein, 9 aa, Artificial Sequence
  source: /note="Description of Artificial Sequence: Synthetic peptide"
VMRARLYLT

SEQ ID NO: 18111 - protein, 9 aa, Artificial Sequence
  source: /note="Description of Artificial Sequence: Synthetic peptide"
RLYLTAADR

SEQ ID NO: 18112 - protein, 9 aa, Artificial Sequence
  source: /note="Description of Artificial Sequence: Synthetic peptide"
RARLYLTAA

SEQ ID NO: 18113 - protein, 9 aa, Artificial Sequence
  source: /note="Description of Artificial Sequence: Synthetic peptide"
MRARLYLTA

SEQ ID NO: 18114 - protein, 10 aa, Artificial Sequence
  source: /note="Description of Artificial Sequence: Synthetic peptide"
VMRARLYLTA

SEQ ID NO: 18115 - protein, 10 aa, Artificial Sequence
  source: /note="Description of Artificial Sequence: Synthetic peptide"
RLYLTAADRA

SEQ ID NO: 18116 - protein, 10 aa, Artificial Sequence
  source: /note="Description of Artificial Sequence: Synthetic peptide"
KVMRARLYLT

SEQ ID NO: 18117 - protein, 10 aa, Artificial Sequence
  source: /note="Description of Artificial Sequence: Synthetic peptide"
RARLYLTAAD

SEQ ID NO: 18118 - protein, 10 aa, Artificial Sequence
  source: /note="Description of Artificial Sequence: Synthetic peptide"
MRARLYLTAA

SEQ ID NO: 18119 - protein, 9 aa, Artificial Sequence
  source: /note="Description of Artificial Sequence: Synthetic peptide"
QQIGLNSFL

SEQ ID NO: 18120 - protein, 9 aa, Artificial Sequence
  source: /note="Description of Artificial Sequence: Synthetic peptide"
LYLLQQIGL

SEQ ID NO: 18121 - protein, 9 aa, Artificial Sequence
  source: /note="Description of Artificial Sequence: Synthetic peptide"
LQQIGLNSF

SEQ ID NO: 18122 - protein, 10 aa, Artificial Sequence
  source: /note="Description of Artificial Sequence: Synthetic peptide"
RLYLLQQIGL

SEQ ID NO: 18123 - protein, 10 aa, Artificial Sequence
  source: /note="Description of Artificial Sequence: Synthetic peptide"
QQIGLNSFLI

SEQ ID NO: 18124 - protein, 10 aa, Artificial Sequence
  source: /note="Description of Artificial Sequence: Synthetic peptide"
LLQQIGLNSF

SEQ ID NO: 18125 - protein, 10 aa, Artificial Sequence
  source: /note="Description of Artificial Sequence: Synthetic peptide"
LQQIGLNSFL

SEQ ID NO: 18126 - protein, 9 aa, Artificial Sequence
  source: /note="Description of Artificial Sequence: Synthetic peptide"
LVMRREELR

SEQ ID NO: 18127 - protein, 9 aa, Artificial Sequence
  source: /note="Description of Artificial Sequence: Synthetic peptide"
ELVMRREEL

SEQ ID NO: 18128 - protein, 10 aa, Artificial Sequence
  source: /note="Description of Artificial Sequence: Synthetic peptide"
ELVMRREELR

SEQ ID NO: 18129 - protein, 10 aa, Artificial Sequence
  source: /note="Description of Artificial Sequence: Synthetic peptide"
MRREELRHAL

SEQ ID NO: 18130 - protein, 10 aa, Artificial Sequence
  source: /note="Description of Artificial Sequence: Synthetic peptide"
EELVMRREEL

SEQ ID NO: 18131 - protein, 9 aa, Artificial Sequence
  source: /note="Description of Artificial Sequence: Synthetic peptide"
LQAWHAGQT

SEQ ID NO: 18132 - protein, 9 aa, Artificial Sequence
  source: /note="Description of Artificial Sequence: Synthetic peptide"
QAWHAGQTI

SEQ ID NO: 18133 - protein, 9 aa, Artificial Sequence
  source: /note="Description of Artificial Sequence: Synthetic peptide"
GQTINDQDF

SEQ ID NO: 18134 - protein, 10 aa, Artificial Sequence
  source: /note="Description of Artificial Sequence: Synthetic peptide"
LQAWHAGQTI

SEQ ID NO: 18135 - protein, 10 aa, Artificial Sequence
  source: /note="Description of Artificial Sequence: Synthetic peptide"
QTINDQDFFL

SEQ ID NO: 18136 - protein, 10 aa, Artificial Sequence
  source: /note="Description of Artificial Sequence: Synthetic peptide"
GQTINDQDFF

SEQ ID NO: 18137 - protein, 10 aa, Artificial Sequence
  source: /note="Description of Artificial Sequence: Synthetic peptide"
LELQAWHAGQ

SEQ ID NO: 18138 - protein, 9 aa, Artificial Sequence
  source: /note="Description of Artificial Sequence: Synthetic peptide"
MAVFQQHCK

SEQ ID NO: 18139 - protein, 9 aa, Artificial Sequence
  source: /note="Description of Artificial Sequence: Synthetic peptide"
AVFQQHCKM

SEQ ID NO: 18140 - protein, 10 aa, Artificial Sequence
  source: /note="Description of Artificial Sequence: Synthetic peptide"
SMAVFQQHCK

SEQ ID NO: 18141 - protein, 10 aa, Artificial Sequence
  source: /note="Description of Artificial Sequence: Synthetic peptide"
QQHCKMAQEY

SEQ ID NO: 18142 - protein, 10 aa, Artificial Sequence
  source: /note="Description of Artificial Sequence: Synthetic peptide"
MAVFQQHCKM

SEQ ID NO: 18143 - protein, 10 aa, Artificial Sequence
  source: /note="Description of Artificial Sequence: Synthetic peptide"
KESMAVFQQH

SEQ ID NO: 18144 - protein, 9 aa, Artificial Sequence
  source: /note="Description of Artificial Sequence: Synthetic peptide"
QVKFGAPGR

SEQ ID NO: 18145 - protein, 9 aa, Artificial Sequence
  source: /note="Description of Artificial Sequence: Synthetic peptide"
HQVKFGAPG

SEQ ID NO: 18146 - protein, 10 aa, Artificial Sequence
  source: /note="Description of Artificial Sequence: Synthetic peptide"
QVKFGAPGRK

SEQ ID NO: 18147 - protein, 10 aa, Artificial Sequence
  source: /note="Description of Artificial Sequence: Synthetic peptide"
HQVKFGAPGR

SEQ ID NO: 18148 - protein, 10 aa, Artificial Sequence
  source: /note="Description of Artificial Sequence: Synthetic peptide"
APGRKETDPL

SEQ ID NO: 18149 - protein, 9 aa, Artificial Sequence
  source: /note="Description of Artificial Sequence: Synthetic peptide"
RILQGNFLY

SEQ ID NO: 18150 - protein, 9 aa, Artificial Sequence
  source: /note="Description of Artificial Sequence: Synthetic peptide"
FLYQQKSLK

SEQ ID NO: 18151 - protein, 9 aa, Artificial Sequence
  source: /note="Description of Artificial Sequence: Synthetic peptide"
KSLKPNGAR

SEQ ID NO: 18152 - protein, 9 aa, Artificial Sequence
  source: /note="Description of Artificial Sequence: Synthetic peptide"
KPNGARSVV

SEQ ID NO: 18153 - protein, 9 aa, Artificial Sequence
  source: /note="Description of Artificial Sequence: Synthetic peptide"
YQQKSLKPN

SEQ ID NO: 18154 - protein, 10 aa, Artificial Sequence
  source: /note="Description of Artificial Sequence: Synthetic peptide"
SLKPNGARSV

SEQ ID NO: 18155 - protein, 10 aa, Artificial Sequence
  source: /note="Description of Artificial Sequence: Synthetic peptide"
NFLYQQKSLK

SEQ ID NO: 18156 - protein, 10 aa, Artificial Sequence
  source: /note="Description of Artificial Sequence: Synthetic peptide"
KPNGARSVVL

SEQ ID NO: 18157 - protein, 10 aa, Artificial Sequence
  source: /note="Description of Artificial Sequence: Synthetic peptide"
GNFLYQQKSL

SEQ ID NO: 18158 - protein, 10 aa, Artificial Sequence
  source: /note="Description of Artificial Sequence: Synthetic peptide"
YQQKSLKPNG

SEQ ID NO: 18159 - protein, 10 aa, Artificial Sequence
  source: /note="Description of Artificial Sequence: Synthetic peptide"
LPDRILQGNF

SEQ ID NO: 18160 - protein, 9 aa, Artificial Sequence
  source: /note="Description of Artificial Sequence: Synthetic peptide"
RPAPPAGRV

SEQ ID NO: 18161 - protein, 9 aa, Artificial Sequence
  source: /note="Description of Artificial Sequence: Synthetic peptide"
APPAGRVPF

SEQ ID NO: 18162 - protein, 9 aa, Artificial Sequence
  source: /note="Description of Artificial Sequence: Synthetic peptide"
PPAGRVPFL

SEQ ID NO: 18163 - protein, 10 aa, Artificial Sequence
  source: /note="Description of Artificial Sequence: Synthetic peptide"
RPAPPAGRVP

SEQ ID NO: 18164 - protein, 10 aa, Artificial Sequence
  source: /note="Description of Artificial Sequence: Synthetic peptide"
APPAGRVPFL

SEQ ID NO: 18165 - protein, 10 aa, Artificial Sequence
  source: /note="Description of Artificial Sequence: Synthetic peptide"
RKAEEERLCL

SEQ ID NO: 18166 - protein, 10 aa, Artificial Sequence
  source: /note="Description of Artificial Sequence: Synthetic peptide"
EERLCLEEEA

SEQ ID NO: 18167 - protein, 9 aa, Artificial Sequence
  source: /note="Description of Artificial Sequence: Synthetic peptide"
KASVDAPPR

SEQ ID NO: 18168 - protein, 9 aa, Artificial Sequence
  source: /note="Description of Artificial Sequence: Synthetic peptide"
AMKEKEANK

SEQ ID NO: 18169 - protein, 9 aa, Artificial Sequence
  source: /note="Description of Artificial Sequence: Synthetic peptide"
KEANKIAAK

SEQ ID NO: 18170 - protein, 9 aa, Artificial Sequence
  source: /note="Description of Artificial Sequence: Synthetic peptide"
KEKEANKIA

SEQ ID NO: 18171 - protein, 10 aa, Artificial Sequence
  source: /note="Description of Artificial Sequence: Synthetic peptide"
AMKEKEANKI

SEQ ID NO: 18172 - protein, 10 aa, Artificial Sequence
  source: /note="Description of Artificial Sequence: Synthetic peptide"
KAMKEKEANK

SEQ ID NO: 18173 - protein, 10 aa, Artificial Sequence
  source: /note="Description of Artificial Sequence: Synthetic peptide"
EANKIAAKKR

SEQ ID NO: 18174 - protein, 10 aa, Artificial Sequence
  source: /note="Description of Artificial Sequence: Synthetic peptide"
KEKEANKIAA

SEQ ID NO: 18175 - protein, 9 aa, Artificial Sequence
  source: /note="Description of Artificial Sequence: Synthetic peptide"
YYDPSDKPI

SEQ ID NO: 18176 - protein, 9 aa, Artificial Sequence
  source: /note="Description of Artificial Sequence: Synthetic peptide"
KPIAEAPFK

SEQ ID NO: 18177 - protein, 10 aa, Artificial Sequence
  source: /note="Description of Artificial Sequence: Synthetic peptide"
QYYDPSDKPI

SEQ ID NO: 18178 - protein, 10 aa, Artificial Sequence
  source: /note="Description of Artificial Sequence: Synthetic peptide"
SDKPIAEAPF

SEQ ID NO: 18179 - protein, 10 aa, Artificial Sequence
  source: /note="Description of Artificial Sequence: Synthetic peptide"
KPIAEAPFKF

SEQ ID NO: 18180 - protein, 10 aa, Artificial Sequence
  source: /note="Description of Artificial Sequence: Synthetic peptide"
KEETEAQQPF

SEQ ID NO: 18181 - protein, 9 aa, Artificial Sequence
  source: /note="Description of Artificial Sequence: Synthetic peptide"
TMCEPPYSL

SEQ ID NO: 18182 - protein, 9 aa, Artificial Sequence
  source: /note="Description of Artificial Sequence: Synthetic peptide"
PLSSLLHPL

SEQ ID NO: 18183 - protein, 9 aa, Artificial Sequence
  source: /note="Description of Artificial Sequence: Synthetic peptide"
LLHPLALPA

SEQ ID NO: 18184 - protein, 9 aa, Artificial Sequence
  source: /note="Description of Artificial Sequence: Synthetic peptide"
GLSATRHWA

SEQ ID NO: 18185 - protein, 9 aa, Artificial Sequence
  source: /note="Description of Artificial Sequence: Synthetic peptide"
SLHLALCSC

SEQ ID NO: 18186 - protein, 9 aa, Artificial Sequence
  source: /note="Description of Artificial Sequence: Synthetic peptide"
ALPALPGPL

SEQ ID NO: 18187 - protein, 9 aa, Artificial Sequence
  source: /note="Description of Artificial Sequence: Synthetic peptide"
GLCLEATPK

SEQ ID NO: 18188 - protein, 9 aa, Artificial Sequence
  source: /note="Description of Artificial Sequence: Synthetic peptide"
CSCPSPFPR

SEQ ID NO: 18189 - protein, 9 aa, Artificial Sequence
  source: /note="Description of Artificial Sequence: Synthetic peptide"
KFQGACPGL

SEQ ID NO: 18190 - protein, 9 aa, Artificial Sequence
  source: /note="Description of Artificial Sequence: Synthetic peptide"
RGTMCEPPY

SEQ ID NO: 18191 - protein, 9 aa, Artificial Sequence
  source: /note="Description of Artificial Sequence: Synthetic peptide"
HWATCPCWR

SEQ ID NO: 18192 - protein, 9 aa, Artificial Sequence
  source: /note="Description of Artificial Sequence: Synthetic peptide"
EPPYSLHLA

SEQ ID NO: 18193 - protein, 9 aa, Artificial Sequence
  source: /note="Description of Artificial Sequence: Synthetic peptide"
TPKPTGLSA

SEQ ID NO: 18194 - protein, 9 aa, Artificial Sequence
  source: /note="Description of Artificial Sequence: Synthetic peptide"
PPYSLHLAL

SEQ ID NO: 18195 - protein, 9 aa, Artificial Sequence
  source: /note="Description of Artificial Sequence: Synthetic peptide"
CPSPFPRPL

SEQ ID NO: 18196 - protein, 9 aa, Artificial Sequence
  source: /note="Description of Artificial Sequence: Synthetic peptide"
SPFPRPLSS

SEQ ID NO: 18197 - protein, 9 aa, Artificial Sequence
  source: /note="Description of Artificial Sequence: Synthetic peptide"
FPRPLSSLL

SEQ ID NO: 18198 - protein, 9 aa, Artificial Sequence
  source: /note="Description of Artificial Sequence: Synthetic peptide"
APLTSSNKV

SEQ ID NO: 18199 - protein, 9 aa, Artificial Sequence
  source: /note="Description of Artificial Sequence: Synthetic peptide"
SSLLHPLAL

SEQ ID NO: 18200 - protein, 9 aa, Artificial Sequence
  source: /note="Description of Artificial Sequence: Synthetic peptide"
ALCSCPSPF

SEQ ID NO: 18201 - protein, 9 aa, Artificial Sequence
  source: /note="Description of Artificial Sequence: Synthetic peptide"
LQGAQGVPG

SEQ ID NO: 18202 - protein, 9 aa, Artificial Sequence
  source: /note="Description of Artificial Sequence: Synthetic peptide"
AQGVPGLCL

SEQ ID NO: 18203 - protein, 9 aa, Artificial Sequence
  source: /note="Description of Artificial Sequence: Synthetic peptide"
RHWATCPCW

SEQ ID NO: 18204 - protein, 9 aa, Artificial Sequence
  source: /note="Description of Artificial Sequence: Synthetic peptide"
LKFQGACPG

SEQ ID NO: 18205 - protein, 9 aa, Artificial Sequence
  source: /note="Description of Artificial Sequence: Synthetic peptide"
FQGACPGLL

SEQ ID NO: 18206 - protein, 9 aa, Artificial Sequence
  source: /note="Description of Artificial Sequence: Synthetic peptide"
DEGPAPAPL

SEQ ID NO: 18207 - protein, 9 aa, Artificial Sequence
  source: /note="Description of Artificial Sequence: Synthetic peptide"
CEPPYSLHL

SEQ ID NO: 18208 - protein, 10 aa, Artificial Sequence
  source: /note="Description of Artificial Sequence: Synthetic peptide"
GTMCEPPYSL

SEQ ID NO: 18209 - protein, 10 aa, Artificial Sequence
  source: /note="Description of Artificial Sequence: Synthetic peptide"
SLLHPLALPA

SEQ ID NO: 18210 - protein, 10 aa, Artificial Sequence
  source: /note="Description of Artificial Sequence: Synthetic peptide"
LLHPLALPAL

SEQ ID NO: 18211 - protein, 10 aa, Artificial Sequence
  source: /note="Description of Artificial Sequence: Synthetic peptide"
GLSATRHWAT

SEQ ID NO: 18212 - protein, 10 aa, Artificial Sequence
  source: /note="Description of Artificial Sequence: Synthetic peptide"
ALPALPGPLK

SEQ ID NO: 18213 - protein, 10 aa, Artificial Sequence
  source: /note="Description of Artificial Sequence: Synthetic peptide"
PFPRPLSSLL

SEQ ID NO: 18214 - protein, 10 aa, Artificial Sequence
  source: /note="Description of Artificial Sequence: Synthetic peptide"
KFQGACPGLL

SEQ ID NO: 18215 - protein, 10 aa, Artificial Sequence
  source: /note="Description of Artificial Sequence: Synthetic peptide"
ATRHWATCPC

SEQ ID NO: 18216 - protein, 10 aa, Artificial Sequence
  source: /note="Description of Artificial Sequence: Synthetic peptide"
TSALQGAQGV

SEQ ID NO: 18217 - protein, 10 aa, Artificial Sequence
  source: /note="Description of Artificial Sequence: Synthetic peptide"
TPKPTGLSAT

SEQ ID NO: 18218 - protein, 10 aa, Artificial Sequence
  source: /note="Description of Artificial Sequence: Synthetic peptide"
EPPYSLHLAL

SEQ ID NO: 18219 - protein, 10 aa, Artificial Sequence
  source: /note="Description of Artificial Sequence: Synthetic peptide"
SPFPRPLSSL

SEQ ID NO: 18220 - protein, 10 aa, Artificial Sequence
  source: /note="Description of Artificial Sequence: Synthetic peptide"
FPRPLSSLLH

SEQ ID NO: 18221 - protein, 10 aa, Artificial Sequence
  source: /note="Description of Artificial Sequence: Synthetic peptide"
RPLSSLLHPL

SEQ ID NO: 18222 - protein, 10 aa, Artificial Sequence
  source: /note="Description of Artificial Sequence: Synthetic peptide"
LPALPGPLKF

SEQ ID NO: 18223 - protein, 10 aa, Artificial Sequence
  source: /note="Description of Artificial Sequence: Synthetic peptide"
APLTSSNKVM

SEQ ID NO: 18224 - protein, 10 aa, Artificial Sequence
  source: /note="Description of Artificial Sequence: Synthetic peptide"
LALCSCPSPF

SEQ ID NO: 18225 - protein, 10 aa, Artificial Sequence
  source: /note="Description of Artificial Sequence: Synthetic peptide"
LQGAQGVPGL

SEQ ID NO: 18226 - protein, 10 aa, Artificial Sequence
  source: /note="Description of Artificial Sequence: Synthetic peptide"
LEATPKPTGL

SEQ ID NO: 18227 - protein, 10 aa, Artificial Sequence
  source: /note="Description of Artificial Sequence: Synthetic peptide"
WRGTMCEPPY

SEQ ID NO: 18228 - protein, 10 aa, Artificial Sequence
  source: /note="Description of Artificial Sequence: Synthetic peptide"
LSSLLHPLAL

SEQ ID NO: 18229 - protein, 10 aa, Artificial Sequence
  source: /note="Description of Artificial Sequence: Synthetic peptide"
LALPALPGPL

SEQ ID NO: 18230 - protein, 10 aa, Artificial Sequence
  source: /note="Description of Artificial Sequence: Synthetic peptide"
LKFQGACPGL

SEQ ID NO: 18231 - protein, 10 aa, Artificial Sequence
  source: /note="Description of Artificial Sequence: Synthetic peptide"
CEPPYSLHLA

SEQ ID NO: 18232 - protein, 9 aa, Artificial Sequence
  source: /note="Description of Artificial Sequence: Synthetic peptide"
LFKFSMAYI

SEQ ID NO: 18233 - protein, 9 aa, Artificial Sequence
  source: /note="Description of Artificial Sequence: Synthetic peptide"
ELFKFSMAY

SEQ ID NO: 18234 - protein, 9 aa, Artificial Sequence
  source: /note="Description of Artificial Sequence: Synthetic peptide"
SMAYIVQEY

SEQ ID NO: 18235 - protein, 9 aa, Artificial Sequence
  source: /note="Description of Artificial Sequence: Synthetic peptide"
MAYIVQEYM

SEQ ID NO: 18236 - protein, 9 aa, Artificial Sequence
  source: /note="Description of Artificial Sequence: Synthetic peptide"
FKFSMAYIV

SEQ ID NO: 18237 - protein, 9 aa, Artificial Sequence
  source: /note="Description of Artificial Sequence: Synthetic peptide"
GELFKFSMA

SEQ ID NO: 18238 - protein, 10 aa, Artificial Sequence
  source: /note="Description of Artificial Sequence: Synthetic peptide"
FSMAYIVQEY

SEQ ID NO: 18239 - protein, 10 aa, Artificial Sequence
  source: /note="Description of Artificial Sequence: Synthetic peptide"
ELFKFSMAYI

SEQ ID NO: 18240 - protein, 10 aa, Artificial Sequence
  source: /note="Description of Artificial Sequence: Synthetic peptide"
SMAYIVQEYM

SEQ ID NO: 18241 - protein, 10 aa, Artificial Sequence
  source: /note="Description of Artificial Sequence: Synthetic peptide"
LQGELFKFSM

SEQ ID NO: 18242 - protein, 10 aa, Artificial Sequence
  source: /note="Description of Artificial Sequence: Synthetic peptide"
GELFKFSMAY

SEQ ID NO: 18243 - protein, 10 aa, Artificial Sequence
  source: /note="Description of Artificial Sequence: Synthetic peptide"
FKFSMAYIVQ

SEQ ID NO: 18244 - protein, 10 aa, Artificial Sequence
  source: /note="Description of Artificial Sequence: Synthetic peptide"
LEDPEPRKPV

SEQ ID NO: 18245 - protein, 9 aa, Artificial Sequence
  source: /note="Description of Artificial Sequence: Synthetic peptide"
RVVPLLPRL

SEQ ID NO: 18246 - protein, 9 aa, Artificial Sequence
  source: /note="Description of Artificial Sequence: Synthetic peptide"
LLPRLGVGA

SEQ ID NO: 18247 - protein, 9 aa, Artificial Sequence
  source: /note="Description of Artificial Sequence: Synthetic peptide"
RLGVGATRI

SEQ ID NO: 18248 - protein, 9 aa, Artificial Sequence
  source: /note="Description of Artificial Sequence: Synthetic peptide"
RWHLRVVPL

SEQ ID NO: 18249 - protein, 9 aa, Artificial Sequence
  source: /note="Description of Artificial Sequence: Synthetic peptide"
RAAPPPPQI

SEQ ID NO: 18250 - protein, 9 aa, Artificial Sequence
  source: /note="Description of Artificial Sequence: Synthetic peptide"
AQPPRWHLR

SEQ ID NO: 18251 - protein, 9 aa, Artificial Sequence
  source: /note="Description of Artificial Sequence: Synthetic peptide"
LAAAAQPPR

SEQ ID NO: 18252 - protein, 9 aa, Artificial Sequence
  source: /note="Description of Artificial Sequence: Synthetic peptide"
EAPPPTALA

SEQ ID NO: 18253 - protein, 9 aa, Artificial Sequence
  source: /note="Description of Artificial Sequence: Synthetic peptide"
APPPTALAA

SEQ ID NO: 18254 - protein, 9 aa, Artificial Sequence
  source: /note="Description of Artificial Sequence: Synthetic peptide"
PPRWHLRVV

SEQ ID NO: 18255 - protein, 9 aa, Artificial Sequence
  source: /note="Description of Artificial Sequence: Synthetic peptide"
VPLLPRLGV

SEQ ID NO: 18256 - protein, 9 aa, Artificial Sequence
  source: /note="Description of Artificial Sequence: Synthetic peptide"
LPRLGVGAT

SEQ ID NO: 18257 - protein, 9 aa, Artificial Sequence
  source: /note="Description of Artificial Sequence: Synthetic peptide"
IEAPPPTAL

SEQ ID NO: 18258 - protein, 9 aa, Artificial Sequence
  source: /note="Description of Artificial Sequence: Synthetic peptide"
AAQPPRWHL

SEQ ID NO: 18259 - protein, 9 aa, Artificial Sequence
  source: /note="Description of Artificial Sequence: Synthetic peptide"
WHLRVVPLL

SEQ ID NO: 18260 - protein, 9 aa, Artificial Sequence
  source: /note="Description of Artificial Sequence: Synthetic peptide"
DELPPPRAA

SEQ ID NO: 18261 - protein, 9 aa, Artificial Sequence
  source: /note="Description of Artificial Sequence: Synthetic peptide"
ETESTTRPM

SEQ ID NO: 18262 - protein, 9 aa, Artificial Sequence
  source: /note="Description of Artificial Sequence: Synthetic peptide"
QPPRWHLRV

SEQ ID NO: 18263 - protein, 10 aa, Artificial Sequence
  source: /note="Description of Artificial Sequence: Synthetic peptide"
ALAAAAQPPR

SEQ ID NO: 18264 - protein, 10 aa, Artificial Sequence
  source: /note="Description of Artificial Sequence: Synthetic peptide"
HLRVVPLLPR

SEQ ID NO: 18265 - protein, 10 aa, Artificial Sequence
  source: /note="Description of Artificial Sequence: Synthetic peptide"
AAQPPRWHLR

SEQ ID NO: 18266 - protein, 10 aa, Artificial Sequence
  source: /note="Description of Artificial Sequence: Synthetic peptide"
RWHLRVVPLL

SEQ ID NO: 18267 - protein, 10 aa, Artificial Sequence
  source: /note="Description of Artificial Sequence: Synthetic peptide"
CLSDELPPPR

SEQ ID NO: 18268 - protein, 10 aa, Artificial Sequence
  source: /note="Description of Artificial Sequence: Synthetic peptide"
EAPPPTALAA

SEQ ID NO: 18269 - protein, 10 aa, Artificial Sequence
  source: /note="Description of Artificial Sequence: Synthetic peptide"
APPPTALAAA

SEQ ID NO: 18270 - protein, 10 aa, Artificial Sequence
  source: /note="Description of Artificial Sequence: Synthetic peptide"
IEAPPPTALA

SEQ ID NO: 18271 - protein, 10 aa, Artificial Sequence
  source: /note="Description of Artificial Sequence: Synthetic peptide"
LAAAAQPPRW

SEQ ID NO: 18272 - protein, 10 aa, Artificial Sequence
  source: /note="Description of Artificial Sequence: Synthetic peptide"
AAAQPPRWHL

SEQ ID NO: 18273 - protein, 10 aa, Artificial Sequence
  source: /note="Description of Artificial Sequence: Synthetic peptide"
LRVVPLLPRL

SEQ ID NO: 18274 - protein, 10 aa, Artificial Sequence
  source: /note="Description of Artificial Sequence: Synthetic peptide"
IETESTTRPM

SEQ ID NO: 18275 - protein, 10 aa, Artificial Sequence
  source: /note="Description of Artificial Sequence: Synthetic peptide"
DELPPPRAAP

SEQ ID NO: 18276 - protein, 10 aa, Artificial Sequence
  source: /note="Description of Artificial Sequence: Synthetic peptide"
QPPRWHLRVV

SEQ ID NO: 18277 - protein, 9 aa, Artificial Sequence
  source: /note="Description of Artificial Sequence: Synthetic peptide"
QLFDHSLLY

SEQ ID NO: 18278 - protein, 9 aa, Artificial Sequence
  source: /note="Description of Artificial Sequence: Synthetic peptide"
LLYTVLCGS

SEQ ID NO: 18279 - protein, 9 aa, Artificial Sequence
  source: /note="Description of Artificial Sequence: Synthetic peptide"
QPQLFDHSL

SEQ ID NO: 18280 - protein, 9 aa, Artificial Sequence
  source: /note="Description of Artificial Sequence: Synthetic peptide"
AKETHQPQL

SEQ ID NO: 18281 - protein, 9 aa, Artificial Sequence
  source: /note="Description of Artificial Sequence: Synthetic peptide"
KETHQPQLF

SEQ ID NO: 18282 - protein, 9 aa, Artificial Sequence
  source: /note="Description of Artificial Sequence: Synthetic peptide"
FDHSLLYTV

SEQ ID NO: 18283 - protein, 10 aa, Artificial Sequence
  source: /note="Description of Artificial Sequence: Synthetic peptide"
QLFDHSLLYT

SEQ ID NO: 18284 - protein, 10 aa, Artificial Sequence
  source: /note="Description of Artificial Sequence: Synthetic peptide"
GSRSAGSREV

SEQ ID NO: 18285 - protein, 10 aa, Artificial Sequence
  source: /note="Description of Artificial Sequence: Synthetic peptide"
PQLFDHSLLY

SEQ ID NO: 18286 - protein, 10 aa, Artificial Sequence
  source: /note="Description of Artificial Sequence: Synthetic peptide"
LLYTVLCGSR

SEQ ID NO: 18287 - protein, 10 aa, Artificial Sequence
  source: /note="Description of Artificial Sequence: Synthetic peptide"
YTVLCGSRSA

SEQ ID NO: 18288 - protein, 10 aa, Artificial Sequence
  source: /note="Description of Artificial Sequence: Synthetic peptide"
QPQLFDHSLL

SEQ ID NO: 18289 - protein, 10 aa, Artificial Sequence
  source: /note="Description of Artificial Sequence: Synthetic peptide"
FAKETHQPQL

SEQ ID NO: 18290 - protein, 10 aa, Artificial Sequence
  source: /note="Description of Artificial Sequence: Synthetic peptide"
AKETHQPQLF

SEQ ID NO: 18291 - protein, 10 aa, Artificial Sequence
  source: /note="Description of Artificial Sequence: Synthetic peptide"
HQPQLFDHSL

SEQ ID NO: 18292 - protein, 10 aa, Artificial Sequence
  source: /note="Description of Artificial Sequence: Synthetic peptide"
FDHSLLYTVL

SEQ ID NO: 18293 - protein, 9 aa, Artificial Sequence
  source: /note="Description of Artificial Sequence: Synthetic peptide"
VLYTHQLCL

SEQ ID NO: 18294 - protein, 9 aa, Artificial Sequence
  source: /note="Description of Artificial Sequence: Synthetic peptide"
LYTHQLCLL

SEQ ID NO: 18295 - protein, 9 aa, Artificial Sequence
  source: /note="Description of Artificial Sequence: Synthetic peptide"
GSVLYTHQL

SEQ ID NO: 18296 - protein, 10 aa, Artificial Sequence
  source: /note="Description of Artificial Sequence: Synthetic peptide"
VLYTHQLCLL

SEQ ID NO: 18297 - protein, 10 aa, Artificial Sequence
  source: /note="Description of Artificial Sequence: Synthetic peptide"
NPCRCDGSVL

SEQ ID NO: 18298 - protein, 9 aa, Artificial Sequence
  source: /note="Description of Artificial Sequence: Synthetic peptide"
RLWCKYSNK

SEQ ID NO: 18299 - protein, 9 aa, Artificial Sequence
  source: /note="Description of Artificial Sequence: Synthetic peptide"
LWCKYSNKL

SEQ ID NO: 18300 - protein, 9 aa, Artificial Sequence
  source: /note="Description of Artificial Sequence: Synthetic peptide"
YVLRLWCKY

SEQ ID NO: 18301 - protein, 9 aa, Artificial Sequence
  source: /note="Description of Artificial Sequence: Synthetic peptide"
DYVLRLWCK

SEQ ID NO: 18302 - protein, 9 aa, Artificial Sequence
  source: /note="Description of Artificial Sequence: Synthetic peptide"
CKYSNKLQI

SEQ ID NO: 18303 - protein, 10 aa, Artificial Sequence
  source: /note="Description of Artificial Sequence: Synthetic peptide"
RLWCKYSNKL

SEQ ID NO: 18304 - protein, 10 aa, Artificial Sequence
  source: /note="Description of Artificial Sequence: Synthetic peptide"
CKYSNKLQIL

SEQ ID NO: 18305 - protein, 9 aa, Artificial Sequence
  source: /note="Description of Artificial Sequence: Synthetic peptide"
KKRSAFPSR

SEQ ID NO: 18306 - protein, 9 aa, Artificial Sequence
  source: /note="Description of Artificial Sequence: Synthetic peptide"
RSAFPSRSL

SEQ ID NO: 18307 - protein, 9 aa, Artificial Sequence
  source: /note="Description of Artificial Sequence: Synthetic peptide"
SAFPSRSLS

SEQ ID NO: 18308 - protein, 9 aa, Artificial Sequence
  source: /note="Description of Artificial Sequence: Synthetic peptide"
TPKKKRSAF

SEQ ID NO: 18309 - protein, 10 aa, Artificial Sequence
  source: /note="Description of Artificial Sequence: Synthetic peptide"
KKKRSAFPSR

SEQ ID NO: 18310 - protein, 10 aa, Artificial Sequence
  source: /note="Description of Artificial Sequence: Synthetic peptide"
RSAFPSRSLS

SEQ ID NO: 18311 - protein, 10 aa, Artificial Sequence
  source: /note="Description of Artificial Sequence: Synthetic peptide"
KRSAFPSRSL

SEQ ID NO: 18312 - protein, 10 aa, Artificial Sequence
  source: /note="Description of Artificial Sequence: Synthetic peptide"
SAFPSRSLSS

SEQ ID NO: 18313 - protein, 9 aa, Artificial Sequence
  source: /note="Description of Artificial Sequence: Synthetic peptide"
SCVQQTNGF

SEQ ID NO: 18314 - protein, 9 aa, Artificial Sequence
  source: /note="Description of Artificial Sequence: Synthetic peptide"
VQQTNGFVQ

SEQ ID NO: 18315 - protein, 10 aa, Artificial Sequence
  source: /note="Description of Artificial Sequence: Synthetic peptide"
SSCVQQTNGF

SEQ ID NO: 18316 - protein, 10 aa, Artificial Sequence
  source: /note="Description of Artificial Sequence: Synthetic peptide"
QQTNGFVQRH

SEQ ID NO: 18317 - protein, 9 aa, Artificial Sequence
  source: /note="Description of Artificial Sequence: Synthetic peptide"
GLKESLRVI

SEQ ID NO: 18318 - protein, 9 aa, Artificial Sequence
  source: /note="Description of Artificial Sequence: Synthetic peptide"
GSLRKKGLK

SEQ ID NO: 18319 - protein, 9 aa, Artificial Sequence
  source: /note="Description of Artificial Sequence: Synthetic peptide"
RKKGLKESL

SEQ ID NO: 18320 - protein, 10 aa, Artificial Sequence
  source: /note="Description of Artificial Sequence: Synthetic peptide"
GLKESLRVIL

SEQ ID NO: 18321 - protein, 10 aa, Artificial Sequence
  source: /note="Description of Artificial Sequence: Synthetic peptide"
VGSLRKKGLK

SEQ ID NO: 18322 - protein, 9 aa, Artificial Sequence
  source: /note="Description of Artificial Sequence: Synthetic peptide"
KLNAKLAGL

SEQ ID NO: 18323 - protein, 10 aa, Artificial Sequence
  source: /note="Description of Artificial Sequence: Synthetic peptide"
KLNAKLAGLR

SEQ ID NO: 18324 - protein, 10 aa, Artificial Sequence
  source: /note="Description of Artificial Sequence: Synthetic peptide"
LAGLRRNGTL

SEQ ID NO: 18325 - protein, 10 aa, Artificial Sequence
  source: /note="Description of Artificial Sequence: Synthetic peptide"
GLRRNGTLPW

SEQ ID NO: 18326 - protein, 10 aa, Artificial Sequence
  source: /note="Description of Artificial Sequence: Synthetic peptide"
HKLNAKLAGL

SEQ ID NO: 18327 - protein, 9 aa, Artificial Sequence
  source: /note="Description of Artificial Sequence: Synthetic peptide"
RWDHIKDSF

SEQ ID NO: 18328 - protein, 10 aa, Artificial Sequence
  source: /note="Description of Artificial Sequence: Synthetic peptide"
KRWDHIKDSF

SEQ ID NO: 18329 - protein, 9 aa, Artificial Sequence
  source: /note="Description of Artificial Sequence: Synthetic peptide"
RAHRNALER

SEQ ID NO: 18330 - protein, 9 aa, Artificial Sequence
  source: /note="Description of Artificial Sequence: Synthetic peptide"
SAADKRAHR

SEQ ID NO: 18331 - protein, 9 aa, Artificial Sequence
  source: /note="Description of Artificial Sequence: Synthetic peptide"
AHRNALERK

SEQ ID NO: 18332 - protein, 9 aa, Artificial Sequence
  source: /note="Description of Artificial Sequence: Synthetic peptide"
DKRAHRNAL

SEQ ID NO: 18333 - protein, 10 aa, Artificial Sequence
  source: /note="Description of Artificial Sequence: Synthetic peptide"
RAHRNALERK

SEQ ID NO: 18334 - protein, 10 aa, Artificial Sequence
  source: /note="Description of Artificial Sequence: Synthetic peptide"
QSAADKRAHR

SEQ ID NO: 18335 - protein, 9 aa, Artificial Sequence
  source: /note="Description of Artificial Sequence: Synthetic peptide"
SLMQAYEAC

SEQ ID NO: 18336 - protein, 9 aa, Artificial Sequence
  source: /note="Description of Artificial Sequence: Synthetic peptide"
MQAYEACKA

SEQ ID NO: 18337 - protein, 9 aa, Artificial Sequence
  source: /note="Description of Artificial Sequence: Synthetic peptide"
LMQAYEACK

SEQ ID NO: 18338 - protein, 9 aa, Artificial Sequence
  source: /note="Description of Artificial Sequence: Synthetic peptide"
QAYEACKAI

SEQ ID NO: 18339 - protein, 9 aa, Artificial Sequence
  source: /note="Description of Artificial Sequence: Synthetic peptide"
YEACKAIII

SEQ ID NO: 18340 - protein, 10 aa, Artificial Sequence
  source: /note="Description of Artificial Sequence: Synthetic peptide"
LMQAYEACKA

SEQ ID NO: 18341 - protein, 10 aa, Artificial Sequence
  source: /note="Description of Artificial Sequence: Synthetic peptide"
MQAYEACKAI

SEQ ID NO: 18342 - protein, 10 aa, Artificial Sequence
  source: /note="Description of Artificial Sequence: Synthetic peptide"
SLMQAYEACK

SEQ ID NO: 18343 - protein, 10 aa, Artificial Sequence
  source: /note="Description of Artificial Sequence: Synthetic peptide"
EACKAIIIKL

SEQ ID NO: 18344 - protein, 10 aa, Artificial Sequence
  source: /note="Description of Artificial Sequence: Synthetic peptide"
QAYEACKAII

SEQ ID NO: 18345 - protein, 9 aa, Artificial Sequence
  source: /note="Description of Artificial Sequence: Synthetic peptide"
SLALCWVPA

SEQ ID NO: 18346 - protein, 9 aa, Artificial Sequence
  source: /note="Description of Artificial Sequence: Synthetic peptide"
SGRPPNSLA

SEQ ID NO: 18347 - protein, 9 aa, Artificial Sequence
  source: /note="Description of Artificial Sequence: Synthetic peptide"
VPACWVTCL

SEQ ID NO: 18348 - protein, 9 aa, Artificial Sequence
  source: /note="Description of Artificial Sequence: Synthetic peptide"
PPNSLALCW

SEQ ID NO: 18349 - protein, 10 aa, Artificial Sequence
  source: /note="Description of Artificial Sequence: Synthetic peptide"
SLALCWVPAC

SEQ ID NO: 18350 - protein, 10 aa, Artificial Sequence
  source: /note="Description of Artificial Sequence: Synthetic peptide"
ALCWVPACWV

SEQ ID NO: 18351 - protein, 10 aa, Artificial Sequence
  source: /note="Description of Artificial Sequence: Synthetic peptide"
SGRPPNSLAL

SEQ ID NO: 18352 - protein, 10 aa, Artificial Sequence
  source: /note="Description of Artificial Sequence: Synthetic peptide"
NSLALCWVPA

SEQ ID NO: 18353 - protein, 10 aa, Artificial Sequence
  source: /note="Description of Artificial Sequence: Synthetic peptide"
WVPACWVTCL

SEQ ID NO: 18354 - protein, 10 aa, Artificial Sequence
  source: /note="Description of Artificial Sequence: Synthetic peptide"
RPPNSLALCW

SEQ ID NO: 18355 - protein, 10 aa, Artificial Sequence
  source: /note="Description of Artificial Sequence: Synthetic peptide"
LALCWVPACW

SEQ ID NO: 18356 - protein, 9 aa, Artificial Sequence
  source: /note="Description of Artificial Sequence: Synthetic peptide"
SSSTPLRGF

SEQ ID NO: 18357 - protein, 10 aa, Artificial Sequence
  source: /note="Description of Artificial Sequence: Synthetic peptide"
LLPGGGSSST

SEQ ID NO: 18358 - protein, 10 aa, Artificial Sequence
  source: /note="Description of Artificial Sequence: Synthetic peptide"
LQLLPGGGSS

SEQ ID NO: 18359 - protein, 10 aa, Artificial Sequence
  source: /note="Description of Artificial Sequence: Synthetic peptide"
GSSSTPLRGF

SEQ ID NO: 18360 - protein, 9 aa, Artificial Sequence
  source: /note="Description of Artificial Sequence: Synthetic peptide"
LAAIWFQTY

SEQ ID NO: 18361 - protein, 9 aa, Artificial Sequence
  source: /note="Description of Artificial Sequence: Synthetic peptide"
LLAAIWFQT

SEQ ID NO: 18362 - protein, 9 aa, Artificial Sequence
  source: /note="Description of Artificial Sequence: Synthetic peptide"
AIWFQTYLH

SEQ ID NO: 18363 - protein, 9 aa, Artificial Sequence
  source: /note="Description of Artificial Sequence: Synthetic peptide"
AAIWFQTYL

SEQ ID NO: 18364 - protein, 9 aa, Artificial Sequence
  source: /note="Description of Artificial Sequence: Synthetic peptide"
FQTYLHSSK

SEQ ID NO: 18365 - protein, 10 aa, Artificial Sequence
  source: /note="Description of Artificial Sequence: Synthetic peptide"
LLAAIWFQTY

SEQ ID NO: 18366 - protein, 10 aa, Artificial Sequence
  source: /note="Description of Artificial Sequence: Synthetic peptide"
ALLAAIWFQT

SEQ ID NO: 18367 - protein, 10 aa, Artificial Sequence
  source: /note="Description of Artificial Sequence: Synthetic peptide"
WFQTYLHSSK

SEQ ID NO: 18368 - protein, 10 aa, Artificial Sequence
  source: /note="Description of Artificial Sequence: Synthetic peptide"
LAAIWFQTYL

SEQ ID NO: 18369 - protein, 10 aa, Artificial Sequence
  source: /note="Description of Artificial Sequence: Synthetic peptide"
FQTYLHSSKT

SEQ ID NO: 18370 - protein, 9 aa, Artificial Sequence
  source: /note="Description of Artificial Sequence: Synthetic peptide"
LSLADTLWY

SEQ ID NO: 18371 - protein, 9 aa, Artificial Sequence
  source: /note="Description of Artificial Sequence: Synthetic peptide"
SLADTLWYW

SEQ ID NO: 18372 - protein, 9 aa, Artificial Sequence
  source: /note="Description of Artificial Sequence: Synthetic peptide"
TLWYWASIY

SEQ ID NO: 18373 - protein, 9 aa, Artificial Sequence
  source: /note="Description of Artificial Sequence: Synthetic peptide"
LWYWASIYF

SEQ ID NO: 18374 - protein, 9 aa, Artificial Sequence
  source: /note="Description of Artificial Sequence: Synthetic peptide"
WYWASIYFC

SEQ ID NO: 18375 - protein, 9 aa, Artificial Sequence
  source: /note="Description of Artificial Sequence: Synthetic peptide"
DTLWYWASI

SEQ ID NO: 18376 - protein, 9 aa, Artificial Sequence
  source: /note="Description of Artificial Sequence: Synthetic peptide"
LLSLADTLW

SEQ ID NO: 18377 - protein, 10 aa, Artificial Sequence
  source: /note="Description of Artificial Sequence: Synthetic peptide"
LLSLADTLWY

SEQ ID NO: 18378 - protein, 10 aa, Artificial Sequence
  source: /note="Description of Artificial Sequence: Synthetic peptide"
SLADTLWYWA

SEQ ID NO: 18379 - protein, 10 aa, Artificial Sequence
  source: /note="Description of Artificial Sequence: Synthetic peptide"
LSLADTLWYW

SEQ ID NO: 18380 - protein, 10 aa, Artificial Sequence
  source: /note="Description of Artificial Sequence: Synthetic peptide"
TLWYWASIYF

SEQ ID NO: 18381 - protein, 10 aa, Artificial Sequence
  source: /note="Description of Artificial Sequence: Synthetic peptide"
WYWASIYFCI

SEQ ID NO: 18382 - protein, 10 aa, Artificial Sequence
  source: /note="Description of Artificial Sequence: Synthetic peptide"
DTLWYWASIY

SEQ ID NO: 18383 - protein, 10 aa, Artificial Sequence
  source: /note="Description of Artificial Sequence: Synthetic peptide"
VLLSLADTLW

SEQ ID NO: 18384 - protein, 10 aa, Artificial Sequence
  source: /note="Description of Artificial Sequence: Synthetic peptide"
ADTLWYWASI

SEQ ID NO: 18385 - protein, 9 aa, Artificial Sequence
  source: /note="Description of Artificial Sequence: Synthetic peptide"
HLVIADTFV

SEQ ID NO: 18386 - protein, 9 aa, Artificial Sequence
  source: /note="Description of Artificial Sequence: Synthetic peptide"
LVIADTFVR

SEQ ID NO: 18387 - protein, 9 aa, Artificial Sequence
  source: /note="Description of Artificial Sequence: Synthetic peptide"
KHLVIADTF

SEQ ID NO: 18388 - protein, 9 aa, Artificial Sequence
  source: /note="Description of Artificial Sequence: Synthetic peptide"
TFVRHIDNV

SEQ ID NO: 18389 - protein, 10 aa, Artificial Sequence
  source: /note="Description of Artificial Sequence: Synthetic peptide"
VIADTFVRHI

SEQ ID NO: 18390 - protein, 10 aa, Artificial Sequence
  source: /note="Description of Artificial Sequence: Synthetic peptide"
TFVRHIDNVF

SEQ ID NO: 18391 - protein, 10 aa, Artificial Sequence
  source: /note="Description of Artificial Sequence: Synthetic peptide"
HLVIADTFVR

SEQ ID NO: 18392 - protein, 10 aa, Artificial Sequence
  source: /note="Description of Artificial Sequence: Synthetic peptide"
DTFVRHIDNV

SEQ ID NO: 18393 - protein, 10 aa, Artificial Sequence
  source: /note="Description of Artificial Sequence: Synthetic peptide"
NKHLVIADTF

SEQ ID NO: 18394 - protein, 9 aa, Artificial Sequence
  source: /note="Description of Artificial Sequence: Synthetic peptide"
ASQNGLEKY

SEQ ID NO: 18395 - protein, 9 aa, Artificial Sequence
  source: /note="Description of Artificial Sequence: Synthetic peptide"
IASQNGLEK

SEQ ID NO: 18396 - protein, 9 aa, Artificial Sequence
  source: /note="Description of Artificial Sequence: Synthetic peptide"
FEIASQNGL

SEQ ID NO: 18397 - protein, 9 aa, Artificial Sequence
  source: /note="Description of Artificial Sequence: Synthetic peptide"
SQNGLEKYI

SEQ ID NO: 18398 - protein, 10 aa, Artificial Sequence
  source: /note="Description of Artificial Sequence: Synthetic peptide"
IASQNGLEKY

SEQ ID NO: 18399 - protein, 10 aa, Artificial Sequence
  source: /note="Description of Artificial Sequence: Synthetic peptide"
RKFEIASQNG

SEQ ID NO: 18400 - protein, 10 aa, Artificial Sequence
  source: /note="Description of Artificial Sequence: Synthetic peptide"
SQNGLEKYIL

SEQ ID NO: 18401 - protein, 9 aa, Artificial Sequence
  source: /note="Description of Artificial Sequence: Synthetic peptide"
ILQRMTFSV

SEQ ID NO: 18402 - protein, 9 aa, Artificial Sequence
  source: /note="Description of Artificial Sequence: Synthetic peptide"
RMTFSVAPA

SEQ ID NO: 18403 - protein, 9 aa, Artificial Sequence
  source: /note="Description of Artificial Sequence: Synthetic peptide"
RILQRMTFS

SEQ ID NO: 18404 - protein, 9 aa, Artificial Sequence
  source: /note="Description of Artificial Sequence: Synthetic peptide"
LQRMTFSVA

SEQ ID NO: 18405 - protein, 9 aa, Artificial Sequence
  source: /note="Description of Artificial Sequence: Synthetic peptide"
MTFSVAPAS

SEQ ID NO: 18406 - protein, 9 aa, Artificial Sequence
  source: /note="Description of Artificial Sequence: Synthetic peptide"
VRILQRMTF

SEQ ID NO: 18407 - protein, 10 aa, Artificial Sequence
  source: /note="Description of Artificial Sequence: Synthetic peptide"
RILQRMTFSV

SEQ ID NO: 18408 - protein, 10 aa, Artificial Sequence
  source: /note="Description of Artificial Sequence: Synthetic peptide"
ILQRMTFSVA

SEQ ID NO: 18409 - protein, 10 aa, Artificial Sequence
  source: /note="Description of Artificial Sequence: Synthetic peptide"
TFSVAPASQR

SEQ ID NO: 18410 - protein, 10 aa, Artificial Sequence
  source: /note="Description of Artificial Sequence: Synthetic peptide"
YVRILQRMTF

SEQ ID NO: 18411 - protein, 10 aa, Artificial Sequence
  source: /note="Description of Artificial Sequence: Synthetic peptide"
LQRMTFSVAP

SEQ ID NO: 18412 - protein, 10 aa, Artificial Sequence
  source: /note="Description of Artificial Sequence: Synthetic peptide"
QRMTFSVAPA

SEQ ID NO: 18413 - protein, 10 aa, Artificial Sequence
  source: /note="Description of Artificial Sequence: Synthetic peptide"
RMTFSVAPAS

SEQ ID NO: 18414 - protein, 9 aa, Artificial Sequence
  source: /note="Description of Artificial Sequence: Synthetic peptide"
YLQLYNVSI

SEQ ID NO: 18415 - protein, 9 aa, Artificial Sequence
  source: /note="Description of Artificial Sequence: Synthetic peptide"
NVSIGNHAY

SEQ ID NO: 18416 - protein, 9 aa, Artificial Sequence
  source: /note="Description of Artificial Sequence: Synthetic peptide"
LQLYNVSIG

SEQ ID NO: 18417 - protein, 10 aa, Artificial Sequence
  source: /note="Description of Artificial Sequence: Synthetic peptide"
SIGNHAYENK

SEQ ID NO: 18418 - protein, 10 aa, Artificial Sequence
  source: /note="Description of Artificial Sequence: Synthetic peptide"
QYLQLYNVSI

SEQ ID NO: 18419 - protein, 10 aa, Artificial Sequence
  source: /note="Description of Artificial Sequence: Synthetic peptide"
YNVSIGNHAY

SEQ ID NO: 18420 - protein, 9 aa, Artificial Sequence
  source: /note="Description of Artificial Sequence: Synthetic peptide"
LLQKGKERY

SEQ ID NO: 18421 - protein, 10 aa, Artificial Sequence
  source: /note="Description of Artificial Sequence: Synthetic peptide"
NALPENLLQK

SEQ ID NO: 18422 - protein, 9 aa, Artificial Sequence
  source: /note="Description of Artificial Sequence: Synthetic peptide"
NLQRHVCNI

SEQ ID NO: 18423 - protein, 9 aa, Artificial Sequence
  source: /note="Description of Artificial Sequence: Synthetic peptide"
RHVCNIHNK

SEQ ID NO: 18424 - protein, 9 aa, Artificial Sequence
  source: /note="Description of Artificial Sequence: Synthetic peptide"
LQRHVCNIH

SEQ ID NO: 18425 - protein, 10 aa, Artificial Sequence
  source: /note="Description of Artificial Sequence: Synthetic peptide"
HVCNIHNKEK

SEQ ID NO: 18426 - protein, 10 aa, Artificial Sequence
  source: /note="Description of Artificial Sequence: Synthetic peptide"
CNIHNKEKPF

SEQ ID NO: 18427 - protein, 9 aa, Artificial Sequence
  source: /note="Description of Artificial Sequence: Synthetic peptide"
QKEDERTAL

SEQ ID NO: 18428 - protein, 10 aa, Artificial Sequence
  source: /note="Description of Artificial Sequence: Synthetic peptide"
KQKEDERTAL

SEQ ID NO: 18429 - protein, 10 aa, Artificial Sequence
  source: /note="Description of Artificial Sequence: Synthetic peptide"
RTALNVKQGF

SEQ ID NO: 18430 - protein, 10 aa, Artificial Sequence
  source: /note="Description of Artificial Sequence: Synthetic peptide"
KEDERTALNV

SEQ ID NO: 18431 - protein, 9 aa, Artificial Sequence
  source: /note="Description of Artificial Sequence: Synthetic peptide"
KQSFNNQPA

SEQ ID NO: 18432 - protein, 9 aa, Artificial Sequence
  source: /note="Description of Artificial Sequence: Synthetic peptide"
TALNVKQSF

SEQ ID NO: 18433 - protein, 9 aa, Artificial Sequence
  source: /note="Description of Artificial Sequence: Synthetic peptide"
QSFNNQPAV

SEQ ID NO: 18434 - protein, 10 aa, Artificial Sequence
  source: /note="Description of Artificial Sequence: Synthetic peptide"
KQSFNNQPAV

SEQ ID NO: 18435 - protein, 10 aa, Artificial Sequence
  source: /note="Description of Artificial Sequence: Synthetic peptide"
LTALNVKQSF

SEQ ID NO: 18436 - protein, 10 aa, Artificial Sequence
  source: /note="Description of Artificial Sequence: Synthetic peptide"
VKQSFNNQPA

SEQ ID NO: 18437 - protein, 9 aa, Artificial Sequence
  source: /note="Description of Artificial Sequence: Synthetic peptide"
AVFAVFKAV

SEQ ID NO: 18438 - protein, 9 aa, Artificial Sequence
  source: /note="Description of Artificial Sequence: Synthetic peptide"
FAVFKAVFV

SEQ ID NO: 18439 - protein, 9 aa, Artificial Sequence
  source: /note="Description of Artificial Sequence: Synthetic peptide"
AVFKAVFVL

SEQ ID NO: 18440 - protein, 9 aa, Artificial Sequence
  source: /note="Description of Artificial Sequence: Synthetic peptide"
VFAVFKAVF

SEQ ID NO: 18441 - protein, 9 aa, Artificial Sequence
  source: /note="Description of Artificial Sequence: Synthetic peptide"
VDGAVFAVF

SEQ ID NO: 18442 - protein, 10 aa, Artificial Sequence
  source: /note="Description of Artificial Sequence: Synthetic peptide"
FAVFKAVFVL

SEQ ID NO: 18443 - protein, 10 aa, Artificial Sequence
  source: /note="Description of Artificial Sequence: Synthetic peptide"
AVFAVFKAVF

SEQ ID NO: 18444 - protein, 10 aa, Artificial Sequence
  source: /note="Description of Artificial Sequence: Synthetic peptide"
IVDGAVFAVF

SEQ ID NO: 18445 - protein, 9 aa, Artificial Sequence
  source: /note="Description of Artificial Sequence: Synthetic peptide"
QLIYYPHGI

SEQ ID NO: 18446 - protein, 9 aa, Artificial Sequence
  source: /note="Description of Artificial Sequence: Synthetic peptide"
LIYYPHGIK

SEQ ID NO: 18447 - protein, 9 aa, Artificial Sequence
  source: /note="Description of Artificial Sequence: Synthetic peptide"
AQKLLQLIY

SEQ ID NO: 18448 - protein, 9 aa, Artificial Sequence
  source: /note="Description of Artificial Sequence: Synthetic peptide"
QKLLQLIYY

SEQ ID NO: 18449 - protein, 10 aa, Artificial Sequence
  source: /note="Description of Artificial Sequence: Synthetic peptide"
QAQKLLQLIY

SEQ ID NO: 18450 - protein, 10 aa, Artificial Sequence
  source: /note="Description of Artificial Sequence: Synthetic peptide"
LQLIYYPHGI

SEQ ID NO: 18451 - protein, 10 aa, Artificial Sequence
  source: /note="Description of Artificial Sequence: Synthetic peptide"
QLIYYPHGIK

SEQ ID NO: 18452 - protein, 10 aa, Artificial Sequence
  source: /note="Description of Artificial Sequence: Synthetic peptide"
AQKLLQLIYY

SEQ ID NO: 18453 - protein, 9 aa, Artificial Sequence
  source: /note="Description of Artificial Sequence: Synthetic peptide"
LQMQQPQQS

SEQ ID NO: 18454 - protein, 9 aa, Artificial Sequence
  source: /note="Description of Artificial Sequence: Synthetic peptide"
MQQPQQSQP

SEQ ID NO: 18455 - protein, 10 aa, Artificial Sequence
  source: /note="Description of Artificial Sequence: Synthetic peptide"
LQMQQPQQSQ

SEQ ID NO: 18456 - protein, 10 aa, Artificial Sequence
  source: /note="Description of Artificial Sequence: Synthetic peptide"
MQQPQQSQPQ

SEQ ID NO: 18457 - protein, 9 aa, Artificial Sequence
  source: /note="Description of Artificial Sequence: Synthetic peptide"
QQTQQQQTA

SEQ ID NO: 18458 - protein, 9 aa, Artificial Sequence
  source: /note="Description of Artificial Sequence: Synthetic peptide"
TQQQQTAAL

SEQ ID NO: 18459 - protein, 10 aa, Artificial Sequence
  source: /note="Description of Artificial Sequence: Synthetic peptide"
TQQQQTAALV

SEQ ID NO: 18460 - protein, 10 aa, Artificial Sequence
  source: /note="Description of Artificial Sequence: Synthetic peptide"
LQQTQQQQTA

SEQ ID NO: 18461 - protein, 10 aa, Artificial Sequence
  source: /note="Description of Artificial Sequence: Synthetic peptide"
QQTQQQQTAA

SEQ ID NO: 18462 - protein, 9 aa, Artificial Sequence
  source: /note="Description of Artificial Sequence: Synthetic peptide"
GVAHIKSSK

SEQ ID NO: 18463 - protein, 9 aa, Artificial Sequence
  source: /note="Description of Artificial Sequence: Synthetic peptide"
MRKAGVAHI

SEQ ID NO: 18464 - protein, 9 aa, Artificial Sequence
  source: /note="Description of Artificial Sequence: Synthetic peptide"
AHIKSSKDM

SEQ ID NO: 18465 - protein, 10 aa, Artificial Sequence
  source: /note="Description of Artificial Sequence: Synthetic peptide"
AMRKAGVAHI

SEQ ID NO: 18466 - protein, 10 aa, Artificial Sequence
  source: /note="Description of Artificial Sequence: Synthetic peptide"
MRKAGVAHIK

SEQ ID NO: 18467 - protein, 10 aa, Artificial Sequence
  source: /note="Description of Artificial Sequence: Synthetic peptide"
AGVAHIKSSK

SEQ ID NO: 18468 - protein, 10 aa, Artificial Sequence
  source: /note="Description of Artificial Sequence: Synthetic peptide"
DSQGKLSVLR

SEQ ID NO: 18469 - protein, 10 aa, Artificial Sequence
  source: /note="Description of Artificial Sequence: Synthetic peptide"
IDSQGKLSVL

SEQ ID NO: 18470 - protein, 10 aa, Artificial Sequence
  source: /note="Description of Artificial Sequence: Synthetic peptide"
SQGKLSVLRL

SEQ ID NO: 18471 - protein, 9 aa, Artificial Sequence
  source: /note="Description of Artificial Sequence: Synthetic peptide"
SSDPDTSYV

SEQ ID NO: 18472 - protein, 9 aa, Artificial Sequence
  source: /note="Description of Artificial Sequence: Synthetic peptide"
DSSDPDTSY

SEQ ID NO: 18473 - protein, 10 aa, Artificial Sequence
  source: /note="Description of Artificial Sequence: Synthetic peptide"
DSSDPDTSYV

SEQ ID NO: 18474 - protein, 10 aa, Artificial Sequence
  source: /note="Description of Artificial Sequence: Synthetic peptide"
CDSSDPDTSY

SEQ ID NO: 18475 - protein, 9 aa, Artificial Sequence
  source: /note="Description of Artificial Sequence: Synthetic peptide"
NMMQNHKIA

SEQ ID NO: 18476 - protein, 9 aa, Artificial Sequence
  source: /note="Description of Artificial Sequence: Synthetic peptide"
MMQNHKIAP

SEQ ID NO: 18477 - protein, 9 aa, Artificial Sequence
  source: /note="Description of Artificial Sequence: Synthetic peptide"
MQNHKIAPG

SEQ ID NO: 18478 - protein, 10 aa, Artificial Sequence
  source: /note="Description of Artificial Sequence: Synthetic peptide"
MQNHKIAPGL

SEQ ID NO: 18479 - protein, 10 aa, Artificial Sequence
  source: /note="Description of Artificial Sequence: Synthetic peptide"
MMQNHKIAPG

SEQ ID NO: 18480 - protein, 10 aa, Artificial Sequence
  source: /note="Description of Artificial Sequence: Synthetic peptide"
EEFDNMMQNH

SEQ ID NO: 18481 - protein, 9 aa, Artificial Sequence
  source: /note="Description of Artificial Sequence: Synthetic peptide"
KHHLKQVQL

SEQ ID NO: 18482 - protein, 9 aa, Artificial Sequence
  source: /note="Description of Artificial Sequence: Synthetic peptide"
HHLKQVQLL

SEQ ID NO: 18483 - protein, 10 aa, Artificial Sequence
  source: /note="Description of Artificial Sequence: Synthetic peptide"
HHLKQVQLLF

SEQ ID NO: 18484 - protein, 10 aa, Artificial Sequence
  source: /note="Description of Artificial Sequence: Synthetic peptide"
QPLPQCKHHL

SEQ ID NO: 18485 - protein, 10 aa, Artificial Sequence
  source: /note="Description of Artificial Sequence: Synthetic peptide"
CKHHLKQVQL

SEQ ID NO: 18486 - protein, 10 aa, Artificial Sequence
  source: /note="Description of Artificial Sequence: Synthetic peptide"
KHHLKQVQLL

SEQ ID NO: 18487 - protein, 9 aa, Artificial Sequence
  source: /note="Description of Artificial Sequence: Synthetic peptide"
YVEMKLPAR

SEQ ID NO: 18488 - protein, 9 aa, Artificial Sequence
  source: /note="Description of Artificial Sequence: Synthetic peptide"
LPARRDSPY

SEQ ID NO: 18489 - protein, 10 aa, Artificial Sequence
  source: /note="Description of Artificial Sequence: Synthetic peptide"
KLPARRDSPY

SEQ ID NO: 18490 - protein, 10 aa, Artificial Sequence
  source: /note="Description of Artificial Sequence: Synthetic peptide"
YVEMKLPARR

SEQ ID NO: 18491 - protein, 10 aa, Artificial Sequence
  source: /note="Description of Artificial Sequence: Synthetic peptide"
LPARRDSPYA

SEQ ID NO: 18492 - protein, 10 aa, Artificial Sequence
  source: /note="Description of Artificial Sequence: Synthetic peptide"
SECGYVEMKL

SEQ ID NO: 18493 - protein, 9 aa, Artificial Sequence
  source: /note="Description of Artificial Sequence: Synthetic peptide"
CECGCYAGY

SEQ ID NO: 18494 - protein, 10 aa, Artificial Sequence
  source: /note="Description of Artificial Sequence: Synthetic peptide"
NPGGCECGCY

SEQ ID NO: 18495 - protein, 9 aa, Artificial Sequence
  source: /note="Description of Artificial Sequence: Synthetic peptide"
LPLPPGCQW

SEQ ID NO: 18496 - protein, 10 aa, Artificial Sequence
  source: /note="Description of Artificial Sequence: Synthetic peptide"
CDSVTGALPL

SEQ ID NO: 18497 - protein, 9 aa, Artificial Sequence
  source: /note="Description of Artificial Sequence: Synthetic peptide"
RGHFGCVYY

SEQ ID NO: 18498 - protein, 10 aa, Artificial Sequence
  source: /note="Description of Artificial Sequence: Synthetic peptide"
HFGCVYYGTL

SEQ ID NO: 18499 - protein, 9 aa, Artificial Sequence
  source: /note="Description of Artificial Sequence: Synthetic peptide"
KLPVKWTAL

SEQ ID NO: 18500 - protein, 9 aa, Artificial Sequence
  source: /note="Description of Artificial Sequence: Synthetic peptide"
VKWTALESL

SEQ ID NO: 18501 - protein, 10 aa, Artificial Sequence
  source: /note="Description of Artificial Sequence: Synthetic peptide"
TALESLQTQK

SEQ ID NO: 18502 - protein, 10 aa, Artificial Sequence
  source: /note="Description of Artificial Sequence: Synthetic peptide"
AKLPVKWTAL

SEQ ID NO: 18503 - protein, 10 aa, Artificial Sequence
  source: /note="Description of Artificial Sequence: Synthetic peptide"
LPVKWTALES

SEQ ID NO: 18504 - protein, 9 aa, Artificial Sequence
  source: /note="Description of Artificial Sequence: Synthetic peptide"
REQTDQTEA

SEQ ID NO: 18505 - protein, 9 aa, Artificial Sequence
  source: /note="Description of Artificial Sequence: Synthetic peptide"
SQNPRRPPP

SEQ ID NO: 18506 - protein, 10 aa, Artificial Sequence
  source: /note="Description of Artificial Sequence: Synthetic peptide"
SQNPRRPPPS

SEQ ID NO: 18507 - protein, 9 aa, Artificial Sequence
  source: /note="Description of Artificial Sequence: Synthetic peptide"
ILLACQIRY

SEQ ID NO: 18508 - protein, 9 aa, Artificial Sequence
  source: /note="Description of Artificial Sequence: Synthetic peptide"
LACQIRYER

SEQ ID NO: 18509 - protein, 10 aa, Artificial Sequence
  source: /note="Description of Artificial Sequence: Synthetic peptide"
VILLACQIRY

SEQ ID NO: 18510 - protein, 10 aa, Artificial Sequence
  source: /note="Description of Artificial Sequence: Synthetic peptide"
SVILLACQIR

SEQ ID NO: 18511 - protein, 10 aa, Artificial Sequence
  source: /note="Description of Artificial Sequence: Synthetic peptide"
LLACQIRYER

SEQ ID NO: 18512 - protein, 9 aa, Artificial Sequence
  source: /note="Description of Artificial Sequence: Synthetic peptide"
FYKRNSTNL

SEQ ID NO: 18513 - protein, 9 aa, Artificial Sequence
  source: /note="Description of Artificial Sequence: Synthetic peptide"
KRNSTNLFK

SEQ ID NO: 18514 - protein, 9 aa, Artificial Sequence
  source: /note="Description of Artificial Sequence: Synthetic peptide"
YKRNSTNLF

SEQ ID NO: 18515 - protein, 10 aa, Artificial Sequence
  source: /note="Description of Artificial Sequence: Synthetic peptide"
LFYKRNSTNL

SEQ ID NO: 18516 - protein, 10 aa, Artificial Sequence
  source: /note="Description of Artificial Sequence: Synthetic peptide"
FYKRNSTNLF

SEQ ID NO: 18517 - protein, 10 aa, Artificial Sequence
  source: /note="Description of Artificial Sequence: Synthetic peptide"
YKRNSTNLFK

SEQ ID NO: 18518 - protein, 10 aa, Artificial Sequence
  source: /note="Description of Artificial Sequence: Synthetic peptide"
LFKDRHWTTR

SEQ ID NO: 18519 - protein, 9 aa, Artificial Sequence
  source: /note="Description of Artificial Sequence: Synthetic peptide"
QWFVCNREK

SEQ ID NO: 18520 - protein, 9 aa, Artificial Sequence
  source: /note="Description of Artificial Sequence: Synthetic peptide"
NHQWFVCNR

SEQ ID NO: 18521 - protein, 9 aa, Artificial Sequence
  source: /note="Description of Artificial Sequence: Synthetic peptide"
GRKENHQWF

SEQ ID NO: 18522 - protein, 9 aa, Artificial Sequence
  source: /note="Description of Artificial Sequence: Synthetic peptide"
KENHQWFVC

SEQ ID NO: 18523 - protein, 10 aa, Artificial Sequence
  source: /note="Description of Artificial Sequence: Synthetic peptide"
HQWFVCNREK

SEQ ID NO: 18524 - protein, 10 aa, Artificial Sequence
  source: /note="Description of Artificial Sequence: Synthetic peptide"
ENHQWFVCNR

SEQ ID NO: 18525 - protein, 9 aa, Artificial Sequence
  source: /note="Description of Artificial Sequence: Synthetic peptide"
TQSRGSQPS

SEQ ID NO: 18526 - protein, 10 aa, Artificial Sequence
  source: /note="Description of Artificial Sequence: Synthetic peptide"
KTQSRGSQPS

SEQ ID NO: 18527 - protein, 10 aa, Artificial Sequence
  source: /note="Description of Artificial Sequence: Synthetic peptide"
TQSRGSQPST

SEQ ID NO: 18528 - protein, 9 aa, Artificial Sequence
  source: /note="Description of Artificial Sequence: Synthetic peptide"
EAAAAAGVL

SEQ ID NO: 18529 - protein, 9 aa, Artificial Sequence
  source: /note="Description of Artificial Sequence: Synthetic peptide"
REAAAAAGV

SEQ ID NO: 18530 - protein, 10 aa, Artificial Sequence
  source: /note="Description of Artificial Sequence: Synthetic peptide"
EAAAAAGVLY

SEQ ID NO: 18531 - protein, 10 aa, Artificial Sequence
  source: /note="Description of Artificial Sequence: Synthetic peptide"
REAAAAAGVL

SEQ ID NO: 18532 - protein, 9 aa, Artificial Sequence
  source: /note="Description of Artificial Sequence: Synthetic peptide"
TSFDTSLGR

SEQ ID NO: 18533 - protein, 9 aa, Artificial Sequence
  source: /note="Description of Artificial Sequence: Synthetic peptide"
KGTSFDTSL

SEQ ID NO: 18534 - protein, 10 aa, Artificial Sequence
  source: /note="Description of Artificial Sequence: Synthetic peptide"
GTSFDTSLGR

SEQ ID NO: 18535 - protein, 10 aa, Artificial Sequence
  source: /note="Description of Artificial Sequence: Synthetic peptide"
TSFDTSLGRV

SEQ ID NO: 18536 - protein, 10 aa, Artificial Sequence
  source: /note="Description of Artificial Sequence: Synthetic peptide"
SKGTSFDTSL

SEQ ID NO: 18537 - protein, 9 aa, Artificial Sequence
  source: /note="Description of Artificial Sequence: Synthetic peptide"
RSMSENAVC

SEQ ID NO: 18538 - protein, 9 aa, Artificial Sequence
  source: /note="Description of Artificial Sequence: Synthetic peptide"
SENAVCQNG

SEQ ID NO: 18539 - protein, 10 aa, Artificial Sequence
  source: /note="Description of Artificial Sequence: Synthetic peptide"
NAVCQNGQLV

SEQ ID NO: 18540 - protein, 9 aa, Artificial Sequence
  source: /note="Description of Artificial Sequence: Synthetic peptide"
SLNGHEFNF

SEQ ID NO: 18541 - protein, 9 aa, Artificial Sequence
  source: /note="Description of Artificial Sequence: Synthetic peptide"
HEFNFIHDV

SEQ ID NO: 18542 - protein, 10 aa, Artificial Sequence
  source: /note="Description of Artificial Sequence: Synthetic peptide"
SLNGHEFNFI

SEQ ID NO: 18543 - protein, 10 aa, Artificial Sequence
  source: /note="Description of Artificial Sequence: Synthetic peptide"
YSLNGHEFNF

SEQ ID NO: 18544 - protein, 10 aa, Artificial Sequence
  source: /note="Description of Artificial Sequence: Synthetic peptide"
EFNFIHDVNK

SEQ ID NO: 18545 - protein, 10 aa, Artificial Sequence
  source: /note="Description of Artificial Sequence: Synthetic peptide"
HEFNFIHDVN

SEQ ID NO: 18546 - protein, 9 aa, Artificial Sequence
  source: /note="Description of Artificial Sequence: Synthetic peptide"
WIPATFAQA

SEQ ID NO: 18547 - protein, 9 aa, Artificial Sequence
  source: /note="Description of Artificial Sequence: Synthetic peptide"
AQAAFWNHV

SEQ ID NO: 18548 - protein, 9 aa, Artificial Sequence
  source: /note="Description of Artificial Sequence: Synthetic peptide"
QAAFWNHVL

SEQ ID NO: 18549 - protein, 9 aa, Artificial Sequence
  source: /note="Description of Artificial Sequence: Synthetic peptide"
IPATFAQAA

SEQ ID NO: 18550 - protein, 9 aa, Artificial Sequence
  source: /note="Description of Artificial Sequence: Synthetic peptide"
ATFAQAAFW

SEQ ID NO: 18551 - protein, 10 aa, Artificial Sequence
  source: /note="Description of Artificial Sequence: Synthetic peptide"
FAQAAFWNHV

SEQ ID NO: 18552 - protein, 10 aa, Artificial Sequence
  source: /note="Description of Artificial Sequence: Synthetic peptide"
AQAAFWNHVL

SEQ ID NO: 18553 - protein, 10 aa, Artificial Sequence
  source: /note="Description of Artificial Sequence: Synthetic peptide"
WIPATFAQAA

SEQ ID NO: 18554 - protein, 10 aa, Artificial Sequence
  source: /note="Description of Artificial Sequence: Synthetic peptide"
QAAFWNHVLA

SEQ ID NO: 18555 - protein, 10 aa, Artificial Sequence
  source: /note="Description of Artificial Sequence: Synthetic peptide"
IPATFAQAAF

SEQ ID NO: 18556 - protein, 10 aa, Artificial Sequence
  source: /note="Description of Artificial Sequence: Synthetic peptide"
AEWIPATFAQ

SEQ ID NO: 18557 - protein, 9 aa, Artificial Sequence
  source: /note="Description of Artificial Sequence: Synthetic peptide"
HTANERRQR

SEQ ID NO: 18558 - protein, 9 aa, Artificial Sequence
  source: /note="Description of Artificial Sequence: Synthetic peptide"
NERRQRGEM

SEQ ID NO: 18559 - protein, 9 aa, Artificial Sequence
  source: /note="Description of Artificial Sequence: Synthetic peptide"
RQRGEMRDL

SEQ ID NO: 18560 - protein, 10 aa, Artificial Sequence
  source: /note="Description of Artificial Sequence: Synthetic peptide"
RQRGEMRDLF

SEQ ID NO: 18561 - protein, 9 aa, Artificial Sequence
  source: /note="Description of Artificial Sequence: Synthetic peptide"
FFWAFPPAA

SEQ ID NO: 18562 - protein, 9 aa, Artificial Sequence
  source: /note="Description of Artificial Sequence: Synthetic peptide"
AFPPAAGDF

SEQ ID NO: 18563 - protein, 9 aa, Artificial Sequence
  source: /note="Description of Artificial Sequence: Synthetic peptide"
DFFWAFPPA

SEQ ID NO: 18564 - protein, 9 aa, Artificial Sequence
  source: /note="Description of Artificial Sequence: Synthetic peptide"
FPPAAGDFI

SEQ ID NO: 18565 - protein, 10 aa, Artificial Sequence
  source: /note="Description of Artificial Sequence: Synthetic peptide"
AFPPAAGDFI

SEQ ID NO: 18566 - protein, 10 aa, Artificial Sequence
  source: /note="Description of Artificial Sequence: Synthetic peptide"
WAFPPAAGDF

SEQ ID NO: 18567 - protein, 10 aa, Artificial Sequence
  source: /note="Description of Artificial Sequence: Synthetic peptide"
PPAAGDFIRF

SEQ ID NO: 18568 - protein, 10 aa, Artificial Sequence
  source: /note="Description of Artificial Sequence: Synthetic peptide"
REDFFWAFPP

SEQ ID NO: 18569 - protein, 10 aa, Artificial Sequence
  source: /note="Description of Artificial Sequence: Synthetic peptide"
EDFFWAFPPA

SEQ ID NO: 18570 - protein, 9 aa, Artificial Sequence
  source: /note="Description of Artificial Sequence: Synthetic peptide"
SSYKGMENK

SEQ ID NO: 18571 - protein, 9 aa, Artificial Sequence
  source: /note="Description of Artificial Sequence: Synthetic peptide"
SYKGMENKL

SEQ ID NO: 18572 - protein, 9 aa, Artificial Sequence
  source: /note="Description of Artificial Sequence: Synthetic peptide"
GYYSSYKGM

SEQ ID NO: 18573 - protein, 10 aa, Artificial Sequence
  source: /note="Description of Artificial Sequence: Synthetic peptide"
YSSYKGMENK

SEQ ID NO: 18574 - protein, 10 aa, Artificial Sequence
  source: /note="Description of Artificial Sequence: Synthetic peptide"
SYKGMENKLK

SEQ ID NO: 18575 - protein, 10 aa, Artificial Sequence
  source: /note="Description of Artificial Sequence: Synthetic peptide"
MGYYSSYKGM

SEQ ID NO: 18576 - protein, 10 aa, Artificial Sequence
  source: /note="Description of Artificial Sequence: Synthetic peptide"
SSYKGMENKL

SEQ ID NO: 18577 - protein, 10 aa, Artificial Sequence
  source: /note="Description of Artificial Sequence: Synthetic peptide"
MENKLKDDDF

SEQ ID NO: 18578 - protein, 9 aa, Artificial Sequence
  source: /note="Description of Artificial Sequence: Synthetic peptide"
EAAKNGSPV

SEQ ID NO: 18579 - protein, 10 aa, Artificial Sequence
  source: /note="Description of Artificial Sequence: Synthetic peptide"
SEAAKNGSPV

SEQ ID NO: 18580 - protein, 9 aa, Artificial Sequence
  source: /note="Description of Artificial Sequence: Synthetic peptide"
GQWTQMLPL

SEQ ID NO: 18581 - protein, 9 aa, Artificial Sequence
  source: /note="Description of Artificial Sequence: Synthetic peptide"
GLKTLIHFK

SEQ ID NO: 18582 - protein, 9 aa, Artificial Sequence
  source: /note="Description of Artificial Sequence: Synthetic peptide"
QMLPLKNYR

SEQ ID NO: 18583 - protein, 9 aa, Artificial Sequence
  source: /note="Description of Artificial Sequence: Synthetic peptide"
GFGQWTQML

SEQ ID NO: 18584 - protein, 9 aa, Artificial Sequence
  source: /note="Description of Artificial Sequence: Synthetic peptide"
RGLKTLIHF

SEQ ID NO: 18585 - protein, 9 aa, Artificial Sequence
  source: /note="Description of Artificial Sequence: Synthetic peptide"
QWTQMLPLK

SEQ ID NO: 18586 - protein, 9 aa, Artificial Sequence
  source: /note="Description of Artificial Sequence: Synthetic peptide"
PLKNYRGLK

SEQ ID NO: 18587 - protein, 9 aa, Artificial Sequence
  source: /note="Description of Artificial Sequence: Synthetic peptide"
TQMLPLKNY

SEQ ID NO: 18588 - protein, 9 aa, Artificial Sequence
  source: /note="Description of Artificial Sequence: Synthetic peptide"
LPLKNYRGL

SEQ ID NO: 18589 - protein, 9 aa, Artificial Sequence
  source: /note="Description of Artificial Sequence: Synthetic peptide"
HLGWVKSGF

SEQ ID NO: 18590 - protein, 9 aa, Artificial Sequence
  source: /note="Description of Artificial Sequence: Synthetic peptide"
WVKSGFGQW

SEQ ID NO: 18591 - protein, 9 aa, Artificial Sequence
  source: /note="Description of Artificial Sequence: Synthetic peptide"
SGFGQWTQM

SEQ ID NO: 18592 - protein, 9 aa, Artificial Sequence
  source: /note="Description of Artificial Sequence: Synthetic peptide"
KNYRGLKTL

SEQ ID NO: 18593 - protein, 10 aa, Artificial Sequence
  source: /note="Description of Artificial Sequence: Synthetic peptide"
WTQMLPLKNY

SEQ ID NO: 18594 - protein, 10 aa, Artificial Sequence
  source: /note="Description of Artificial Sequence: Synthetic peptide"
MLPLKNYRGL

SEQ ID NO: 18595 - protein, 10 aa, Artificial Sequence
  source: /note="Description of Artificial Sequence: Synthetic peptide"
GQWTQMLPLK

SEQ ID NO: 18596 - protein, 10 aa, Artificial Sequence
  source: /note="Description of Artificial Sequence: Synthetic peptide"
RGLKTLIHFK

SEQ ID NO: 18597 - protein, 10 aa, Artificial Sequence
  source: /note="Description of Artificial Sequence: Synthetic peptide"
TQMLPLKNYR

SEQ ID NO: 18598 - protein, 10 aa, Artificial Sequence
  source: /note="Description of Artificial Sequence: Synthetic peptide"
GWVKSGFGQW

SEQ ID NO: 18599 - protein, 10 aa, Artificial Sequence
  source: /note="Description of Artificial Sequence: Synthetic peptide"
QHLGWVKSGF

SEQ ID NO: 18600 - protein, 10 aa, Artificial Sequence
  source: /note="Description of Artificial Sequence: Synthetic peptide"
KSGFGQWTQM

SEQ ID NO: 18601 - protein, 10 aa, Artificial Sequence
  source: /note="Description of Artificial Sequence: Synthetic peptide"
SGFGQWTQML

SEQ ID NO: 18602 - protein, 10 aa, Artificial Sequence
  source: /note="Description of Artificial Sequence: Synthetic peptide"
FGQWTQMLPL

SEQ ID NO: 18603 - protein, 10 aa, Artificial Sequence
  source: /note="Description of Artificial Sequence: Synthetic peptide"
LKNYRGLKTL

SEQ ID NO: 18604 - protein, 10 aa, Artificial Sequence
  source: /note="Description of Artificial Sequence: Synthetic peptide"
KNYRGLKTLI

SEQ ID NO: 18605 - protein, 10 aa, Artificial Sequence
  source: /note="Description of Artificial Sequence: Synthetic peptide"
YRGLKTLIHF

SEQ ID NO: 18606 - protein, 9 aa, Artificial Sequence
  source: /note="Description of Artificial Sequence: Synthetic peptide"
VSAVAALLF

SEQ ID NO: 18607 - protein, 9 aa, Artificial Sequence
  source: /note="Description of Artificial Sequence: Synthetic peptide"
AVAALLFLL

SEQ ID NO: 18608 - protein, 9 aa, Artificial Sequence
  source: /note="Description of Artificial Sequence: Synthetic peptide"
LLLLFSMSV

SEQ ID NO: 18609 - protein, 9 aa, Artificial Sequence
  source: /note="Description of Artificial Sequence: Synthetic peptide"
LLLFSMSVV

SEQ ID NO: 18610 - protein, 9 aa, Artificial Sequence
  source: /note="Description of Artificial Sequence: Synthetic peptide"
LLFSMSVVV

SEQ ID NO: 18611 - protein, 9 aa, Artificial Sequence
  source: /note="Description of Artificial Sequence: Synthetic peptide"
HVSAVAALL

SEQ ID NO: 18612 - protein, 9 aa, Artificial Sequence
  source: /note="Description of Artificial Sequence: Synthetic peptide"
SMSVVVRRK

SEQ ID NO: 18613 - protein, 9 aa, Artificial Sequence
  source: /note="Description of Artificial Sequence: Synthetic peptide"
FSMSVVVRR

SEQ ID NO: 18614 - protein, 9 aa, Artificial Sequence
  source: /note="Description of Artificial Sequence: Synthetic peptide"
ALLFLLLLF

SEQ ID NO: 18615 - protein, 9 aa, Artificial Sequence
  source: /note="Description of Artificial Sequence: Synthetic peptide"
LFLLLLFSM

SEQ ID NO: 18616 - protein, 9 aa, Artificial Sequence
  source: /note="Description of Artificial Sequence: Synthetic peptide"
VVRRKHQLQ

SEQ ID NO: 18617 - protein, 9 aa, Artificial Sequence
  source: /note="Description of Artificial Sequence: Synthetic peptide"
LFSMSVVVR

SEQ ID NO: 18618 - protein, 9 aa, Artificial Sequence
  source: /note="Description of Artificial Sequence: Synthetic peptide"
SAVAALLFL

SEQ ID NO: 18619 - protein, 9 aa, Artificial Sequence
  source: /note="Description of Artificial Sequence: Synthetic peptide"
VVVRRKHQL

SEQ ID NO: 18620 - protein, 9 aa, Artificial Sequence
  source: /note="Description of Artificial Sequence: Synthetic peptide"
FHVSAVAAL

SEQ ID NO: 18621 - protein, 9 aa, Artificial Sequence
  source: /note="Description of Artificial Sequence: Synthetic peptide"
VAALLFLLL

SEQ ID NO: 18622 - protein, 9 aa, Artificial Sequence
  source: /note="Description of Artificial Sequence: Synthetic peptide"
HQLQRVQSS

SEQ ID NO: 18623 - protein, 10 aa, Artificial Sequence
  source: /note="Description of Artificial Sequence: Synthetic peptide"
SAVAALLFLL

SEQ ID NO: 18624 - protein, 10 aa, Artificial Sequence
  source: /note="Description of Artificial Sequence: Synthetic peptide"
AVAALLFLLL

SEQ ID NO: 18625 - protein, 10 aa, Artificial Sequence
  source: /note="Description of Artificial Sequence: Synthetic peptide"
LLFLLLLFSM

SEQ ID NO: 18626 - protein, 10 aa, Artificial Sequence
  source: /note="Description of Artificial Sequence: Synthetic peptide"
FLLLLFSMSV

SEQ ID NO: 18627 - protein, 10 aa, Artificial Sequence
  source: /note="Description of Artificial Sequence: Synthetic peptide"
LLLLFSMSVV

SEQ ID NO: 18628 - protein, 10 aa, Artificial Sequence
  source: /note="Description of Artificial Sequence: Synthetic peptide"
LLLFSMSVVV

SEQ ID NO: 18629 - protein, 10 aa, Artificial Sequence
  source: /note="Description of Artificial Sequence: Synthetic peptide"
LLFSMSVVVR

SEQ ID NO: 18630 - protein, 10 aa, Artificial Sequence
  source: /note="Description of Artificial Sequence: Synthetic peptide"
FSMSVVVRRK

SEQ ID NO: 18631 - protein, 10 aa, Artificial Sequence
  source: /note="Description of Artificial Sequence: Synthetic peptide"
AALLFLLLLF

SEQ ID NO: 18632 - protein, 10 aa, Artificial Sequence
  source: /note="Description of Artificial Sequence: Synthetic peptide"
VVRRKHQLQR

SEQ ID NO: 18633 - protein, 10 aa, Artificial Sequence
  source: /note="Description of Artificial Sequence: Synthetic peptide"
HVSAVAALLF

SEQ ID NO: 18634 - protein, 10 aa, Artificial Sequence
  source: /note="Description of Artificial Sequence: Synthetic peptide"
LFSMSVVVRR

SEQ ID NO: 18635 - protein, 10 aa, Artificial Sequence
  source: /note="Description of Artificial Sequence: Synthetic peptide"
SVVVRRKHQL

SEQ ID NO: 18636 - protein, 10 aa, Artificial Sequence
  source: /note="Description of Artificial Sequence: Synthetic peptide"
FHVSAVAALL

SEQ ID NO: 18637 - protein, 9 aa, Artificial Sequence
  source: /note="Description of Artificial Sequence: Synthetic peptide"
KEQIAKDLF

SEQ ID NO: 18638 - protein, 9 aa, Artificial Sequence
  source: /note="Description of Artificial Sequence: Synthetic peptide"
AASVTGMKK

SEQ ID NO: 18639 - protein, 9 aa, Artificial Sequence
  source: /note="Description of Artificial Sequence: Synthetic peptide"
DPAASVTGM

SEQ ID NO: 18640 - protein, 10 aa, Artificial Sequence
  source: /note="Description of Artificial Sequence: Synthetic peptide"
SVTGMKKWPR

SEQ ID NO: 18641 - protein, 10 aa, Artificial Sequence
  source: /note="Description of Artificial Sequence: Synthetic peptide"
AASVTGMKKW

SEQ ID NO: 18642 - protein, 9 aa, Artificial Sequence
  source: /note="Description of Artificial Sequence: Synthetic peptide"
HTKSQQEMV

SEQ ID NO: 18643 - protein, 10 aa, Artificial Sequence
  source: /note="Description of Artificial Sequence: Synthetic peptide"
HTHTKSQQEM

SEQ ID NO: 18644 - protein, 10 aa, Artificial Sequence
  source: /note="Description of Artificial Sequence: Synthetic peptide"
HTKSQQEMVR

SEQ ID NO: 18645 - protein, 9 aa, Artificial Sequence
  source: /note="Description of Artificial Sequence: Synthetic peptide"
HTQSQQEMV

SEQ ID NO: 18646 - protein, 9 aa, Artificial Sequence
  source: /note="Description of Artificial Sequence: Synthetic peptide"
THTQSQQEM

SEQ ID NO: 18647 - protein, 10 aa, Artificial Sequence
  source: /note="Description of Artificial Sequence: Synthetic peptide"
HTHTQSQQEM

SEQ ID NO: 18648 - protein, 10 aa, Artificial Sequence
  source: /note="Description of Artificial Sequence: Synthetic peptide"
HTQSQQEMVR

SEQ ID NO: 18649 - protein, 10 aa, Artificial Sequence
  source: /note="Description of Artificial Sequence: Synthetic peptide"
CTDKPTTDEK

SEQ ID NO: 18650 - protein, 9 aa, Artificial Sequence
  source: /note="Description of Artificial Sequence: Synthetic peptide"
PLGPVGWHV

SEQ ID NO: 18651 - protein, 9 aa, Artificial Sequence
  source: /note="Description of Artificial Sequence: Synthetic peptide"
QYAASPLPI

SEQ ID NO: 18652 - protein, 9 aa, Artificial Sequence
  source: /note="Description of Artificial Sequence: Synthetic peptide"
GWHVRTAPH

SEQ ID NO: 18653 - protein, 9 aa, Artificial Sequence
  source: /note="Description of Artificial Sequence: Synthetic peptide"
LGSSGTPQY

SEQ ID NO: 18654 - protein, 9 aa, Artificial Sequence
  source: /note="Description of Artificial Sequence: Synthetic peptide"
YAASPLPIA

SEQ ID NO: 18655 - protein, 9 aa, Artificial Sequence
  source: /note="Description of Artificial Sequence: Synthetic peptide"
IAAPARAPL

SEQ ID NO: 18656 - protein, 9 aa, Artificial Sequence
  source: /note="Description of Artificial Sequence: Synthetic peptide"
TPQYAASPL

SEQ ID NO: 18657 - protein, 9 aa, Artificial Sequence
  source: /note="Description of Artificial Sequence: Synthetic peptide"
SPLPIAAPA

SEQ ID NO: 18658 - protein, 9 aa, Artificial Sequence
  source: /note="Description of Artificial Sequence: Synthetic peptide"
LPIAAPARA

SEQ ID NO: 18659 - protein, 10 aa, Artificial Sequence
  source: /note="Description of Artificial Sequence: Synthetic peptide"
ALGSSGTPQY

SEQ ID NO: 18660 - protein, 10 aa, Artificial Sequence
  source: /note="Description of Artificial Sequence: Synthetic peptide"
YAASPLPIAA

SEQ ID NO: 18661 - protein, 10 aa, Artificial Sequence
  source: /note="Description of Artificial Sequence: Synthetic peptide"
APARAPLGPV

SEQ ID NO: 18662 - protein, 10 aa, Artificial Sequence
  source: /note="Description of Artificial Sequence: Synthetic peptide"
PQYAASPLPI

SEQ ID NO: 18663 - protein, 10 aa, Artificial Sequence
  source: /note="Description of Artificial Sequence: Synthetic peptide"
ARAPLGPVGW

SEQ ID NO: 18664 - protein, 10 aa, Artificial Sequence
  source: /note="Description of Artificial Sequence: Synthetic peptide"
APLGPVGWHV

SEQ ID NO: 18665 - protein, 9 aa, Artificial Sequence
  source: /note="Description of Artificial Sequence: Synthetic peptide"
YLNDLFSYD

SEQ ID NO: 18666 - protein, 9 aa, Artificial Sequence
  source: /note="Description of Artificial Sequence: Synthetic peptide"
TYLNDLFSY

SEQ ID NO: 18667 - protein, 9 aa, Artificial Sequence
  source: /note="Description of Artificial Sequence: Synthetic peptide"
RSKTYLNDL

SEQ ID NO: 18668 - protein, 9 aa, Artificial Sequence
  source: /note="Description of Artificial Sequence: Synthetic peptide"
KTYLNDLFS

SEQ ID NO: 18669 - protein, 9 aa, Artificial Sequence
  source: /note="Description of Artificial Sequence: Synthetic peptide"
SKTYLNDLF

SEQ ID NO: 18670 - protein, 10 aa, Artificial Sequence
  source: /note="Description of Artificial Sequence: Synthetic peptide"
KTYLNDLFSY

SEQ ID NO: 18671 - protein, 10 aa, Artificial Sequence
  source: /note="Description of Artificial Sequence: Synthetic peptide"
YLNDLFSYDV

SEQ ID NO: 18672 - protein, 10 aa, Artificial Sequence
  source: /note="Description of Artificial Sequence: Synthetic peptide"
RSKTYLNDLF

SEQ ID NO: 18673 - protein, 9 aa, Artificial Sequence
  source: /note="Description of Artificial Sequence: Synthetic peptide"
YWHQLVEHV

SEQ ID NO: 18674 - protein, 9 aa, Artificial Sequence
  source: /note="Description of Artificial Sequence: Synthetic peptide"
HVRMGEGNM

SEQ ID NO: 18675 - protein, 9 aa, Artificial Sequence
  source: /note="Description of Artificial Sequence: Synthetic peptide"
HQLVEHVRM

SEQ ID NO: 18676 - protein, 10 aa, Artificial Sequence
  source: /note="Description of Artificial Sequence: Synthetic peptide"
AYWHQLVEHV

SEQ ID NO: 18677 - protein, 10 aa, Artificial Sequence
  source: /note="Description of Artificial Sequence: Synthetic peptide"
HVRMGEGNML

SEQ ID NO: 18678 - protein, 10 aa, Artificial Sequence
  source: /note="Description of Artificial Sequence: Synthetic peptide"
YWHQLVEHVR

SEQ ID NO: 18679 - protein, 10 aa, Artificial Sequence
  source: /note="Description of Artificial Sequence: Synthetic peptide"
SAYWHQLVEH

SEQ ID NO: 18680 - protein, 10 aa, Artificial Sequence
  source: /note="Description of Artificial Sequence: Synthetic peptide"
WHQLVEHVRM

SEQ ID NO: 18681 - protein, 9 aa, Artificial Sequence
  source: /note="Description of Artificial Sequence: Synthetic peptide"
CVLQTLHPM

SEQ ID NO: 18682 - protein, 9 aa, Artificial Sequence
  source: /note="Description of Artificial Sequence: Synthetic peptide"
CDMCVLQTL

SEQ ID NO: 18683 - protein, 10 aa, Artificial Sequence
  source: /note="Description of Artificial Sequence: Synthetic peptide"
MCVLQTLHPM

SEQ ID NO: 18684 - protein, 9 aa, Artificial Sequence
  source: /note="Description of Artificial Sequence: Synthetic peptide"
EESPMSPPT

SEQ ID NO: 18685 - protein, 9 aa, Artificial Sequence
  source: /note="Description of Artificial Sequence: Synthetic peptide"
RLHASPHHL

SEQ ID NO: 18686 - protein, 9 aa, Artificial Sequence
  source: /note="Description of Artificial Sequence: Synthetic peptide"
SLRSHAYAL

SEQ ID NO: 18687 - protein, 9 aa, Artificial Sequence
  source: /note="Description of Artificial Sequence: Synthetic peptide"
RLRDHICPL

SEQ ID NO: 18688 - protein, 9 aa, Artificial Sequence
  source: /note="Description of Artificial Sequence: Synthetic peptide"
SLGNHLCPL

SEQ ID NO: 18689 - protein, 9 aa, Artificial Sequence
  source: /note="Description of Artificial Sequence: Synthetic peptide"
RLRSRTCLL

SEQ ID NO: 18690 - protein, 9 aa, Artificial Sequence
  source: /note="Description of Artificial Sequence: Synthetic peptide"
GLRNRICPL

SEQ ID NO: 18691 - protein, 9 aa, Artificial Sequence
  source: /note="Description of Artificial Sequence: Synthetic peptide"
SLRSHPCPL

SEQ ID NO: 18692 - protein, 9 aa, Artificial Sequence
  source: /note="Description of Artificial Sequence: Synthetic peptide"
HLRSCPCSL

SEQ ID NO: 18693 - protein, 9 aa, Artificial Sequence
  source: /note="Description of Artificial Sequence: Synthetic peptide"
HLGSHPCRL

SEQ ID NO: 18694 - protein, 9 aa, Artificial Sequence
  source: /note="Description of Artificial Sequence: Synthetic peptide"
HLRTHLLPH

SEQ ID NO: 18695 - protein, 9 aa, Artificial Sequence
  source: /note="Description of Artificial Sequence: Synthetic peptide"
GLRSHTYLR

SEQ ID NO: 18696 - protein, 9 aa, Artificial Sequence
  source: /note="Description of Artificial Sequence: Synthetic peptide"
RTHLLPHHR

SEQ ID NO: 18697 - protein, 9 aa, Artificial Sequence
  source: /note="Description of Artificial Sequence: Synthetic peptide"
SQANALHLR

SEQ ID NO: 18698 - protein, 9 aa, Artificial Sequence
  source: /note="Description of Artificial Sequence: Synthetic peptide"
RYRAYPPCL

SEQ ID NO: 18699 - protein, 9 aa, Artificial Sequence
  source: /note="Description of Artificial Sequence: Synthetic peptide"
HLRYRAYPP

SEQ ID NO: 18700 - protein, 9 aa, Artificial Sequence
  source: /note="Description of Artificial Sequence: Synthetic peptide"
RLRNLPCPH

SEQ ID NO: 18701 - protein, 9 aa, Artificial Sequence
  source: /note="Description of Artificial Sequence: Synthetic peptide"
RLRSLPRPL

SEQ ID NO: 18702 - protein, 9 aa, Artificial Sequence
  source: /note="Description of Artificial Sequence: Synthetic peptide"
RSLPRPLHL

SEQ ID NO: 18703 - protein, 9 aa, Artificial Sequence
  source: /note="Description of Artificial Sequence: Synthetic peptide"
HLRLHASPH

SEQ ID NO: 18704 - protein, 9 aa, Artificial Sequence
  source: /note="Description of Artificial Sequence: Synthetic peptide"
HLRTPPHPH

SEQ ID NO: 18705 - protein, 9 aa, Artificial Sequence
  source: /note="Description of Artificial Sequence: Synthetic peptide"
RTPPHPHHL

SEQ ID NO: 18706 - protein, 9 aa, Artificial Sequence
  source: /note="Description of Artificial Sequence: Synthetic peptide"
RTRSCPCRW

SEQ ID NO: 18707 - protein, 9 aa, Artificial Sequence
  source: /note="Description of Artificial Sequence: Synthetic peptide"
RWRSHPCCH

SEQ ID NO: 18708 - protein, 9 aa, Artificial Sequence
  source: /note="Description of Artificial Sequence: Synthetic peptide"
RSHPCCHYL

SEQ ID NO: 18709 - protein, 9 aa, Artificial Sequence
  source: /note="Description of Artificial Sequence: Synthetic peptide"
HYLRSRNSA

SEQ ID NO: 18710 - protein, 9 aa, Artificial Sequence
  source: /note="Description of Artificial Sequence: Synthetic peptide"
RSRNSAPGP

SEQ ID NO: 18711 - protein, 9 aa, Artificial Sequence
  source: /note="Description of Artificial Sequence: Synthetic peptide"
RGRTCHPGL

SEQ ID NO: 18712 - protein, 9 aa, Artificial Sequence
  source: /note="Description of Artificial Sequence: Synthetic peptide"
RSRTCPPGL

SEQ ID NO: 18713 - protein, 9 aa, Artificial Sequence
  source: /note="Description of Artificial Sequence: Synthetic peptide"
RSHTYLRRL

SEQ ID NO: 18714 - protein, 9 aa, Artificial Sequence
  source: /note="Description of Artificial Sequence: Synthetic peptide"
HTYLRRLRS

SEQ ID NO: 18715 - protein, 9 aa, Artificial Sequence
  source: /note="Description of Artificial Sequence: Synthetic peptide"
RLRSHTCPP

SEQ ID NO: 18716 - protein, 9 aa, Artificial Sequence
  source: /note="Description of Artificial Sequence: Synthetic peptide"
RSHTCPPSL

SEQ ID NO: 18717 - protein, 9 aa, Artificial Sequence
  source: /note="Description of Artificial Sequence: Synthetic peptide"
RSHAYALCL

SEQ ID NO: 18718 - protein, 9 aa, Artificial Sequence
  source: /note="Description of Artificial Sequence: Synthetic peptide"
RSHTCPPRL

SEQ ID NO: 18719 - protein, 9 aa, Artificial Sequence
  source: /note="Description of Artificial Sequence: Synthetic peptide"
RSRTCLLCL

SEQ ID NO: 18720 - protein, 9 aa, Artificial Sequence
  source: /note="Description of Artificial Sequence: Synthetic peptide"
RSHACPPNL

SEQ ID NO: 18721 - protein, 9 aa, Artificial Sequence
  source: /note="Description of Artificial Sequence: Synthetic peptide"
RNHTCPPSL

SEQ ID NO: 18722 - protein, 9 aa, Artificial Sequence
  source: /note="Description of Artificial Sequence: Synthetic peptide"
RSHACPPGL

SEQ ID NO: 18723 - protein, 9 aa, Artificial Sequence
  source: /note="Description of Artificial Sequence: Synthetic peptide"
RNRICPLSL

SEQ ID NO: 18724 - protein, 9 aa, Artificial Sequence
  source: /note="Description of Artificial Sequence: Synthetic peptide"
RSHPCPLGL

SEQ ID NO: 18725 - protein, 9 aa, Artificial Sequence
  source: /note="Description of Artificial Sequence: Synthetic peptide"
RSQANALHL

SEQ ID NO: 18726 - protein, 9 aa, Artificial Sequence
  source: /note="Description of Artificial Sequence: Synthetic peptide"
RSCPCSLPL

SEQ ID NO: 18727 - protein, 9 aa, Artificial Sequence
  source: /note="Description of Artificial Sequence: Synthetic peptide"
SPMSPHLRY

SEQ ID NO: 18728 - protein, 9 aa, Artificial Sequence
  source: /note="Description of Artificial Sequence: Synthetic peptide"
SLPLGNHPY

SEQ ID NO: 18729 - protein, 9 aa, Artificial Sequence
  source: /note="Description of Artificial Sequence: Synthetic peptide"
ESPMSPHLR

SEQ ID NO: 18730 - protein, 9 aa, Artificial Sequence
  source: /note="Description of Artificial Sequence: Synthetic peptide"
PMSPHLRYR

SEQ ID NO: 18731 - protein, 9 aa, Artificial Sequence
  source: /note="Description of Artificial Sequence: Synthetic peptide"
NLPCPHRLR

SEQ ID NO: 18732 - protein, 9 aa, Artificial Sequence
  source: /note="Description of Artificial Sequence: Synthetic peptide"
SLPRPLHLR

SEQ ID NO: 18733 - protein, 9 aa, Artificial Sequence
  source: /note="Description of Artificial Sequence: Synthetic peptide"
LLPHHRRTR

SEQ ID NO: 18734 - protein, 9 aa, Artificial Sequence
  source: /note="Description of Artificial Sequence: Synthetic peptide"
SHAYALCLR

SEQ ID NO: 18735 - protein, 9 aa, Artificial Sequence
  source: /note="Description of Artificial Sequence: Synthetic peptide"
DHICPLSLR

SEQ ID NO: 18736 - protein, 9 aa, Artificial Sequence
  source: /note="Description of Artificial Sequence: Synthetic peptide"
MSPHLRYRA

SEQ ID NO: 18737 - protein, 9 aa, Artificial Sequence
  source: /note="Description of Artificial Sequence: Synthetic peptide"
SPHLRYRAY

SEQ ID NO: 18738 - protein, 9 aa, Artificial Sequence
  source: /note="Description of Artificial Sequence: Synthetic peptide"
LPRPLHLRL

SEQ ID NO: 18739 - protein, 9 aa, Artificial Sequence
  source: /note="Description of Artificial Sequence: Synthetic peptide"
RPLHLRLHA

SEQ ID NO: 18740 - protein, 9 aa, Artificial Sequence
  source: /note="Description of Artificial Sequence: Synthetic peptide"
SPHHLRTPP

SEQ ID NO: 18741 - protein, 9 aa, Artificial Sequence
  source: /note="Description of Artificial Sequence: Synthetic peptide"
HPHHLRTHL

SEQ ID NO: 18742 - protein, 9 aa, Artificial Sequence
  source: /note="Description of Artificial Sequence: Synthetic peptide"
LPHHRRTRS

SEQ ID NO: 18743 - protein, 9 aa, Artificial Sequence
  source: /note="Description of Artificial Sequence: Synthetic peptide"
APGPRGRTC

SEQ ID NO: 18744 - protein, 9 aa, Artificial Sequence
  source: /note="Description of Artificial Sequence: Synthetic peptide"
CPLGLKSPL

SEQ ID NO: 18745 - protein, 9 aa, Artificial Sequence
  source: /note="Description of Artificial Sequence: Synthetic peptide"
LPLGNHPYL

SEQ ID NO: 18746 - protein, 9 aa, Artificial Sequence
  source: /note="Description of Artificial Sequence: Synthetic peptide"
CPRSCRCPH

SEQ ID NO: 18747 - protein, 9 aa, Artificial Sequence
  source: /note="Description of Artificial Sequence: Synthetic peptide"
CPHLGSHPC

SEQ ID NO: 18748 - protein, 9 aa, Artificial Sequence
  source: /note="Description of Artificial Sequence: Synthetic peptide"
YLRSRNSAP

SEQ ID NO: 18749 - protein, 9 aa, Artificial Sequence
  source: /note="Description of Artificial Sequence: Synthetic peptide"
NLRNHTCPP

SEQ ID NO: 18750 - protein, 9 aa, Artificial Sequence
  source: /note="Description of Artificial Sequence: Synthetic peptide"
WRSHPCCHY

SEQ ID NO: 18751 - protein, 9 aa, Artificial Sequence
  source: /note="Description of Artificial Sequence: Synthetic peptide"
RDHICPLSL

SEQ ID NO: 18752 - protein, 9 aa, Artificial Sequence
  source: /note="Description of Artificial Sequence: Synthetic peptide"
LESQPCLSL

SEQ ID NO: 18753 - protein, 9 aa, Artificial Sequence
  source: /note="Description of Artificial Sequence: Synthetic peptide"
EESPMSPHL

SEQ ID NO: 18754 - protein, 9 aa, Artificial Sequence
  source: /note="Description of Artificial Sequence: Synthetic peptide"
PPSLRSHAY

SEQ ID NO: 18755 - protein, 9 aa, Artificial Sequence
  source: /note="Description of Artificial Sequence: Synthetic peptide"
CPPRLRDHI

SEQ ID NO: 18756 - protein, 9 aa, Artificial Sequence
  source: /note="Description of Artificial Sequence: Synthetic peptide"
CPPGLRNRI

SEQ ID NO: 18757 - protein, 10 aa, Artificial Sequence
  source: /note="Description of Artificial Sequence: Synthetic peptide"
ESPMSPHLRY

SEQ ID NO: 18758 - protein, 10 aa, Artificial Sequence
  source: /note="Description of Artificial Sequence: Synthetic peptide"
CSLPLGNHPY

SEQ ID NO: 18759 - protein, 10 aa, Artificial Sequence
  source: /note="Description of Artificial Sequence: Synthetic peptide"
SLPLGNHPYL

SEQ ID NO: 18760 - protein, 10 aa, Artificial Sequence
  source: /note="Description of Artificial Sequence: Synthetic peptide"
SLPRPLHLRL

SEQ ID NO: 18761 - protein, 10 aa, Artificial Sequence
  source: /note="Description of Artificial Sequence: Synthetic peptide"
GLKSPLRSQA

SEQ ID NO: 18762 - protein, 10 aa, Artificial Sequence
  source: /note="Description of Artificial Sequence: Synthetic peptide"
YLPCLESQPC

SEQ ID NO: 18763 - protein, 10 aa, Artificial Sequence
  source: /note="Description of Artificial Sequence: Synthetic peptide"
RLRNLPCPHR

SEQ ID NO: 18764 - protein, 10 aa, Artificial Sequence
  source: /note="Description of Artificial Sequence: Synthetic peptide"
RLRSLPRPLH

SEQ ID NO: 18765 - protein, 10 aa, Artificial Sequence
  source: /note="Description of Artificial Sequence: Synthetic peptide"
RLHASPHHLR

SEQ ID NO: 18766 - protein, 10 aa, Artificial Sequence
  source: /note="Description of Artificial Sequence: Synthetic peptide"
GLRSHTYLRR

SEQ ID NO: 18767 - protein, 10 aa, Artificial Sequence
  source: /note="Description of Artificial Sequence: Synthetic peptide"
RSHAYALCLR

SEQ ID NO: 18768 - protein, 10 aa, Artificial Sequence
  source: /note="Description of Artificial Sequence: Synthetic peptide"
CLRSHTCPPR

SEQ ID NO: 18769 - protein, 10 aa, Artificial Sequence
  source: /note="Description of Artificial Sequence: Synthetic peptide"
SLRNCTCPPR

SEQ ID NO: 18770 - protein, 10 aa, Artificial Sequence
  source: /note="Description of Artificial Sequence: Synthetic peptide"
RSRTCLLCLR

SEQ ID NO: 18771 - protein, 10 aa, Artificial Sequence
  source: /note="Description of Artificial Sequence: Synthetic peptide"
RSHPCPLGLK

SEQ ID NO: 18772 - protein, 10 aa, Artificial Sequence
  source: /note="Description of Artificial Sequence: Synthetic peptide"
RSLPRPLHLR

SEQ ID NO: 18773 - protein, 10 aa, Artificial Sequence
  source: /note="Description of Artificial Sequence: Synthetic peptide"
RTHLLPHHRR

SEQ ID NO: 18774 - protein, 10 aa, Artificial Sequence
  source: /note="Description of Artificial Sequence: Synthetic peptide"
RSHPCCHYLR

SEQ ID NO: 18775 - protein, 10 aa, Artificial Sequence
  source: /note="Description of Artificial Sequence: Synthetic peptide"
RTCHPGLRSR

SEQ ID NO: 18776 - protein, 10 aa, Artificial Sequence
  source: /note="Description of Artificial Sequence: Synthetic peptide"
RSHTCPPSLR

SEQ ID NO: 18777 - protein, 10 aa, Artificial Sequence
  source: /note="Description of Artificial Sequence: Synthetic peptide"
RSHTCPPRLR

SEQ ID NO: 18778 - protein, 10 aa, Artificial Sequence
  source: /note="Description of Artificial Sequence: Synthetic peptide"
CTCPPRLRSR

SEQ ID NO: 18779 - protein, 10 aa, Artificial Sequence
  source: /note="Description of Artificial Sequence: Synthetic peptide"
RSHACPPNLR

SEQ ID NO: 18780 - protein, 10 aa, Artificial Sequence
  source: /note="Description of Artificial Sequence: Synthetic peptide"
RSHACPPGLR

SEQ ID NO: 18781 - protein, 10 aa, Artificial Sequence
  source: /note="Description of Artificial Sequence: Synthetic peptide"
RSQANALHLR

SEQ ID NO: 18782 - protein, 10 aa, Artificial Sequence
  source: /note="Description of Artificial Sequence: Synthetic peptide"
RYRAYPPCLW

SEQ ID NO: 18783 - protein, 10 aa, Artificial Sequence
  source: /note="Description of Artificial Sequence: Synthetic peptide"
LWCHACLHRL

SEQ ID NO: 18784 - protein, 10 aa, Artificial Sequence
  source: /note="Description of Artificial Sequence: Synthetic peptide"
HLRYRAYPPC

SEQ ID NO: 18785 - protein, 10 aa, Artificial Sequence
  source: /note="Description of Artificial Sequence: Synthetic peptide"
RNLPCPHRLR

SEQ ID NO: 18786 - protein, 10 aa, Artificial Sequence
  source: /note="Description of Artificial Sequence: Synthetic peptide"
HLRLHASPHH

SEQ ID NO: 18787 - protein, 10 aa, Artificial Sequence
  source: /note="Description of Artificial Sequence: Synthetic peptide"
HLRTPPHPHH

SEQ ID NO: 18788 - protein, 10 aa, Artificial Sequence
  source: /note="Description of Artificial Sequence: Synthetic peptide"
RTPPHPHHLR

SEQ ID NO: 18789 - protein, 10 aa, Artificial Sequence
  source: /note="Description of Artificial Sequence: Synthetic peptide"
HLRTHLLPHH

SEQ ID NO: 18790 - protein, 10 aa, Artificial Sequence
  source: /note="Description of Artificial Sequence: Synthetic peptide"
HLLPHHRRTR

SEQ ID NO: 18791 - protein, 10 aa, Artificial Sequence
  source: /note="Description of Artificial Sequence: Synthetic peptide"
RTRSCPCRWR

SEQ ID NO: 18792 - protein, 10 aa, Artificial Sequence
  source: /note="Description of Artificial Sequence: Synthetic peptide"
RSCPCRWRSH

SEQ ID NO: 18793 - protein, 10 aa, Artificial Sequence
  source: /note="Description of Artificial Sequence: Synthetic peptide"
RWRSHPCCHY

SEQ ID NO: 18794 - protein, 10 aa, Artificial Sequence
  source: /note="Description of Artificial Sequence: Synthetic peptide"
RSRNSAPGPR

SEQ ID NO: 18795 - protein, 10 aa, Artificial Sequence
  source: /note="Description of Artificial Sequence: Synthetic peptide"
RGRTCHPGLR

SEQ ID NO: 18796 - protein, 10 aa, Artificial Sequence
  source: /note="Description of Artificial Sequence: Synthetic peptide"
GLRSRTCPPG

SEQ ID NO: 18797 - protein, 10 aa, Artificial Sequence
  source: /note="Description of Artificial Sequence: Synthetic peptide"
RSRTCPPGLR

SEQ ID NO: 18798 - protein, 10 aa, Artificial Sequence
  source: /note="Description of Artificial Sequence: Synthetic peptide"
RSHTYLRRLR

SEQ ID NO: 18799 - protein, 10 aa, Artificial Sequence
  source: /note="Description of Artificial Sequence: Synthetic peptide"
HTYLRRLRSH

SEQ ID NO: 18800 - protein, 10 aa, Artificial Sequence
  source: /note="Description of Artificial Sequence: Synthetic peptide"
RLRSHTCPPS

SEQ ID NO: 18801 - protein, 10 aa, Artificial Sequence
  source: /note="Description of Artificial Sequence: Synthetic peptide"
SLRSHAYALC

SEQ ID NO: 18802 - protein, 10 aa, Artificial Sequence
  source: /note="Description of Artificial Sequence: Synthetic peptide"
RLRDHICPLS

SEQ ID NO: 18803 - protein, 10 aa, Artificial Sequence
  source: /note="Description of Artificial Sequence: Synthetic peptide"
RLRSRTCLLC

SEQ ID NO: 18804 - protein, 10 aa, Artificial Sequence
  source: /note="Description of Artificial Sequence: Synthetic peptide"
RNHTCPPSLR

SEQ ID NO: 18805 - protein, 10 aa, Artificial Sequence
  source: /note="Description of Artificial Sequence: Synthetic peptide"
SLRSHACPPG

SEQ ID NO: 18806 - protein, 10 aa, Artificial Sequence
  source: /note="Description of Artificial Sequence: Synthetic peptide"
GLRNRICPLS

SEQ ID NO: 18807 - protein, 10 aa, Artificial Sequence
  source: /note="Description of Artificial Sequence: Synthetic peptide"
RNRICPLSLR

SEQ ID NO: 18808 - protein, 10 aa, Artificial Sequence
  source: /note="Description of Artificial Sequence: Synthetic peptide"
SLRSHPCPLG

SEQ ID NO: 18809 - protein, 10 aa, Artificial Sequence
  source: /note="Description of Artificial Sequence: Synthetic peptide"
KSPLRSQANA

SEQ ID NO: 18810 - protein, 10 aa, Artificial Sequence
  source: /note="Description of Artificial Sequence: Synthetic peptide"
MSPHLRYRAY

SEQ ID NO: 18811 - protein, 10 aa, Artificial Sequence
  source: /note="Description of Artificial Sequence: Synthetic peptide"
SPMSPHLRYR

SEQ ID NO: 18812 - protein, 10 aa, Artificial Sequence
  source: /note="Description of Artificial Sequence: Synthetic peptide"
CLWCHACLHR

SEQ ID NO: 18813 - protein, 10 aa, Artificial Sequence
  source: /note="Description of Artificial Sequence: Synthetic peptide"
CPHRLRSLPR

SEQ ID NO: 18814 - protein, 10 aa, Artificial Sequence
  source: /note="Description of Artificial Sequence: Synthetic peptide"
HPCCHYLRSR

SEQ ID NO: 18815 - protein, 10 aa, Artificial Sequence
  source: /note="Description of Artificial Sequence: Synthetic peptide"
HACPPGLRNR

SEQ ID NO: 18816 - protein, 10 aa, Artificial Sequence
  source: /note="Description of Artificial Sequence: Synthetic peptide"
LPCPHRLRSL

SEQ ID NO: 18817 - protein, 10 aa, Artificial Sequence
  source: /note="Description of Artificial Sequence: Synthetic peptide"
RPLHLRLHAS

SEQ ID NO: 18818 - protein, 10 aa, Artificial Sequence
  source: /note="Description of Artificial Sequence: Synthetic peptide"
SPHHLRTPPH

SEQ ID NO: 18819 - protein, 10 aa, Artificial Sequence
  source: /note="Description of Artificial Sequence: Synthetic peptide"
HPHHLRTHLL

SEQ ID NO: 18820 - protein, 10 aa, Artificial Sequence
  source: /note="Description of Artificial Sequence: Synthetic peptide"
LPHHRRTRSC

SEQ ID NO: 18821 - protein, 10 aa, Artificial Sequence
  source: /note="Description of Artificial Sequence: Synthetic peptide"
PPRLRSRTCL

SEQ ID NO: 18822 - protein, 10 aa, Artificial Sequence
  source: /note="Description of Artificial Sequence: Synthetic peptide"
SPLRSQANAL

SEQ ID NO: 18823 - protein, 10 aa, Artificial Sequence
  source: /note="Description of Artificial Sequence: Synthetic peptide"
CPRSCRCPHL

SEQ ID NO: 18824 - protein, 10 aa, Artificial Sequence
  source: /note="Description of Artificial Sequence: Synthetic peptide"
YLRSRNSAPG

SEQ ID NO: 18825 - protein, 10 aa, Artificial Sequence
  source: /note="Description of Artificial Sequence: Synthetic peptide"
YLRRLRSHTC

SEQ ID NO: 18826 - protein, 10 aa, Artificial Sequence
  source: /note="Description of Artificial Sequence: Synthetic peptide"
HAYALCLRSH

SEQ ID NO: 18827 - protein, 10 aa, Artificial Sequence
  source: /note="Description of Artificial Sequence: Synthetic peptide"
LRYRAYPPCL

SEQ ID NO: 18828 - protein, 10 aa, Artificial Sequence
  source: /note="Description of Artificial Sequence: Synthetic peptide"
RAYPPCLWCH

SEQ ID NO: 18829 - protein, 10 aa, Artificial Sequence
  source: /note="Description of Artificial Sequence: Synthetic peptide"
HRLRSLPRPL

SEQ ID NO: 18830 - protein, 10 aa, Artificial Sequence
  source: /note="Description of Artificial Sequence: Synthetic peptide"
LRSLPRPLHL

SEQ ID NO: 18831 - protein, 10 aa, Artificial Sequence
  source: /note="Description of Artificial Sequence: Synthetic peptide"
LHLRLHASPH

SEQ ID NO: 18832 - protein, 10 aa, Artificial Sequence
  source: /note="Description of Artificial Sequence: Synthetic peptide"
LRLHASPHHL

SEQ ID NO: 18833 - protein, 10 aa, Artificial Sequence
  source: /note="Description of Artificial Sequence: Synthetic peptide"
LRTPPHPHHL

SEQ ID NO: 18834 - protein, 10 aa, Artificial Sequence
  source: /note="Description of Artificial Sequence: Synthetic peptide"
HHLRTHLLPH

SEQ ID NO: 18835 - protein, 10 aa, Artificial Sequence
  source: /note="Description of Artificial Sequence: Synthetic peptide"
WRSHPCCHYL

SEQ ID NO: 18836 - protein, 10 aa, Artificial Sequence
  source: /note="Description of Artificial Sequence: Synthetic peptide"
CHYLRSRNSA

SEQ ID NO: 18837 - protein, 10 aa, Artificial Sequence
  source: /note="Description of Artificial Sequence: Synthetic peptide"
LRSHTYLRRL

SEQ ID NO: 18838 - protein, 10 aa, Artificial Sequence
  source: /note="Description of Artificial Sequence: Synthetic peptide"
LRSHTCPPSL

SEQ ID NO: 18839 - protein, 10 aa, Artificial Sequence
  source: /note="Description of Artificial Sequence: Synthetic peptide"
LRSHAYALCL

SEQ ID NO: 18840 - protein, 10 aa, Artificial Sequence
  source: /note="Description of Artificial Sequence: Synthetic peptide"
LRSHTCPPRL

SEQ ID NO: 18841 - protein, 10 aa, Artificial Sequence
  source: /note="Description of Artificial Sequence: Synthetic peptide"
LRNCTCPPRL

SEQ ID NO: 18842 - protein, 10 aa, Artificial Sequence
  source: /note="Description of Artificial Sequence: Synthetic peptide"
LRSHACPPNL

SEQ ID NO: 18843 - protein, 10 aa, Artificial Sequence
  source: /note="Description of Artificial Sequence: Synthetic peptide"
LRNHTCPPSL

SEQ ID NO: 18844 - protein, 10 aa, Artificial Sequence
  source: /note="Description of Artificial Sequence: Synthetic peptide"
LRSHACPPGL

SEQ ID NO: 18845 - protein, 10 aa, Artificial Sequence
  source: /note="Description of Artificial Sequence: Synthetic peptide"
LRNRICPLSL

SEQ ID NO: 18846 - protein, 10 aa, Artificial Sequence
  source: /note="Description of Artificial Sequence: Synthetic peptide"
LSLRSHPCPL

SEQ ID NO: 18847 - protein, 10 aa, Artificial Sequence
  source: /note="Description of Artificial Sequence: Synthetic peptide"
LRSQANALHL

SEQ ID NO: 18848 - protein, 10 aa, Artificial Sequence
  source: /note="Description of Artificial Sequence: Synthetic peptide"
SQANALHLRS

SEQ ID NO: 18849 - protein, 10 aa, Artificial Sequence
  source: /note="Description of Artificial Sequence: Synthetic peptide"
LHLRSCPCSL

SEQ ID NO: 18850 - protein, 10 aa, Artificial Sequence
  source: /note="Description of Artificial Sequence: Synthetic peptide"
LRSCPCSLPL

SEQ ID NO: 18851 - protein, 10 aa, Artificial Sequence
  source: /note="Description of Artificial Sequence: Synthetic peptide"
LSLGNHLCPL

SEQ ID NO: 18852 - protein, 10 aa, Artificial Sequence
  source: /note="Description of Artificial Sequence: Synthetic peptide"
CPPGLRSHTY

SEQ ID NO: 18853 - protein, 10 aa, Artificial Sequence
  source: /note="Description of Artificial Sequence: Synthetic peptide"
CPPSLRSHAY

SEQ ID NO: 18854 - protein, 9 aa, Artificial Sequence
  source: /note="Description of Artificial Sequence: Synthetic peptide"
RLHASPHHL

SEQ ID NO: 18855 - protein, 9 aa, Artificial Sequence
  source: /note="Description of Artificial Sequence: Synthetic peptide"
SLRSHAYAL

SEQ ID NO: 18856 - protein, 9 aa, Artificial Sequence
  source: /note="Description of Artificial Sequence: Synthetic peptide"
RLRDHICPL

SEQ ID NO: 18857 - protein, 9 aa, Artificial Sequence
  source: /note="Description of Artificial Sequence: Synthetic peptide"
SLGNHLCPL

SEQ ID NO: 18858 - protein, 9 aa, Artificial Sequence
  source: /note="Description of Artificial Sequence: Synthetic peptide"
RLRSRTCLL

SEQ ID NO: 18859 - protein, 9 aa, Artificial Sequence
  source: /note="Description of Artificial Sequence: Synthetic peptide"
GLRNRICPL

SEQ ID NO: 18860 - protein, 9 aa, Artificial Sequence
  source: /note="Description of Artificial Sequence: Synthetic peptide"
SLRSHPCPL

SEQ ID NO: 18861 - protein, 9 aa, Artificial Sequence
  source: /note="Description of Artificial Sequence: Synthetic peptide"
HLRSCPCSL

SEQ ID NO: 18862 - protein, 9 aa, Artificial Sequence
  source: /note="Description of Artificial Sequence: Synthetic peptide"
HLGSHPCRL

SEQ ID NO: 18863 - protein, 9 aa, Artificial Sequence
  source: /note="Description of Artificial Sequence: Synthetic peptide"
HLRTHLLPH

SEQ ID NO: 18864 - protein, 9 aa, Artificial Sequence
  source: /note="Description of Artificial Sequence: Synthetic peptide"
GLRSHTYLR

SEQ ID NO: 18865 - protein, 9 aa, Artificial Sequence
  source: /note="Description of Artificial Sequence: Synthetic peptide"
RTHLLPHHR

SEQ ID NO: 18866 - protein, 9 aa, Artificial Sequence
  source: /note="Description of Artificial Sequence: Synthetic peptide"
SQANALHLR

SEQ ID NO: 18867 - protein, 9 aa, Artificial Sequence
  source: /note="Description of Artificial Sequence: Synthetic peptide"
RLRNLPCPH

SEQ ID NO: 18868 - protein, 9 aa, Artificial Sequence
  source: /note="Description of Artificial Sequence: Synthetic peptide"
RLRSLPRPL

SEQ ID NO: 18869 - protein, 9 aa, Artificial Sequence
  source: /note="Description of Artificial Sequence: Synthetic peptide"
RSLPRPLHL

SEQ ID NO: 18870 - protein, 9 aa, Artificial Sequence
  source: /note="Description of Artificial Sequence: Synthetic peptide"
HLRLHASPH

SEQ ID NO: 18871 - protein, 9 aa, Artificial Sequence
  source: /note="Description of Artificial Sequence: Synthetic peptide"
HLRTPPHPH

SEQ ID NO: 18872 - protein, 9 aa, Artificial Sequence
  source: /note="Description of Artificial Sequence: Synthetic peptide"
RTPPHPHHL

SEQ ID NO: 18873 - protein, 9 aa, Artificial Sequence
  source: /note="Description of Artificial Sequence: Synthetic peptide"
RTRSCPCRW

SEQ ID NO: 18874 - protein, 9 aa, Artificial Sequence
  source: /note="Description of Artificial Sequence: Synthetic peptide"
RWRSHPCCH

SEQ ID NO: 18875 - protein, 9 aa, Artificial Sequence
  source: /note="Description of Artificial Sequence: Synthetic peptide"
RSHPCCHYL

SEQ ID NO: 18876 - protein, 9 aa, Artificial Sequence
  source: /note="Description of Artificial Sequence: Synthetic peptide"
HYLRSRNSA

SEQ ID NO: 18877 - protein, 9 aa, Artificial Sequence
  source: /note="Description of Artificial Sequence: Synthetic peptide"
RSRNSAPGP

SEQ ID NO: 18878 - protein, 9 aa, Artificial Sequence
  source: /note="Description of Artificial Sequence: Synthetic peptide"
RGRTCHPGL

SEQ ID NO: 18879 - protein, 9 aa, Artificial Sequence
  source: /note="Description of Artificial Sequence: Synthetic peptide"
RSRTCPPGL

SEQ ID NO: 18880 - protein, 9 aa, Artificial Sequence
  source: /note="Description of Artificial Sequence: Synthetic peptide"
RSHTYLRRL

SEQ ID NO: 18881 - protein, 9 aa, Artificial Sequence
  source: /note="Description of Artificial Sequence: Synthetic peptide"
HTYLRRLRS

SEQ ID NO: 18882 - protein, 9 aa, Artificial Sequence
  source: /note="Description of Artificial Sequence: Synthetic peptide"
RLRSHTCPP

SEQ ID NO: 18883 - protein, 9 aa, Artificial Sequence
  source: /note="Description of Artificial Sequence: Synthetic peptide"
RSHTCPPSL

SEQ ID NO: 18884 - protein, 9 aa, Artificial Sequence
  source: /note="Description of Artificial Sequence: Synthetic peptide"
RSHAYALCL

SEQ ID NO: 18885 - protein, 9 aa, Artificial Sequence
  source: /note="Description of Artificial Sequence: Synthetic peptide"
RSHTCPPRL

SEQ ID NO: 18886 - protein, 9 aa, Artificial Sequence
  source: /note="Description of Artificial Sequence: Synthetic peptide"
RSRTCLLCL

SEQ ID NO: 18887 - protein, 9 aa, Artificial Sequence
  source: /note="Description of Artificial Sequence: Synthetic peptide"
RSHACPPNL

SEQ ID NO: 18888 - protein, 9 aa, Artificial Sequence
  source: /note="Description of Artificial Sequence: Synthetic peptide"
RNHTCPPSL

SEQ ID NO: 18889 - protein, 9 aa, Artificial Sequence
  source: /note="Description of Artificial Sequence: Synthetic peptide"
RSHACPPGL

SEQ ID NO: 18890 - protein, 9 aa, Artificial Sequence
  source: /note="Description of Artificial Sequence: Synthetic peptide"
RNRICPLSL

SEQ ID NO: 18891 - protein, 9 aa, Artificial Sequence
  source: /note="Description of Artificial Sequence: Synthetic peptide"
RSHPCPLGL

SEQ ID NO: 18892 - protein, 9 aa, Artificial Sequence
  source: /note="Description of Artificial Sequence: Synthetic peptide"
RSQANALHL

SEQ ID NO: 18893 - protein, 9 aa, Artificial Sequence
  source: /note="Description of Artificial Sequence: Synthetic peptide"
RSCPCSLPL

SEQ ID NO: 18894 - protein, 9 aa, Artificial Sequence
  source: /note="Description of Artificial Sequence: Synthetic peptide"
SLPLGNHPY

SEQ ID NO: 18895 - protein, 9 aa, Artificial Sequence
  source: /note="Description of Artificial Sequence: Synthetic peptide"
NLPCPHRLR

SEQ ID NO: 18896 - protein, 9 aa, Artificial Sequence
  source: /note="Description of Artificial Sequence: Synthetic peptide"
SLPRPLHLR

SEQ ID NO: 18897 - protein, 9 aa, Artificial Sequence
  source: /note="Description of Artificial Sequence: Synthetic peptide"
LLPHHRRTR

SEQ ID NO: 18898 - protein, 9 aa, Artificial Sequence
  source: /note="Description of Artificial Sequence: Synthetic peptide"
SHAYALCLR

SEQ ID NO: 18899 - protein, 9 aa, Artificial Sequence
  source: /note="Description of Artificial Sequence: Synthetic peptide"
DHICPLSLR

SEQ ID NO: 18900 - protein, 9 aa, Artificial Sequence
  source: /note="Description of Artificial Sequence: Synthetic peptide"
EVSRLSPCL

SEQ ID NO: 18901 - protein, 9 aa, Artificial Sequence
  source: /note="Description of Artificial Sequence: Synthetic peptide"
LPRPLHLRL

SEQ ID NO: 18902 - protein, 9 aa, Artificial Sequence
  source: /note="Description of Artificial Sequence: Synthetic peptide"
RPLHLRLHA

SEQ ID NO: 18903 - protein, 9 aa, Artificial Sequence
  source: /note="Description of Artificial Sequence: Synthetic peptide"
SPHHLRTPP

SEQ ID NO: 18904 - protein, 9 aa, Artificial Sequence
  source: /note="Description of Artificial Sequence: Synthetic peptide"
HPHHLRTHL

SEQ ID NO: 18905 - protein, 9 aa, Artificial Sequence
  source: /note="Description of Artificial Sequence: Synthetic peptide"
LPHHRRTRS

SEQ ID NO: 18906 - protein, 9 aa, Artificial Sequence
  source: /note="Description of Artificial Sequence: Synthetic peptide"
APGPRGRTC

SEQ ID NO: 18907 - protein, 9 aa, Artificial Sequence
  source: /note="Description of Artificial Sequence: Synthetic peptide"
CPLGLKSPL

SEQ ID NO: 18908 - protein, 9 aa, Artificial Sequence
  source: /note="Description of Artificial Sequence: Synthetic peptide"
LPLGNHPYL

SEQ ID NO: 18909 - protein, 9 aa, Artificial Sequence
  source: /note="Description of Artificial Sequence: Synthetic peptide"
CPRSCRCPH

SEQ ID NO: 18910 - protein, 9 aa, Artificial Sequence
  source: /note="Description of Artificial Sequence: Synthetic peptide"
CPHLGSHPC

SEQ ID NO: 18911 - protein, 9 aa, Artificial Sequence
  source: /note="Description of Artificial Sequence: Synthetic peptide"
YLRSRNSAP

SEQ ID NO: 18912 - protein, 9 aa, Artificial Sequence
  source: /note="Description of Artificial Sequence: Synthetic peptide"
NLRNHTCPP

SEQ ID NO: 18913 - protein, 9 aa, Artificial Sequence
  source: /note="Description of Artificial Sequence: Synthetic peptide"
VSRLSPCLW

SEQ ID NO: 18914 - protein, 9 aa, Artificial Sequence
  source: /note="Description of Artificial Sequence: Synthetic peptide"
WRSHPCCHY

SEQ ID NO: 18915 - protein, 9 aa, Artificial Sequence
  source: /note="Description of Artificial Sequence: Synthetic peptide"
RDHICPLSL

SEQ ID NO: 18916 - protein, 9 aa, Artificial Sequence
  source: /note="Description of Artificial Sequence: Synthetic peptide"
LESQPCLSL

SEQ ID NO: 18917 - protein, 9 aa, Artificial Sequence
  source: /note="Description of Artificial Sequence: Synthetic peptide"
PPSLRSHAY

SEQ ID NO: 18918 - protein, 9 aa, Artificial Sequence
  source: /note="Description of Artificial Sequence: Synthetic peptide"
CPPRLRDHI

SEQ ID NO: 18919 - protein, 9 aa, Artificial Sequence
  source: /note="Description of Artificial Sequence: Synthetic peptide"
CPPGLRNRI

SEQ ID NO: 18920 - protein, 10 aa, Artificial Sequence
  source: /note="Description of Artificial Sequence: Synthetic peptide"
CSLPLGNHPY

SEQ ID NO: 18921 - protein, 10 aa, Artificial Sequence
  source: /note="Description of Artificial Sequence: Synthetic peptide"
RLSPCLWCHA

SEQ ID NO: 18922 - protein, 10 aa, Artificial Sequence
  source: /note="Description of Artificial Sequence: Synthetic peptide"
SLPLGNHPYL

SEQ ID NO: 18923 - protein, 10 aa, Artificial Sequence
  source: /note="Description of Artificial Sequence: Synthetic peptide"
SLPRPLHLRL

SEQ ID NO: 18924 - protein, 10 aa, Artificial Sequence
  source: /note="Description of Artificial Sequence: Synthetic peptide"
GLKSPLRSQA

SEQ ID NO: 18925 - protein, 10 aa, Artificial Sequence
  source: /note="Description of Artificial Sequence: Synthetic peptide"
YLPCLESQPC

SEQ ID NO: 18926 - protein, 10 aa, Artificial Sequence
  source: /note="Description of Artificial Sequence: Synthetic peptide"
RLRNLPCPHR

SEQ ID NO: 18927 - protein, 10 aa, Artificial Sequence
  source: /note="Description of Artificial Sequence: Synthetic peptide"
RLRSLPRPLH

SEQ ID NO: 18928 - protein, 10 aa, Artificial Sequence
  source: /note="Description of Artificial Sequence: Synthetic peptide"
RLHASPHHLR

SEQ ID NO: 18929 - protein, 10 aa, Artificial Sequence
  source: /note="Description of Artificial Sequence: Synthetic peptide"
GLRSHTYLRR

SEQ ID NO: 18930 - protein, 10 aa, Artificial Sequence
  source: /note="Description of Artificial Sequence: Synthetic peptide"
RSHAYALCLR

SEQ ID NO: 18931 - protein, 10 aa, Artificial Sequence
  source: /note="Description of Artificial Sequence: Synthetic peptide"
CLRSHTCPPR

SEQ ID NO: 18932 - protein, 10 aa, Artificial Sequence
  source: /note="Description of Artificial Sequence: Synthetic peptide"
SLRNCTCPPR

SEQ ID NO: 18933 - protein, 10 aa, Artificial Sequence
  source: /note="Description of Artificial Sequence: Synthetic peptide"
RSRTCLLCLR

SEQ ID NO: 18934 - protein, 10 aa, Artificial Sequence
  source: /note="Description of Artificial Sequence: Synthetic peptide"
RSHPCPLGLK

SEQ ID NO: 18935 - protein, 10 aa, Artificial Sequence
  source: /note="Description of Artificial Sequence: Synthetic peptide"
RSLPRPLHLR

SEQ ID NO: 18936 - protein, 10 aa, Artificial Sequence
  source: /note="Description of Artificial Sequence: Synthetic peptide"
RTHLLPHHRR

SEQ ID NO: 18937 - protein, 10 aa, Artificial Sequence
  source: /note="Description of Artificial Sequence: Synthetic peptide"
RSHPCCHYLR

SEQ ID NO: 18938 - protein, 10 aa, Artificial Sequence
  source: /note="Description of Artificial Sequence: Synthetic peptide"
RTCHPGLRSR

SEQ ID NO: 18939 - protein, 10 aa, Artificial Sequence
  source: /note="Description of Artificial Sequence: Synthetic peptide"
RSHTCPPSLR

SEQ ID NO: 18940 - protein, 10 aa, Artificial Sequence
  source: /note="Description of Artificial Sequence: Synthetic peptide"
RSHTCPPRLR

SEQ ID NO: 18941 - protein, 10 aa, Artificial Sequence
  source: /note="Description of Artificial Sequence: Synthetic peptide"
CTCPPRLRSR

SEQ ID NO: 18942 - protein, 10 aa, Artificial Sequence
  source: /note="Description of Artificial Sequence: Synthetic peptide"
RSHACPPNLR

SEQ ID NO: 18943 - protein, 10 aa, Artificial Sequence
  source: /note="Description of Artificial Sequence: Synthetic peptide"
RSHACPPGLR

SEQ ID NO: 18944 - protein, 10 aa, Artificial Sequence
  source: /note="Description of Artificial Sequence: Synthetic peptide"
RSQANALHLR

SEQ ID NO: 18945 - protein, 10 aa, Artificial Sequence
  source: /note="Description of Artificial Sequence: Synthetic peptide"
LWCHACLHRL

SEQ ID NO: 18946 - protein, 10 aa, Artificial Sequence
  source: /note="Description of Artificial Sequence: Synthetic peptide"
RNLPCPHRLR

SEQ ID NO: 18947 - protein, 10 aa, Artificial Sequence
  source: /note="Description of Artificial Sequence: Synthetic peptide"
HLRLHASPHH

SEQ ID NO: 18948 - protein, 10 aa, Artificial Sequence
  source: /note="Description of Artificial Sequence: Synthetic peptide"
HLRTPPHPHH

SEQ ID NO: 18949 - protein, 10 aa, Artificial Sequence
  source: /note="Description of Artificial Sequence: Synthetic peptide"
RTPPHPHHLR

SEQ ID NO: 18950 - protein, 10 aa, Artificial Sequence
  source: /note="Description of Artificial Sequence: Synthetic peptide"
HLRTHLLPHH

SEQ ID NO: 18951 - protein, 10 aa, Artificial Sequence
  source: /note="Description of Artificial Sequence: Synthetic peptide"
HLLPHHRRTR

SEQ ID NO: 18952 - protein, 10 aa, Artificial Sequence
  source: /note="Description of Artificial Sequence: Synthetic peptide"
RTRSCPCRWR

SEQ ID NO: 18953 - protein, 10 aa, Artificial Sequence
  source: /note="Description of Artificial Sequence: Synthetic peptide"
RSCPCRWRSH

SEQ ID NO: 18954 - protein, 10 aa, Artificial Sequence
  source: /note="Description of Artificial Sequence: Synthetic peptide"
RWRSHPCCHY

SEQ ID NO: 18955 - protein, 10 aa, Artificial Sequence
  source: /note="Description of Artificial Sequence: Synthetic peptide"
RSRNSAPGPR

SEQ ID NO: 18956 - protein, 10 aa, Artificial Sequence
  source: /note="Description of Artificial Sequence: Synthetic peptide"
RGRTCHPGLR

SEQ ID NO: 18957 - protein, 10 aa, Artificial Sequence
  source: /note="Description of Artificial Sequence: Synthetic peptide"
GLRSRTCPPG

SEQ ID NO: 18958 - protein, 10 aa, Artificial Sequence
  source: /note="Description of Artificial Sequence: Synthetic peptide"
RSRTCPPGLR

SEQ ID NO: 18959 - protein, 10 aa, Artificial Sequence
  source: /note="Description of Artificial Sequence: Synthetic peptide"
RSHTYLRRLR

SEQ ID NO: 18960 - protein, 10 aa, Artificial Sequence
  source: /note="Description of Artificial Sequence: Synthetic peptide"
HTYLRRLRSH

SEQ ID NO: 18961 - protein, 10 aa, Artificial Sequence
  source: /note="Description of Artificial Sequence: Synthetic peptide"
RLRSHTCPPS

SEQ ID NO: 18962 - protein, 10 aa, Artificial Sequence
  source: /note="Description of Artificial Sequence: Synthetic peptide"
SLRSHAYALC

SEQ ID NO: 18963 - protein, 10 aa, Artificial Sequence
  source: /note="Description of Artificial Sequence: Synthetic peptide"
RLRDHICPLS

SEQ ID NO: 18964 - protein, 10 aa, Artificial Sequence
  source: /note="Description of Artificial Sequence: Synthetic peptide"
RLRSRTCLLC

SEQ ID NO: 18965 - protein, 10 aa, Artificial Sequence
  source: /note="Description of Artificial Sequence: Synthetic peptide"
RNHTCPPSLR

SEQ ID NO: 18966 - protein, 10 aa, Artificial Sequence
  source: /note="Description of Artificial Sequence: Synthetic peptide"
SLRSHACPPG

SEQ ID NO: 18967 - protein, 10 aa, Artificial Sequence
  source: /note="Description of Artificial Sequence: Synthetic peptide"
GLRNRICPLS

SEQ ID NO: 18968 - protein, 10 aa, Artificial Sequence
  source: /note="Description of Artificial Sequence: Synthetic peptide"
RNRICPLSLR

SEQ ID NO: 18969 - protein, 10 aa, Artificial Sequence
  source: /note="Description of Artificial Sequence: Synthetic peptide"
SLRSHPCPLG

SEQ ID NO: 18970 - protein, 10 aa, Artificial Sequence
  source: /note="Description of Artificial Sequence: Synthetic peptide"
KSPLRSQANA

SEQ ID NO: 18971 - protein, 10 aa, Artificial Sequence
  source: /note="Description of Artificial Sequence: Synthetic peptide"
CLWCHACLHR

SEQ ID NO: 18972 - protein, 10 aa, Artificial Sequence
  source: /note="Description of Artificial Sequence: Synthetic peptide"
CPHRLRSLPR

SEQ ID NO: 18973 - protein, 10 aa, Artificial Sequence
  source: /note="Description of Artificial Sequence: Synthetic peptide"
HPCCHYLRSR

SEQ ID NO: 18974 - protein, 10 aa, Artificial Sequence
  source: /note="Description of Artificial Sequence: Synthetic peptide"
HACPPGLRNR

SEQ ID NO: 18975 - protein, 10 aa, Artificial Sequence
  source: /note="Description of Artificial Sequence: Synthetic peptide"
LPCPHRLRSL

SEQ ID NO: 18976 - protein, 10 aa, Artificial Sequence
  source: /note="Description of Artificial Sequence: Synthetic peptide"
RPLHLRLHAS

SEQ ID NO: 18977 - protein, 10 aa, Artificial Sequence
  source: /note="Description of Artificial Sequence: Synthetic peptide"
SPHHLRTPPH

SEQ ID NO: 18978 - protein, 10 aa, Artificial Sequence
  source: /note="Description of Artificial Sequence: Synthetic peptide"
HPHHLRTHLL

SEQ ID NO: 18979 - protein, 10 aa, Artificial Sequence
  source: /note="Description of Artificial Sequence: Synthetic peptide"
LPHHRRTRSC

SEQ ID NO: 18980 - protein, 10 aa, Artificial Sequence
  source: /note="Description of Artificial Sequence: Synthetic peptide"
PPRLRSRTCL

SEQ ID NO: 18981 - protein, 10 aa, Artificial Sequence
  source: /note="Description of Artificial Sequence: Synthetic peptide"
SPLRSQANAL

SEQ ID NO: 18982 - protein, 10 aa, Artificial Sequence
  source: /note="Description of Artificial Sequence: Synthetic peptide"
CPRSCRCPHL

SEQ ID NO: 18983 - protein, 10 aa, Artificial Sequence
  source: /note="Description of Artificial Sequence: Synthetic peptide"
YLRSRNSAPG

SEQ ID NO: 18984 - protein, 10 aa, Artificial Sequence
  source: /note="Description of Artificial Sequence: Synthetic peptide"
YLRRLRSHTC

SEQ ID NO: 18985 - protein, 10 aa, Artificial Sequence
  source: /note="Description of Artificial Sequence: Synthetic peptide"
HAYALCLRSH

SEQ ID NO: 18986 - protein, 10 aa, Artificial Sequence
  source: /note="Description of Artificial Sequence: Synthetic peptide"
HRLRSLPRPL

SEQ ID NO: 18987 - protein, 10 aa, Artificial Sequence
  source: /note="Description of Artificial Sequence: Synthetic peptide"
LRSLPRPLHL

SEQ ID NO: 18988 - protein, 10 aa, Artificial Sequence
  source: /note="Description of Artificial Sequence: Synthetic peptide"
LHLRLHASPH

SEQ ID NO: 18989 - protein, 10 aa, Artificial Sequence
  source: /note="Description of Artificial Sequence: Synthetic peptide"
LRLHASPHHL

SEQ ID NO: 18990 - protein, 10 aa, Artificial Sequence
  source: /note="Description of Artificial Sequence: Synthetic peptide"
LRTPPHPHHL

SEQ ID NO: 18991 - protein, 10 aa, Artificial Sequence
  source: /note="Description of Artificial Sequence: Synthetic peptide"
HHLRTHLLPH

SEQ ID NO: 18992 - protein, 10 aa, Artificial Sequence
  source: /note="Description of Artificial Sequence: Synthetic peptide"
WRSHPCCHYL

SEQ ID NO: 18993 - protein, 10 aa, Artificial Sequence
  source: /note="Description of Artificial Sequence: Synthetic peptide"
CHYLRSRNSA

SEQ ID NO: 18994 - protein, 10 aa, Artificial Sequence
  source: /note="Description of Artificial Sequence: Synthetic peptide"
LRSHTYLRRL

SEQ ID NO: 18995 - protein, 10 aa, Artificial Sequence
  source: /note="Description of Artificial Sequence: Synthetic peptide"
LRSHTCPPSL

SEQ ID NO: 18996 - protein, 10 aa, Artificial Sequence
  source: /note="Description of Artificial Sequence: Synthetic peptide"
LRSHAYALCL

SEQ ID NO: 18997 - protein, 10 aa, Artificial Sequence
  source: /note="Description of Artificial Sequence: Synthetic peptide"
LRSHTCPPRL

SEQ ID NO: 18998 - protein, 10 aa, Artificial Sequence
  source: /note="Description of Artificial Sequence: Synthetic peptide"
LRNCTCPPRL

SEQ ID NO: 18999 - protein, 10 aa, Artificial Sequence
  source: /note="Description of Artificial Sequence: Synthetic peptide"
LRSHACPPNL

SEQ ID NO: 19000 - protein, 10 aa, Artificial Sequence
  source: /note="Description of Artificial Sequence: Synthetic peptide"
LRNHTCPPSL

SEQ ID NO: 19001 - protein, 10 aa, Artificial Sequence
  source: /note="Description of Artificial Sequence: Synthetic peptide"
LRSHACPPGL

SEQ ID NO: 19002 - protein, 10 aa, Artificial Sequence
  source: /note="Description of Artificial Sequence: Synthetic peptide"
LRNRICPLSL

SEQ ID NO: 19003 - protein, 10 aa, Artificial Sequence
  source: /note="Description of Artificial Sequence: Synthetic peptide"
LSLRSHPCPL

SEQ ID NO: 19004 - protein, 10 aa, Artificial Sequence
  source: /note="Description of Artificial Sequence: Synthetic peptide"
LRSQANALHL

SEQ ID NO: 19005 - protein, 10 aa, Artificial Sequence
  source: /note="Description of Artificial Sequence: Synthetic peptide"
SQANALHLRS

SEQ ID NO: 19006 - protein, 10 aa, Artificial Sequence
  source: /note="Description of Artificial Sequence: Synthetic peptide"
LHLRSCPCSL

SEQ ID NO: 19007 - protein, 10 aa, Artificial Sequence
  source: /note="Description of Artificial Sequence: Synthetic peptide"
LRSCPCSLPL

SEQ ID NO: 19008 - protein, 10 aa, Artificial Sequence
  source: /note="Description of Artificial Sequence: Synthetic peptide"
LSLGNHLCPL

SEQ ID NO: 19009 - protein, 10 aa, Artificial Sequence
  source: /note="Description of Artificial Sequence: Synthetic peptide"
CPPGLRSHTY

SEQ ID NO: 19010 - protein, 10 aa, Artificial Sequence
  source: /note="Description of Artificial Sequence: Synthetic peptide"
CPPSLRSHAY

SEQ ID NO: 19011 - protein, 9 aa, Artificial Sequence
  source: /note="Description of Artificial Sequence: Synthetic peptide"
RLWHLLLQV

SEQ ID NO: 19012 - protein, 9 aa, Artificial Sequence
  source: /note="Description of Artificial Sequence: Synthetic peptide"
ALAPTLTHM

SEQ ID NO: 19013 - protein, 9 aa, Artificial Sequence
  source: /note="Description of Artificial Sequence: Synthetic peptide"
LQVTQTSFA

SEQ ID NO: 19014 - protein, 9 aa, Artificial Sequence
  source: /note="Description of Artificial Sequence: Synthetic peptide"
VTQTSFALA

SEQ ID NO: 19015 - protein, 9 aa, Artificial Sequence
  source: /note="Description of Artificial Sequence: Synthetic peptide"
QVTQTSFAL

SEQ ID NO: 19016 - protein, 9 aa, Artificial Sequence
  source: /note="Description of Artificial Sequence: Synthetic peptide"
QTSFALAPT

SEQ ID NO: 19017 - protein, 9 aa, Artificial Sequence
  source: /note="Description of Artificial Sequence: Synthetic peptide"
LPRLWHLLL

SEQ ID NO: 19018 - protein, 9 aa, Artificial Sequence
  source: /note="Description of Artificial Sequence: Synthetic peptide"
LLQVTQTSF

SEQ ID NO: 19019 - protein, 9 aa, Artificial Sequence
  source: /note="Description of Artificial Sequence: Synthetic peptide"
GLRPQEPPL

SEQ ID NO: 19020 - protein, 9 aa, Artificial Sequence
  source: /note="Description of Artificial Sequence: Synthetic peptide"
TQTSFALAP

SEQ ID NO: 19021 - protein, 9 aa, Artificial Sequence
  source: /note="Description of Artificial Sequence: Synthetic peptide"
TSFALAPTL

SEQ ID NO: 19022 - protein, 9 aa, Artificial Sequence
  source: /note="Description of Artificial Sequence: Synthetic peptide"
FALAPTLTH

SEQ ID NO: 19023 - protein, 10 aa, Artificial Sequence
  source: /note="Description of Artificial Sequence: Synthetic peptide"
RLWHLLLQVT

SEQ ID NO: 19024 - protein, 10 aa, Artificial Sequence
  source: /note="Description of Artificial Sequence: Synthetic peptide"
ALAPTLTHML

SEQ ID NO: 19025 - protein, 10 aa, Artificial Sequence
  source: /note="Description of Artificial Sequence: Synthetic peptide"
LLQVTQTSFA

SEQ ID NO: 19026 - protein, 10 aa, Artificial Sequence
  source: /note="Description of Artificial Sequence: Synthetic peptide"
LQVTQTSFAL

SEQ ID NO: 19027 - protein, 10 aa, Artificial Sequence
  source: /note="Description of Artificial Sequence: Synthetic peptide"
LLLQVTQTSF

SEQ ID NO: 19028 - protein, 10 aa, Artificial Sequence
  source: /note="Description of Artificial Sequence: Synthetic peptide"
QVTQTSFALA

SEQ ID NO: 19029 - protein, 10 aa, Artificial Sequence
  source: /note="Description of Artificial Sequence: Synthetic peptide"
QTSFALAPTL

SEQ ID NO: 19030 - protein, 10 aa, Artificial Sequence
  source: /note="Description of Artificial Sequence: Synthetic peptide"
RPQEPPLPRL

SEQ ID NO: 19031 - protein, 10 aa, Artificial Sequence
  source: /note="Description of Artificial Sequence: Synthetic peptide"
FALAPTLTHM

SEQ ID NO: 19032 - protein, 10 aa, Artificial Sequence
  source: /note="Description of Artificial Sequence: Synthetic peptide"
TQTSFALAPT

SEQ ID NO: 19033 - protein, 9 aa, Artificial Sequence
  source: /note="Description of Artificial Sequence: Synthetic peptide"
LLDKFFCTT

SEQ ID NO: 19034 - protein, 9 aa, Artificial Sequence
  source: /note="Description of Artificial Sequence: Synthetic peptide"
SPGDLLDKF

SEQ ID NO: 19035 - protein, 10 aa, Artificial Sequence
  source: /note="Description of Artificial Sequence: Synthetic peptide"
SPGDLLDKFF

SEQ ID NO: 19036 - protein, 10 aa, Artificial Sequence
  source: /note="Description of Artificial Sequence: Synthetic peptide"
KCKQSGEDSK

SEQ ID NO: 19037 - protein, 9 aa, Artificial Sequence
  source: /note="Description of Artificial Sequence: Synthetic peptide"
FLRTKLCFA

SEQ ID NO: 19038 - protein, 9 aa, Artificial Sequence
  source: /note="Description of Artificial Sequence: Synthetic peptide"
AIKAQCMFL

SEQ ID NO: 19039 - protein, 9 aa, Artificial Sequence
  source: /note="Description of Artificial Sequence: Synthetic peptide"
AQCMFLRTK

SEQ ID NO: 19040 - protein, 9 aa, Artificial Sequence
  source: /note="Description of Artificial Sequence: Synthetic peptide"
MFLRTKLCF

SEQ ID NO: 19041 - protein, 9 aa, Artificial Sequence
  source: /note="Description of Artificial Sequence: Synthetic peptide"
RTKLCFAPC

SEQ ID NO: 19042 - protein, 9 aa, Artificial Sequence
  source: /note="Description of Artificial Sequence: Synthetic peptide"
CFAPCTNQR

SEQ ID NO: 19043 - protein, 10 aa, Artificial Sequence
  source: /note="Description of Artificial Sequence: Synthetic peptide"
AIKAQCMFLR

SEQ ID NO: 19044 - protein, 10 aa, Artificial Sequence
  source: /note="Description of Artificial Sequence: Synthetic peptide"
KAQCMFLRTK

SEQ ID NO: 19045 - protein, 10 aa, Artificial Sequence
  source: /note="Description of Artificial Sequence: Synthetic peptide"
CTNQREFMSK

SEQ ID NO: 19046 - protein, 10 aa, Artificial Sequence
  source: /note="Description of Artificial Sequence: Synthetic peptide"
CMFLRTKLCF

SEQ ID NO: 19047 - protein, 10 aa, Artificial Sequence
  source: /note="Description of Artificial Sequence: Synthetic peptide"
RTKLCFAPCT

SEQ ID NO: 19048 - protein, 10 aa, Artificial Sequence
  source: /note="Description of Artificial Sequence: Synthetic peptide"
FLRTKLCFAP

SEQ ID NO: 19049 - protein, 10 aa, Artificial Sequence
  source: /note="Description of Artificial Sequence: Synthetic peptide"
AQCMFLRTKL

SEQ ID NO: 19050 - protein, 10 aa, Artificial Sequence
  source: /note="Description of Artificial Sequence: Synthetic peptide"
FAPCTNQREF

SEQ ID NO: 19051 - protein, 10 aa, Artificial Sequence
  source: /note="Description of Artificial Sequence: Synthetic peptide"
LPYADHNCGA

SEQ ID NO: 19052 - protein, 9 aa, Artificial Sequence
  source: /note="Description of Artificial Sequence: Synthetic peptide"
STARVHTLR

SEQ ID NO: 19053 - protein, 9 aa, Artificial Sequence
  source: /note="Description of Artificial Sequence: Synthetic peptide"
RVHTLRQTS

SEQ ID NO: 19054 - protein, 9 aa, Artificial Sequence
  source: /note="Description of Artificial Sequence: Synthetic peptide"
GMVSTARVH

SEQ ID NO: 19055 - protein, 9 aa, Artificial Sequence
  source: /note="Description of Artificial Sequence: Synthetic peptide"
VSTARVHTL

SEQ ID NO: 19056 - protein, 10 aa, Artificial Sequence
  source: /note="Description of Artificial Sequence: Synthetic peptide"
MVSTARVHTL

SEQ ID NO: 19057 - protein, 10 aa, Artificial Sequence
  source: /note="Description of Artificial Sequence: Synthetic peptide"
VSTARVHTLR

SEQ ID NO: 19058 - protein, 10 aa, Artificial Sequence
  source: /note="Description of Artificial Sequence: Synthetic peptide"
RVHTLRQTSL

SEQ ID NO: 19059 - protein, 10 aa, Artificial Sequence
  source: /note="Description of Artificial Sequence: Synthetic peptide"
SFNGMVSTAR

SEQ ID NO: 19060 - protein, 10 aa, Artificial Sequence
  source: /note="Description of Artificial Sequence: Synthetic peptide"
CISARSGEGI

SEQ ID NO: 19061 - protein, 9 aa, Artificial Sequence
  source: /note="Description of Artificial Sequence: Synthetic peptide"
KSEKCRSSL

SEQ ID NO: 19062 - protein, 9 aa, Artificial Sequence
  source: /note="Description of Artificial Sequence: Synthetic peptide"
KCRSSLDWR

SEQ ID NO: 19063 - protein, 10 aa, Artificial Sequence
  source: /note="Description of Artificial Sequence: Synthetic peptide"
KKSEKCRSSL

SEQ ID NO: 19064 - protein, 10 aa, Artificial Sequence
  source: /note="Description of Artificial Sequence: Synthetic peptide"
SEKCRSSLDW

SEQ ID NO: 19065 - protein, 9 aa, Artificial Sequence
  source: /note="Description of Artificial Sequence: Synthetic peptide"
HLSINLFSL

SEQ ID NO: 19066 - protein, 9 aa, Artificial Sequence
  source: /note="Description of Artificial Sequence: Synthetic peptide"
NLFSLNKTL

SEQ ID NO: 19067 - protein, 9 aa, Artificial Sequence
  source: /note="Description of Artificial Sequence: Synthetic peptide"
SINLFSLNK

SEQ ID NO: 19068 - protein, 9 aa, Artificial Sequence
  source: /note="Description of Artificial Sequence: Synthetic peptide"
SIHLSINLF

SEQ ID NO: 19069 - protein, 9 aa, Artificial Sequence
  source: /note="Description of Artificial Sequence: Synthetic peptide"
KSIHLSINL

SEQ ID NO: 19070 - protein, 10 aa, Artificial Sequence
  source: /note="Description of Artificial Sequence: Synthetic peptide"
LSINLFSLNK

SEQ ID NO: 19071 - protein, 10 aa, Artificial Sequence
  source: /note="Description of Artificial Sequence: Synthetic peptide"
KSIHLSINLF

SEQ ID NO: 19072 - protein, 10 aa, Artificial Sequence
  source: /note="Description of Artificial Sequence: Synthetic peptide"
AKSIHLSINL

SEQ ID NO: 19073 - protein, 10 aa, Artificial Sequence
  source: /note="Description of Artificial Sequence: Synthetic peptide"
IHLSINLFSL

SEQ ID NO: 19074 - protein, 9 aa, Artificial Sequence
  source: /note="Description of Artificial Sequence: Synthetic peptide"
SLPKKINSL

SEQ ID NO: 19075 - protein, 9 aa, Artificial Sequence
  source: /note="Description of Artificial Sequence: Synthetic peptide"
SLKKPTVNL

SEQ ID NO: 19076 - protein, 9 aa, Artificial Sequence
  source: /note="Description of Artificial Sequence: Synthetic peptide"
KSLPKKINS

SEQ ID NO: 19077 - protein, 9 aa, Artificial Sequence
  source: /note="Description of Artificial Sequence: Synthetic peptide"
LPKKINSLK

SEQ ID NO: 19078 - protein, 10 aa, Artificial Sequence
  source: /note="Description of Artificial Sequence: Synthetic peptide"
SLPKKINSLK

SEQ ID NO: 19079 - protein, 10 aa, Artificial Sequence
  source: /note="Description of Artificial Sequence: Synthetic peptide"
KSLPKKINSL

SEQ ID NO: 19080 - protein, 10 aa, Artificial Sequence
  source: /note="Description of Artificial Sequence: Synthetic peptide"
KINSLKKPTV

SEQ ID NO: 19081 - protein, 9 aa, Artificial Sequence
  source: /note="Description of Artificial Sequence: Synthetic peptide"
ALAKPLNDK

SEQ ID NO: 19082 - protein, 9 aa, Artificial Sequence
  source: /note="Description of Artificial Sequence: Synthetic peptide"
LAKPLNDKK

SEQ ID NO: 19083 - protein, 10 aa, Artificial Sequence
  source: /note="Description of Artificial Sequence: Synthetic peptide"
RALAKPLNDK

SEQ ID NO: 19084 - protein, 10 aa, Artificial Sequence
  source: /note="Description of Artificial Sequence: Synthetic peptide"
ALAKPLNDKK

SEQ ID NO: 19085 - protein, 9 aa, Artificial Sequence
  source: /note="Description of Artificial Sequence: Synthetic peptide"
RCALWNGSM

SEQ ID NO: 19086 - protein, 9 aa, Artificial Sequence
  source: /note="Description of Artificial Sequence: Synthetic peptide"
GMYLMHAPL

SEQ ID NO: 19087 - protein, 9 aa, Artificial Sequence
  source: /note="Description of Artificial Sequence: Synthetic peptide"
YLMHAPLDL

SEQ ID NO: 19088 - protein, 10 aa, Artificial Sequence
  source: /note="Description of Artificial Sequence: Synthetic peptide"
FGMYLMHAPL

SEQ ID NO: 19089 - protein, 10 aa, Artificial Sequence
  source: /note="Description of Artificial Sequence: Synthetic peptide"
YLMHAPLDLS

SEQ ID NO: 19090 - protein, 10 aa, Artificial Sequence
  source: /note="Description of Artificial Sequence: Synthetic peptide"
MYLMHAPLDL

SEQ ID NO: 19091 - protein, 10 aa, Artificial Sequence
  source: /note="Description of Artificial Sequence: Synthetic peptide"
APLDLSSPCF

SEQ ID NO: 19092 - protein, 10 aa, Artificial Sequence
  source: /note="Description of Artificial Sequence: Synthetic peptide"
LMHAPLDLSS

SEQ ID NO: 19093 - protein, 10 aa, Artificial Sequence
  source: /note="Description of Artificial Sequence: Synthetic peptide"
LETKLPLSPH

SEQ ID NO: 19094 - protein, 9 aa, Artificial Sequence
  source: /note="Description of Artificial Sequence: Synthetic peptide"
HQVLDYMEV

SEQ ID NO: 19095 - protein, 9 aa, Artificial Sequence
  source: /note="Description of Artificial Sequence: Synthetic peptide"
GLFPHLAGQ

SEQ ID NO: 19096 - protein, 9 aa, Artificial Sequence
  source: /note="Description of Artificial Sequence: Synthetic peptide"
DYMEVHEGL

SEQ ID NO: 19097 - protein, 9 aa, Artificial Sequence
  source: /note="Description of Artificial Sequence: Synthetic peptide"
KPRQGGPAH

SEQ ID NO: 19098 - protein, 9 aa, Artificial Sequence
  source: /note="Description of Artificial Sequence: Synthetic peptide"
GPAHPGHQV

SEQ ID NO: 19099 - protein, 9 aa, Artificial Sequence
  source: /note="Description of Artificial Sequence: Synthetic peptide"
RQGGPAHPG

SEQ ID NO: 19100 - protein, 9 aa, Artificial Sequence
  source: /note="Description of Artificial Sequence: Synthetic peptide"
YMEVHEGLF

SEQ ID NO: 19101 - protein, 9 aa, Artificial Sequence
  source: /note="Description of Artificial Sequence: Synthetic peptide"
HPGHQVLDY

SEQ ID NO: 19102 - protein, 9 aa, Artificial Sequence
  source: /note="Description of Artificial Sequence: Synthetic peptide"
EVHEGLFPH

SEQ ID NO: 19103 - protein, 9 aa, Artificial Sequence
  source: /note="Description of Artificial Sequence: Synthetic peptide"
HEGLFPHLA

SEQ ID NO: 19104 - protein, 10 aa, Artificial Sequence
  source: /note="Description of Artificial Sequence: Synthetic peptide"
DYMEVHEGLF

SEQ ID NO: 19105 - protein, 10 aa, Artificial Sequence
  source: /note="Description of Artificial Sequence: Synthetic peptide"
EVHEGLFPHL

SEQ ID NO: 19106 - protein, 10 aa, Artificial Sequence
  source: /note="Description of Artificial Sequence: Synthetic peptide"
GPAHPGHQVL

SEQ ID NO: 19107 - protein, 10 aa, Artificial Sequence
  source: /note="Description of Artificial Sequence: Synthetic peptide"
RQGGPAHPGH

SEQ ID NO: 19108 - protein, 10 aa, Artificial Sequence
  source: /note="Description of Artificial Sequence: Synthetic peptide"
AHPGHQVLDY

SEQ ID NO: 19109 - protein, 10 aa, Artificial Sequence
  source: /note="Description of Artificial Sequence: Synthetic peptide"
HQVLDYMEVH

SEQ ID NO: 19110 - protein, 10 aa, Artificial Sequence
  source: /note="Description of Artificial Sequence: Synthetic peptide"
LDYMEVHEGL

SEQ ID NO: 19111 - protein, 10 aa, Artificial Sequence
  source: /note="Description of Artificial Sequence: Synthetic peptide"
MEVHEGLFPH

SEQ ID NO: 19112 - protein, 10 aa, Artificial Sequence
  source: /note="Description of Artificial Sequence: Synthetic peptide"
HPGHQVLDYM

SEQ ID NO: 19113 - protein, 9 aa, Artificial Sequence
  source: /note="Description of Artificial Sequence: Synthetic peptide"
SMRIGKYFI

SEQ ID NO: 19114 - protein, 9 aa, Artificial Sequence
  source: /note="Description of Artificial Sequence: Synthetic peptide"
RIGKYFILF

SEQ ID NO: 19115 - protein, 9 aa, Artificial Sequence
  source: /note="Description of Artificial Sequence: Synthetic peptide"
KYFILFTKK

SEQ ID NO: 19116 - protein, 9 aa, Artificial Sequence
  source: /note="Description of Artificial Sequence: Synthetic peptide"
SGSMRIGKY

SEQ ID NO: 19117 - protein, 9 aa, Artificial Sequence
  source: /note="Description of Artificial Sequence: Synthetic peptide"
MRIGKYFIL

SEQ ID NO: 19118 - protein, 9 aa, Artificial Sequence
  source: /note="Description of Artificial Sequence: Synthetic peptide"
GSMRIGKYF

SEQ ID NO: 19119 - protein, 10 aa, Artificial Sequence
  source: /note="Description of Artificial Sequence: Synthetic peptide"
IGKYFILFTK

SEQ ID NO: 19120 - protein, 10 aa, Artificial Sequence
  source: /note="Description of Artificial Sequence: Synthetic peptide"
MRIGKYFILF

SEQ ID NO: 19121 - protein, 10 aa, Artificial Sequence
  source: /note="Description of Artificial Sequence: Synthetic peptide"
GSMRIGKYFI

SEQ ID NO: 19122 - protein, 10 aa, Artificial Sequence
  source: /note="Description of Artificial Sequence: Synthetic peptide"
SMRIGKYFIL

SEQ ID NO: 19123 - protein, 10 aa, Artificial Sequence
  source: /note="Description of Artificial Sequence: Synthetic peptide"
KSGSMRIGKY

SEQ ID NO: 19124 - protein, 10 aa, Artificial Sequence
  source: /note="Description of Artificial Sequence: Synthetic peptide"
SGSMRIGKYF

SEQ ID NO: 19125 - protein, 9 aa, Artificial Sequence
  source: /note="Description of Artificial Sequence: Synthetic peptide"
VEVHVNREW

SEQ ID NO: 19126 - protein, 10 aa, Artificial Sequence
  source: /note="Description of Artificial Sequence: Synthetic peptide"
HVNREWYTGR

SEQ ID NO: 19127 - protein, 10 aa, Artificial Sequence
  source: /note="Description of Artificial Sequence: Synthetic peptide"
VEVHVNREWY

SEQ ID NO: 19128 - protein, 9 aa, Artificial Sequence
  source: /note="Description of Artificial Sequence: Synthetic peptide"
SAKEDSFIY

SEQ ID NO: 19129 - protein, 9 aa, Artificial Sequence
  source: /note="Description of Artificial Sequence: Synthetic peptide"
KEDSFIYPP

SEQ ID NO: 19130 - protein, 10 aa, Artificial Sequence
  source: /note="Description of Artificial Sequence: Synthetic peptide"
VSAKEDSFIY

SEQ ID NO: 19131 - protein, 10 aa, Artificial Sequence
  source: /note="Description of Artificial Sequence: Synthetic peptide"
YVSAKEDSFI

SEQ ID NO: 19132 - protein, 9 aa, Artificial Sequence
  source: /note="Description of Artificial Sequence: Synthetic peptide"
GEKRTAPSL

SEQ ID NO: 19133 - protein, 9 aa, Artificial Sequence
  source: /note="Description of Artificial Sequence: Synthetic peptide"
FTNEAPQLL

SEQ ID NO: 19134 - protein, 9 aa, Artificial Sequence
  source: /note="Description of Artificial Sequence: Synthetic peptide"
QLLSQTPRL

SEQ ID NO: 19135 - protein, 9 aa, Artificial Sequence
  source: /note="Description of Artificial Sequence: Synthetic peptide"
SQTPRLPPC

SEQ ID NO: 19136 - protein, 10 aa, Artificial Sequence
  source: /note="Description of Artificial Sequence: Synthetic peptide"
RDFTNEAPQL

SEQ ID NO: 19137 - protein, 10 aa, Artificial Sequence
  source: /note="Description of Artificial Sequence: Synthetic peptide"
SQTPRLPPCL

SEQ ID NO: 19138 - protein, 10 aa, Artificial Sequence
  source: /note="Description of Artificial Sequence: Synthetic peptide"
CLHTEEPSHW

SEQ ID NO: 19139 - protein, 10 aa, Artificial Sequence
  source: /note="Description of Artificial Sequence: Synthetic peptide"
NEAPQLLSQT

SEQ ID NO: 19140 - protein, 9 aa, Artificial Sequence
  source: /note="Description of Artificial Sequence: Synthetic peptide"
VPEFILVGY

SEQ ID NO: 19141 - protein, 10 aa, Artificial Sequence
  source: /note="Description of Artificial Sequence: Synthetic peptide"
GVPEFILVGY

SEQ ID NO: 19142 - protein, 10 aa, Artificial Sequence
  source: /note="Description of Artificial Sequence: Synthetic peptide"
VPEFILVGYV

SEQ ID NO: 19143 - protein, 9 aa, Artificial Sequence
  source: /note="Description of Artificial Sequence: Synthetic peptide"
ILKKFPHLA

SEQ ID NO: 19144 - protein, 9 aa, Artificial Sequence
  source: /note="Description of Artificial Sequence: Synthetic peptide"
RKKAKIILK

SEQ ID NO: 19145 - protein, 9 aa, Artificial Sequence
  source: /note="Description of Artificial Sequence: Synthetic peptide"
IILKKFPHL

SEQ ID NO: 19146 - protein, 9 aa, Artificial Sequence
  source: /note="Description of Artificial Sequence: Synthetic peptide"
KAKIILKKF

SEQ ID NO: 19147 - protein, 10 aa, Artificial Sequence
  source: /note="Description of Artificial Sequence: Synthetic peptide"
RKKAKIILKK

SEQ ID NO: 19148 - protein, 10 aa, Artificial Sequence
  source: /note="Description of Artificial Sequence: Synthetic peptide"
KIILKKFPHL

SEQ ID NO: 19149 - protein, 10 aa, Artificial Sequence
  source: /note="Description of Artificial Sequence: Synthetic peptide"
LERKKAKIIL

SEQ ID NO: 19150 - protein, 10 aa, Artificial Sequence
  source: /note="Description of Artificial Sequence: Synthetic peptide"
KKAKIILKKF

SEQ ID NO: 19151 - protein, 9 aa, Artificial Sequence
  source: /note="Description of Artificial Sequence: Synthetic peptide"
REEEEKKQL

SEQ ID NO: 19152 - protein, 9 aa, Artificial Sequence
  source: /note="Description of Artificial Sequence: Synthetic peptide"
ISMYIGYTI

SEQ ID NO: 19153 - protein, 9 aa, Artificial Sequence
  source: /note="Description of Artificial Sequence: Synthetic peptide"
TYGSNPISM

SEQ ID NO: 19154 - protein, 9 aa, Artificial Sequence
  source: /note="Description of Artificial Sequence: Synthetic peptide"
SMYIGYTIW

SEQ ID NO: 19155 - protein, 9 aa, Artificial Sequence
  source: /note="Description of Artificial Sequence: Synthetic peptide"
MYIGYTIWG

SEQ ID NO: 19156 - protein, 9 aa, Artificial Sequence
  source: /note="Description of Artificial Sequence: Synthetic peptide"
YGSNPISMY

SEQ ID NO: 19157 - protein, 9 aa, Artificial Sequence
  source: /note="Description of Artificial Sequence: Synthetic peptide"
NPISMYIGY

SEQ ID NO: 19158 - protein, 10 aa, Artificial Sequence
  source: /note="Description of Artificial Sequence: Synthetic peptide"
ISMYIGYTIW

SEQ ID NO: 19159 - protein, 10 aa, Artificial Sequence
  source: /note="Description of Artificial Sequence: Synthetic peptide"
MYIGYTIWGS

SEQ ID NO: 19160 - protein, 10 aa, Artificial Sequence
  source: /note="Description of Artificial Sequence: Synthetic peptide"
TYGSNPISMY

SEQ ID NO: 19161 - protein, 10 aa, Artificial Sequence
  source: /note="Description of Artificial Sequence: Synthetic peptide"
NTYGSNPISM

SEQ ID NO: 19162 - protein, 9 aa, Artificial Sequence
  source: /note="Description of Artificial Sequence: Synthetic peptide"
NLMTSAVPV

SEQ ID NO: 19163 - protein, 9 aa, Artificial Sequence
  source: /note="Description of Artificial Sequence: Synthetic peptide"
LMTSAVPVA

SEQ ID NO: 19164 - protein, 10 aa, Artificial Sequence
  source: /note="Description of Artificial Sequence: Synthetic peptide"
NLMTSAVPVA

SEQ ID NO: 19165 - protein, 10 aa, Artificial Sequence
  source: /note="Description of Artificial Sequence: Synthetic peptide"
MNLMTSAVPV

SEQ ID NO: 19166 - protein, 9 aa, Artificial Sequence
  source: /note="Description of Artificial Sequence: Synthetic peptide"
IILENIKTV

SEQ ID NO: 19167 - protein, 9 aa, Artificial Sequence
  source: /note="Description of Artificial Sequence: Synthetic peptide"
RFGIILENI

SEQ ID NO: 19168 - protein, 10 aa, Artificial Sequence
  source: /note="Description of Artificial Sequence: Synthetic peptide"
GIILENIKTV

SEQ ID NO: 19169 - protein, 10 aa, Artificial Sequence
  source: /note="Description of Artificial Sequence: Synthetic peptide"
RFGIILENIK

SEQ ID NO: 19170 - protein, 10 aa, Artificial Sequence
  source: /note="Description of Artificial Sequence: Synthetic peptide"
KRFGIILENI

SEQ ID NO: 19171 - protein, 9 aa, Artificial Sequence
  source: /note="Description of Artificial Sequence: Synthetic peptide"
KTNSSTFMK

SEQ ID NO: 19172 - protein, 9 aa, Artificial Sequence
  source: /note="Description of Artificial Sequence: Synthetic peptide"
IKTNSSTFM

SEQ ID NO: 19173 - protein, 9 aa, Artificial Sequence
  source: /note="Description of Artificial Sequence: Synthetic peptide"
FSDARHCSR

SEQ ID NO: 19174 - protein, 9 aa, Artificial Sequence
  source: /note="Description of Artificial Sequence: Synthetic peptide"
DARHCSRFR

SEQ ID NO: 19175 - protein, 9 aa, Artificial Sequence
  source: /note="Description of Artificial Sequence: Synthetic peptide"
GQFSDARHC

SEQ ID NO: 19176 - protein, 9 aa, Artificial Sequence
  source: /note="Description of Artificial Sequence: Synthetic peptide"
SDARHCSRF

SEQ ID NO: 19177 - protein, 10 aa, Artificial Sequence
  source: /note="Description of Artificial Sequence: Synthetic peptide"
FSDARHCSRF

SEQ ID NO: 19178 - protein, 10 aa, Artificial Sequence
  source: /note="Description of Artificial Sequence: Synthetic peptide"
KFFIGQFSDA

SEQ ID NO: 19179 - protein, 10 aa, Artificial Sequence
  source: /note="Description of Artificial Sequence: Synthetic peptide"
FFIGQFSDAR

SEQ ID NO: 19180 - protein, 10 aa, Artificial Sequence
  source: /note="Description of Artificial Sequence: Synthetic peptide"
QFSDARHCSR

SEQ ID NO: 19181 - protein, 10 aa, Artificial Sequence
  source: /note="Description of Artificial Sequence: Synthetic peptide"
GQFSDARHCS

SEQ ID NO: 19182 - protein, 10 aa, Artificial Sequence
  source: /note="Description of Artificial Sequence: Synthetic peptide"
ARHCSRFRTL

SEQ ID NO: 19183 - protein, 9 aa, Artificial Sequence
  source: /note="Description of Artificial Sequence: Synthetic peptide"
LLPEDTPPL

SEQ ID NO: 19184 - protein, 9 aa, Artificial Sequence
  source: /note="Description of Artificial Sequence: Synthetic peptide"
LPEDTPPLL

SEQ ID NO: 19185 - protein, 10 aa, Artificial Sequence
  source: /note="Description of Artificial Sequence: Synthetic peptide"
ILLPEDTPPL

SEQ ID NO: 19186 - protein, 10 aa, Artificial Sequence
  source: /note="Description of Artificial Sequence: Synthetic peptide"
LLPEDTPPLL

SEQ ID NO: 19187 - protein, 9 aa, Artificial Sequence
  source: /note="Description of Artificial Sequence: Synthetic peptide"
GSHHPCITK

SEQ ID NO: 19188 - protein, 10 aa, Artificial Sequence
  source: /note="Description of Artificial Sequence: Synthetic peptide"
KGSHHPCITK

SEQ ID NO: 19189 - protein, 10 aa, Artificial Sequence
  source: /note="Description of Artificial Sequence: Synthetic peptide"
ELKGSHHPCI

SEQ ID NO: 19190 - protein, 10 aa, Artificial Sequence
  source: /note="Description of Artificial Sequence: Synthetic peptide"
SHHPCITKTF

SEQ ID NO: 19191 - protein, 10 aa, Artificial Sequence
  source: /note="Description of Artificial Sequence: Synthetic peptide"
LELKGSHHPC

SEQ ID NO: 19192 - protein, 9 aa, Artificial Sequence
  source: /note="Description of Artificial Sequence: Synthetic peptide"
QLSPPRAHR

SEQ ID NO: 19193 - protein, 9 aa, Artificial Sequence
  source: /note="Description of Artificial Sequence: Synthetic peptide"
SPPRAHRHL

SEQ ID NO: 19194 - protein, 9 aa, Artificial Sequence
  source: /note="Description of Artificial Sequence: Synthetic peptide"
TQLSPPRAH

SEQ ID NO: 19195 - protein, 10 aa, Artificial Sequence
  source: /note="Description of Artificial Sequence: Synthetic peptide"
PPRAHRHLPV

SEQ ID NO: 19196 - protein, 9 aa, Artificial Sequence
  source: /note="Description of Artificial Sequence: Synthetic peptide"
GWIGWISGV

SEQ ID NO: 19197 - protein, 9 aa, Artificial Sequence
  source: /note="Description of Artificial Sequence: Synthetic peptide"
WISGVPSCA

SEQ ID NO: 19198 - protein, 9 aa, Artificial Sequence
  source: /note="Description of Artificial Sequence: Synthetic peptide"
RTQMGIAMG

SEQ ID NO: 19199 - protein, 9 aa, Artificial Sequence
  source: /note="Description of Artificial Sequence: Synthetic peptide"
QTRCSLRSV

SEQ ID NO: 19200 - protein, 9 aa, Artificial Sequence
  source: /note="Description of Artificial Sequence: Synthetic peptide"
RCSLRSVAR

SEQ ID NO: 19201 - protein, 9 aa, Artificial Sequence
  source: /note="Description of Artificial Sequence: Synthetic peptide"
AIRATHPGQ

SEQ ID NO: 19202 - protein, 9 aa, Artificial Sequence
  source: /note="Description of Artificial Sequence: Synthetic peptide"
HQSWTPQTR

SEQ ID NO: 19203 - protein, 9 aa, Artificial Sequence
  source: /note="Description of Artificial Sequence: Synthetic peptide"
HPGQSACGI

SEQ ID NO: 19204 - protein, 9 aa, Artificial Sequence
  source: /note="Description of Artificial Sequence: Synthetic peptide"
EENFCRTQM

SEQ ID NO: 19205 - protein, 9 aa, Artificial Sequence
  source: /note="Description of Artificial Sequence: Synthetic peptide"
CRTQMGIAM

SEQ ID NO: 19206 - protein, 9 aa, Artificial Sequence
  source: /note="Description of Artificial Sequence: Synthetic peptide"
SLRSVARGW

SEQ ID NO: 19207 - protein, 9 aa, Artificial Sequence
  source: /note="Description of Artificial Sequence: Synthetic peptide"
ISGVPSCAW

SEQ ID NO: 19208 - protein, 9 aa, Artificial Sequence
  source: /note="Description of Artificial Sequence: Synthetic peptide"
RATHPGQSA

SEQ ID NO: 19209 - protein, 10 aa, Artificial Sequence
  source: /note="Description of Artificial Sequence: Synthetic peptide"
SLRSVARGWI

SEQ ID NO: 19210 - protein, 10 aa, Artificial Sequence
  source: /note="Description of Artificial Sequence: Synthetic peptide"
SVARGWIGWI

SEQ ID NO: 19211 - protein, 10 aa, Artificial Sequence
  source: /note="Description of Artificial Sequence: Synthetic peptide"
QTRCSLRSVA

SEQ ID NO: 19212 - protein, 10 aa, Artificial Sequence
  source: /note="Description of Artificial Sequence: Synthetic peptide"
RGWIGWISGV

SEQ ID NO: 19213 - protein, 10 aa, Artificial Sequence
  source: /note="Description of Artificial Sequence: Synthetic peptide"
AIRATHPGQS

SEQ ID NO: 19214 - protein, 10 aa, Artificial Sequence
  source: /note="Description of Artificial Sequence: Synthetic peptide"
WTPQTRCSLR

SEQ ID NO: 19215 - protein, 10 aa, Artificial Sequence
  source: /note="Description of Artificial Sequence: Synthetic peptide"
VPSCAWLGAI

SEQ ID NO: 19216 - protein, 10 aa, Artificial Sequence
  source: /note="Description of Artificial Sequence: Synthetic peptide"
FCRTQMGIAM

SEQ ID NO: 19217 - protein, 10 aa, Artificial Sequence
  source: /note="Description of Artificial Sequence: Synthetic peptide"
LEENFCRTQM

SEQ ID NO: 19218 - protein, 10 aa, Artificial Sequence
  source: /note="Description of Artificial Sequence: Synthetic peptide"
CSLRSVARGW

SEQ ID NO: 19219 - protein, 10 aa, Artificial Sequence
  source: /note="Description of Artificial Sequence: Synthetic peptide"
RSVARGWIGW

SEQ ID NO: 19220 - protein, 10 aa, Artificial Sequence
  source: /note="Description of Artificial Sequence: Synthetic peptide"
WISGVPSCAW

SEQ ID NO: 19221 - protein, 9 aa, Artificial Sequence
  source: /note="Description of Artificial Sequence: Synthetic peptide"
VTVAHVGTM

SEQ ID NO: 19222 - protein, 10 aa, Artificial Sequence
  source: /note="Description of Artificial Sequence: Synthetic peptide"
RLDNVTVAHV

SEQ ID NO: 19223 - protein, 9 aa, Artificial Sequence
  source: /note="Description of Artificial Sequence: Synthetic peptide"
HLEGEGLKM

SEQ ID NO: 19224 - protein, 9 aa, Artificial Sequence
  source: /note="Description of Artificial Sequence: Synthetic peptide"
LKMSFLPTV

SEQ ID NO: 19225 - protein, 9 aa, Artificial Sequence
  source: /note="Description of Artificial Sequence: Synthetic peptide"
GEGLKMSFL

SEQ ID NO: 19226 - protein, 10 aa, Artificial Sequence
  source: /note="Description of Artificial Sequence: Synthetic peptide"
GLKMSFLPTV

SEQ ID NO: 19227 - protein, 10 aa, Artificial Sequence
  source: /note="Description of Artificial Sequence: Synthetic peptide"
LEGEGLKMSF

SEQ ID NO: 19228 - protein, 9 aa, Artificial Sequence
  source: /note="Description of Artificial Sequence: Synthetic peptide"
RLCPELVRV

SEQ ID NO: 19229 - protein, 9 aa, Artificial Sequence
  source: /note="Description of Artificial Sequence: Synthetic peptide"
RLRLCPELV

SEQ ID NO: 19230 - protein, 9 aa, Artificial Sequence
  source: /note="Description of Artificial Sequence: Synthetic peptide"
RAGGMWPPR

SEQ ID NO: 19231 - protein, 9 aa, Artificial Sequence
  source: /note="Description of Artificial Sequence: Synthetic peptide"
MWPPRPPDL

SEQ ID NO: 19232 - protein, 9 aa, Artificial Sequence
  source: /note="Description of Artificial Sequence: Synthetic peptide"
VLRGHPRLR

SEQ ID NO: 19233 - protein, 9 aa, Artificial Sequence
  source: /note="Description of Artificial Sequence: Synthetic peptide"
RGHPRLRLC

SEQ ID NO: 19234 - protein, 9 aa, Artificial Sequence
  source: /note="Description of Artificial Sequence: Synthetic peptide"
LVRVGRAGG

SEQ ID NO: 19235 - protein, 9 aa, Artificial Sequence
  source: /note="Description of Artificial Sequence: Synthetic peptide"
HPRLRLCPE

SEQ ID NO: 19236 - protein, 9 aa, Artificial Sequence
  source: /note="Description of Artificial Sequence: Synthetic peptide"
RVGRAGGMW

SEQ ID NO: 19237 - protein, 10 aa, Artificial Sequence
  source: /note="Description of Artificial Sequence: Synthetic peptide"
GMWPPRPPDL

SEQ ID NO: 19238 - protein, 10 aa, Artificial Sequence
  source: /note="Description of Artificial Sequence: Synthetic peptide"
RLRLCPELVR

SEQ ID NO: 19239 - protein, 10 aa, Artificial Sequence
  source: /note="Description of Artificial Sequence: Synthetic peptide"
VLRGHPRLRL

SEQ ID NO: 19240 - protein, 10 aa, Artificial Sequence
  source: /note="Description of Artificial Sequence: Synthetic peptide"
LVRVGRAGGM

SEQ ID NO: 19241 - protein, 10 aa, Artificial Sequence
  source: /note="Description of Artificial Sequence: Synthetic peptide"
DLDVLRGHPR

SEQ ID NO: 19242 - protein, 10 aa, Artificial Sequence
  source: /note="Description of Artificial Sequence: Synthetic peptide"
DVLRGHPRLR

SEQ ID NO: 19243 - protein, 10 aa, Artificial Sequence
  source: /note="Description of Artificial Sequence: Synthetic peptide"
HPRLRLCPEL

SEQ ID NO: 19244 - protein, 9 aa, Artificial Sequence
  source: /note="Description of Artificial Sequence: Synthetic peptide"
AMEKTQIMY

SEQ ID NO: 19245 - protein, 9 aa, Artificial Sequence
  source: /note="Description of Artificial Sequence: Synthetic peptide"
KTQIMYMKL

SEQ ID NO: 19246 - protein, 9 aa, Artificial Sequence
  source: /note="Description of Artificial Sequence: Synthetic peptide"
RAMEKTQIM

SEQ ID NO: 19247 - protein, 9 aa, Artificial Sequence
  source: /note="Description of Artificial Sequence: Synthetic peptide"
TQIMYMKLY

SEQ ID NO: 19248 - protein, 9 aa, Artificial Sequence
  source: /note="Description of Artificial Sequence: Synthetic peptide"
MEKTQIMYM

SEQ ID NO: 19249 - protein, 10 aa, Artificial Sequence
  source: /note="Description of Artificial Sequence: Synthetic peptide"
KTQIMYMKLY

SEQ ID NO: 19250 - protein, 10 aa, Artificial Sequence
  source: /note="Description of Artificial Sequence: Synthetic peptide"
RAMEKTQIMY

SEQ ID NO: 19251 - protein, 10 aa, Artificial Sequence
  source: /note="Description of Artificial Sequence: Synthetic peptide"
MEKTQIMYMK

SEQ ID NO: 19252 - protein, 10 aa, Artificial Sequence
  source: /note="Description of Artificial Sequence: Synthetic peptide"
ARAMEKTQIM

SEQ ID NO: 19253 - protein, 10 aa, Artificial Sequence
  source: /note="Description of Artificial Sequence: Synthetic peptide"
AMEKTQIMYM

SEQ ID NO: 19254 - protein, 9 aa, Artificial Sequence
  source: /note="Description of Artificial Sequence: Synthetic peptide"
SYYHKKMGW

SEQ ID NO: 19255 - protein, 9 aa, Artificial Sequence
  source: /note="Description of Artificial Sequence: Synthetic peptide"
VLSYYHKKM

SEQ ID NO: 19256 - protein, 10 aa, Artificial Sequence
  source: /note="Description of Artificial Sequence: Synthetic peptide"
LSYYHKKMGW

SEQ ID NO: 19257 - protein, 9 aa, Artificial Sequence
  source: /note="Description of Artificial Sequence: Synthetic peptide"
APVAYDKKM

SEQ ID NO: 19258 - protein, 9 aa, Artificial Sequence
  source: /note="Description of Artificial Sequence: Synthetic peptide"
HEWEDAPVA

SEQ ID NO: 19259 - protein, 10 aa, Artificial Sequence
  source: /note="Description of Artificial Sequence: Synthetic peptide"
KLHEWEDAPV

SEQ ID NO: 19260 - protein, 10 aa, Artificial Sequence
  source: /note="Description of Artificial Sequence: Synthetic peptide"
HEWEDAPVAY

SEQ ID NO: 19261 - protein, 9 aa, Artificial Sequence
  source: /note="Description of Artificial Sequence: Synthetic peptide"
LMLGRMRFL

SEQ ID NO: 19262 - protein, 9 aa, Artificial Sequence
  source: /note="Description of Artificial Sequence: Synthetic peptide"
RFLEALGEW

SEQ ID NO: 19263 - protein, 9 aa, Artificial Sequence
  source: /note="Description of Artificial Sequence: Synthetic peptide"
LGRMRFLEA

SEQ ID NO: 19264 - protein, 9 aa, Artificial Sequence
  source: /note="Description of Artificial Sequence: Synthetic peptide"
RMRFLEALG

SEQ ID NO: 19265 - protein, 9 aa, Artificial Sequence
  source: /note="Description of Artificial Sequence: Synthetic peptide"
ELMLGRMRF

SEQ ID NO: 19266 - protein, 9 aa, Artificial Sequence
  source: /note="Description of Artificial Sequence: Synthetic peptide"
GRMRFLEAL

SEQ ID NO: 19267 - protein, 10 aa, Artificial Sequence
  source: /note="Description of Artificial Sequence: Synthetic peptide"
MLGRMRFLEA

SEQ ID NO: 19268 - protein, 10 aa, Artificial Sequence
  source: /note="Description of Artificial Sequence: Synthetic peptide"
RMRFLEALGE

SEQ ID NO: 19269 - protein, 10 aa, Artificial Sequence
  source: /note="Description of Artificial Sequence: Synthetic peptide"
ELMLGRMRFL

SEQ ID NO: 19270 - protein, 10 aa, Artificial Sequence
  source: /note="Description of Artificial Sequence: Synthetic peptide"
LGRMRFLEAL

SEQ ID NO: 19271 - protein, 10 aa, Artificial Sequence
  source: /note="Description of Artificial Sequence: Synthetic peptide"
MRFLEALGEW

SEQ ID NO: 19272 - protein, 9 aa, Artificial Sequence
  source: /note="Description of Artificial Sequence: Synthetic peptide"
LLANDPTYL

SEQ ID NO: 19273 - protein, 9 aa, Artificial Sequence
  source: /note="Description of Artificial Sequence: Synthetic peptide"
LANDPTYLR

SEQ ID NO: 19274 - protein, 9 aa, Artificial Sequence
  source: /note="Description of Artificial Sequence: Synthetic peptide"
TYLRKNLSI

SEQ ID NO: 19275 - protein, 9 aa, Artificial Sequence
  source: /note="Description of Artificial Sequence: Synthetic peptide"
TLLANDPTY

SEQ ID NO: 19276 - protein, 10 aa, Artificial Sequence
  source: /note="Description of Artificial Sequence: Synthetic peptide"
TLLANDPTYL

SEQ ID NO: 19277 - protein, 10 aa, Artificial Sequence
  source: /note="Description of Artificial Sequence: Synthetic peptide"
LLANDPTYLR

SEQ ID NO: 19278 - protein, 10 aa, Artificial Sequence
  source: /note="Description of Artificial Sequence: Synthetic peptide"
LANDPTYLRK

SEQ ID NO: 19279 - protein, 10 aa, Artificial Sequence
  source: /note="Description of Artificial Sequence: Synthetic peptide"
NTLLANDPTY

SEQ ID NO: 19280 - protein, 10 aa, Artificial Sequence
  source: /note="Description of Artificial Sequence: Synthetic peptide"
YLRKNLSIQR

SEQ ID NO: 19281 - protein, 9 aa, Artificial Sequence
  source: /note="Description of Artificial Sequence: Synthetic peptide"
EAEWQLVLR

SEQ ID NO: 19282 - protein, 9 aa, Artificial Sequence
  source: /note="Description of Artificial Sequence: Synthetic peptide"
REAEWQLVL

SEQ ID NO: 19283 - protein, 9 aa, Artificial Sequence
  source: /note="Description of Artificial Sequence: Synthetic peptide"
AEWQLVLRL

SEQ ID NO: 19284 - protein, 9 aa, Artificial Sequence
  source: /note="Description of Artificial Sequence: Synthetic peptide"
DPQAREAEW

SEQ ID NO: 19285 - protein, 10 aa, Artificial Sequence
  source: /note="Description of Artificial Sequence: Synthetic peptide"
AEWQLVLRLK

SEQ ID NO: 19286 - protein, 9 aa, Artificial Sequence
  source: /note="Description of Artificial Sequence: Synthetic peptide"
DTKEIFSSI

SEQ ID NO: 19287 - protein, 9 aa, Artificial Sequence
  source: /note="Description of Artificial Sequence: Synthetic peptide"
KEIFSSINT

SEQ ID NO: 19288 - protein, 10 aa, Artificial Sequence
  source: /note="Description of Artificial Sequence: Synthetic peptide"
KDTKEIFSSI

SEQ ID NO: 19289 - protein, 9 aa, Artificial Sequence
  source: /note="Description of Artificial Sequence: Synthetic peptide"
TTQTGPSGV

SEQ ID NO: 19290 - protein, 10 aa, Artificial Sequence
  source: /note="Description of Artificial Sequence: Synthetic peptide"
ITTQTGPSGV

SEQ ID NO: 19291 - protein, 10 aa, Artificial Sequence
  source: /note="Description of Artificial Sequence: Synthetic peptide"
MLHTSSEPET

SEQ ID NO: 19292 - protein, 9 aa, Artificial Sequence
  source: /note="Description of Artificial Sequence: Synthetic peptide"
RPVKGPSDI

SEQ ID NO: 19293 - protein, 9 aa, Artificial Sequence
  source: /note="Description of Artificial Sequence: Synthetic peptide"
VKGPSDIHF

SEQ ID NO: 19294 - protein, 9 aa, Artificial Sequence
  source: /note="Description of Artificial Sequence: Synthetic peptide"
AVTSTTLPI

SEQ ID NO: 19295 - protein, 9 aa, Artificial Sequence
  source: /note="Description of Artificial Sequence: Synthetic peptide"
LPILTLSPG

SEQ ID NO: 19296 - protein, 10 aa, Artificial Sequence
  source: /note="Description of Artificial Sequence: Synthetic peptide"
RAVTSTTLPI

SEQ ID NO: 19297 - protein, 9 aa, Artificial Sequence
  source: /note="Description of Artificial Sequence: Synthetic peptide"
STGEAFTNI

SEQ ID NO: 19298 - protein, 9 aa, Artificial Sequence
  source: /note="Description of Artificial Sequence: Synthetic peptide"
EAFTNISLV

SEQ ID NO: 19299 - protein, 9 aa, Artificial Sequence
  source: /note="Description of Artificial Sequence: Synthetic peptide"
LTVSTGEAF

SEQ ID NO: 19300 - protein, 9 aa, Artificial Sequence
  source: /note="Description of Artificial Sequence: Synthetic peptide"
GEAFTNISL

SEQ ID NO: 19301 - protein, 10 aa, Artificial Sequence
  source: /note="Description of Artificial Sequence: Synthetic peptide"
TLTVSTGEAF

SEQ ID NO: 19302 - protein, 10 aa, Artificial Sequence
  source: /note="Description of Artificial Sequence: Synthetic peptide"
GEAFTNISLV

SEQ ID NO: 19303 - protein, 9 aa, Artificial Sequence
  source: /note="Description of Artificial Sequence: Synthetic peptide"
TTVSGTIPK

SEQ ID NO: 19304 - protein, 9 aa, Artificial Sequence
  source: /note="Description of Artificial Sequence: Synthetic peptide"
GTIPKFSHR

SEQ ID NO: 19305 - protein, 10 aa, Artificial Sequence
  source: /note="Description of Artificial Sequence: Synthetic peptide"
STTVSGTIPK

SEQ ID NO: 19306 - protein, 10 aa, Artificial Sequence
  source: /note="Description of Artificial Sequence: Synthetic peptide"
TTVSGTIPKF

SEQ ID NO: 19307 - protein, 9 aa, Artificial Sequence
  source: /note="Description of Artificial Sequence: Synthetic peptide"
HLDPKSPGV

SEQ ID NO: 19308 - protein, 10 aa, Artificial Sequence
  source: /note="Description of Artificial Sequence: Synthetic peptide"
AICTHHLDPK

SEQ ID NO: 19309 - protein, 9 aa, Artificial Sequence
  source: /note="Description of Artificial Sequence: Synthetic peptide"
LLMLVFHSK

SEQ ID NO: 19310 - protein, 9 aa, Artificial Sequence
  source: /note="Description of Artificial Sequence: Synthetic peptide"
VFHSKREVK

SEQ ID NO: 19311 - protein, 9 aa, Artificial Sequence
  source: /note="Description of Artificial Sequence: Synthetic peptide"
LMLVFHSKR

SEQ ID NO: 19312 - protein, 10 aa, Artificial Sequence
  source: /note="Description of Artificial Sequence: Synthetic peptide"
MLVFHSKREV

SEQ ID NO: 19313 - protein, 10 aa, Artificial Sequence
  source: /note="Description of Artificial Sequence: Synthetic peptide"
ALLMLVFHSK

SEQ ID NO: 19314 - protein, 10 aa, Artificial Sequence
  source: /note="Description of Artificial Sequence: Synthetic peptide"
LVFHSKREVK

SEQ ID NO: 19315 - protein, 10 aa, Artificial Sequence
  source: /note="Description of Artificial Sequence: Synthetic peptide"
HSKREVKRQK

SEQ ID NO: 19316 - protein, 10 aa, Artificial Sequence
  source: /note="Description of Artificial Sequence: Synthetic peptide"
LLMLVFHSKR

SEQ ID NO: 19317 - protein, 10 aa, Artificial Sequence
  source: /note="Description of Artificial Sequence: Synthetic peptide"
VFHSKREVKR

SEQ ID NO: 19318 - protein, 9 aa, Artificial Sequence
  source: /note="Description of Artificial Sequence: Synthetic peptide"
NVMEPRMYL

SEQ ID NO: 19319 - protein, 9 aa, Artificial Sequence
  source: /note="Description of Artificial Sequence: Synthetic peptide"
TSTNVMEPR

SEQ ID NO: 19320 - protein, 9 aa, Artificial Sequence
  source: /note="Description of Artificial Sequence: Synthetic peptide"
MEPRMYLSC

SEQ ID NO: 19321 - protein, 10 aa, Artificial Sequence
  source: /note="Description of Artificial Sequence: Synthetic peptide"
STNVMEPRMY

SEQ ID NO: 19322 - protein, 10 aa, Artificial Sequence
  source: /note="Description of Artificial Sequence: Synthetic peptide"
TTSTNVMEPR

SEQ ID NO: 19323 - protein, 10 aa, Artificial Sequence
  source: /note="Description of Artificial Sequence: Synthetic peptide"
NVMEPRMYLS

SEQ ID NO: 19324 - protein, 10 aa, Artificial Sequence
  source: /note="Description of Artificial Sequence: Synthetic peptide"
ATGTTSTNVM

SEQ ID NO: 19325 - protein, 9 aa, Artificial Sequence
  source: /note="Description of Artificial Sequence: Synthetic peptide"
TSMPVSTHA

SEQ ID NO: 19326 - protein, 9 aa, Artificial Sequence
  source: /note="Description of Artificial Sequence: Synthetic peptide"
VSTHASGQF

SEQ ID NO: 19327 - protein, 9 aa, Artificial Sequence
  source: /note="Description of Artificial Sequence: Synthetic peptide"
MPVSTHASG

SEQ ID NO: 19328 - protein, 10 aa, Artificial Sequence
  source: /note="Description of Artificial Sequence: Synthetic peptide"
LTSMPVSTHA

SEQ ID NO: 19329 - protein, 10 aa, Artificial Sequence
  source: /note="Description of Artificial Sequence: Synthetic peptide"
MPVSTHASGQ

SEQ ID NO: 19330 - protein, 9 aa, Artificial Sequence
  source: /note="Description of Artificial Sequence: Synthetic peptide"
FQHLPLTPA

SEQ ID NO: 19331 - protein, 9 aa, Artificial Sequence
  source: /note="Description of Artificial Sequence: Synthetic peptide"
HLPLTPAHL

SEQ ID NO: 19332 - protein, 9 aa, Artificial Sequence
  source: /note="Description of Artificial Sequence: Synthetic peptide"
LTSMPVRPR

SEQ ID NO: 19333 - protein, 9 aa, Artificial Sequence
  source: /note="Description of Artificial Sequence: Synthetic peptide"
PVRPRQWPV

SEQ ID NO: 19334 - protein, 9 aa, Artificial Sequence
  source: /note="Description of Artificial Sequence: Synthetic peptide"
RPRQWPVLR

SEQ ID NO: 19335 - protein, 9 aa, Artificial Sequence
  source: /note="Description of Artificial Sequence: Synthetic peptide"
RQWPVLRLA

SEQ ID NO: 19336 - protein, 9 aa, Artificial Sequence
  source: /note="Description of Artificial Sequence: Synthetic peptide"
WPVLRLAPF

SEQ ID NO: 19337 - protein, 9 aa, Artificial Sequence
  source: /note="Description of Artificial Sequence: Synthetic peptide"
LRLAPFQHL

SEQ ID NO: 19338 - protein, 9 aa, Artificial Sequence
  source: /note="Description of Artificial Sequence: Synthetic peptide"
LAPFQHLPL

SEQ ID NO: 19339 - protein, 10 aa, Artificial Sequence
  source: /note="Description of Artificial Sequence: Synthetic peptide"
RLAPFQHLPL

SEQ ID NO: 19340 - protein, 10 aa, Artificial Sequence
  source: /note="Description of Artificial Sequence: Synthetic peptide"
VLRLAPFQHL

SEQ ID NO: 19341 - protein, 10 aa, Artificial Sequence
  source: /note="Description of Artificial Sequence: Synthetic peptide"
QWPVLRLAPF

SEQ ID NO: 19342 - protein, 10 aa, Artificial Sequence
  source: /note="Description of Artificial Sequence: Synthetic peptide"
PVRPRQWPVL

SEQ ID NO: 19343 - protein, 10 aa, Artificial Sequence
  source: /note="Description of Artificial Sequence: Synthetic peptide"
MPVRPRQWPV

SEQ ID NO: 19344 - protein, 10 aa, Artificial Sequence
  source: /note="Description of Artificial Sequence: Synthetic peptide"
RPRQWPVLRL

SEQ ID NO: 19345 - protein, 10 aa, Artificial Sequence
  source: /note="Description of Artificial Sequence: Synthetic peptide"
FQHLPLTPAH

SEQ ID NO: 19346 - protein, 10 aa, Artificial Sequence
  source: /note="Description of Artificial Sequence: Synthetic peptide"
TSMPVRPRQW

SEQ ID NO: 19347 - protein, 10 aa, Artificial Sequence
  source: /note="Description of Artificial Sequence: Synthetic peptide"
RQWPVLRLAP

SEQ ID NO: 19348 - protein, 9 aa, Artificial Sequence
  source: /note="Description of Artificial Sequence: Synthetic peptide"
TLSEGTNPL

SEQ ID NO: 19349 - protein, 10 aa, Artificial Sequence
  source: /note="Description of Artificial Sequence: Synthetic peptide"
TLSEGTNPLT

SEQ ID NO: 19350 - protein, 10 aa, Artificial Sequence
  source: /note="Description of Artificial Sequence: Synthetic peptide"
GTNPLTSIPV

SEQ ID NO: 19351 - protein, 10 aa, Artificial Sequence
  source: /note="Description of Artificial Sequence: Synthetic peptide"
STLSEGTNPL

SEQ ID NO: 19352 - protein, 10 aa, Artificial Sequence
  source: /note="Description of Artificial Sequence: Synthetic peptide"
SEGTNPLTSI

SEQ ID NO: 19353 - protein, 10 aa, Artificial Sequence
  source: /note="Description of Artificial Sequence: Synthetic peptide"
NPLTSIPVSH

SEQ ID NO: 19354 - protein, 9 aa, Artificial Sequence
  source: /note="Description of Artificial Sequence: Synthetic peptide"
TTPITTTTM

SEQ ID NO: 19355 - protein, 9 aa, Artificial Sequence
  source: /note="Description of Artificial Sequence: Synthetic peptide"
TPITTTTMV

SEQ ID NO: 19356 - protein, 9 aa, Artificial Sequence
  source: /note="Description of Artificial Sequence: Synthetic peptide"
TTTTMVTPT

SEQ ID NO: 19357 - protein, 9 aa, Artificial Sequence
  source: /note="Description of Artificial Sequence: Synthetic peptide"
TTMVTPTPT

SEQ ID NO: 19358 - protein, 9 aa, Artificial Sequence
  source: /note="Description of Artificial Sequence: Synthetic peptide"
MVTPTPTPT

SEQ ID NO: 19359 - protein, 10 aa, Artificial Sequence
  source: /note="Description of Artificial Sequence: Synthetic peptide"
TTTPITTTTM

SEQ ID NO: 19360 - protein, 10 aa, Artificial Sequence
  source: /note="Description of Artificial Sequence: Synthetic peptide"
TTPITTTTMV

SEQ ID NO: 19361 - protein, 10 aa, Artificial Sequence
  source: /note="Description of Artificial Sequence: Synthetic peptide"
TMVTPTPTPT

SEQ ID NO: 19362 - protein, 10 aa, Artificial Sequence
  source: /note="Description of Artificial Sequence: Synthetic peptide"
TPITTTTMVT

SEQ ID NO: 19363 - protein, 9 aa, Artificial Sequence
  source: /note="Description of Artificial Sequence: Synthetic peptide"
TQNPTSTPI

SEQ ID NO: 19364 - protein, 10 aa, Artificial Sequence
  source: /note="Description of Artificial Sequence: Synthetic peptide"
TQNPTSTPIT

SEQ ID NO: 19365 - protein, 9 aa, Artificial Sequence
  source: /note="Description of Artificial Sequence: Synthetic peptide"
TQTPRSTPI

SEQ ID NO: 19366 - protein, 10 aa, Artificial Sequence
  source: /note="Description of Artificial Sequence: Synthetic peptide"
GTQTPRSTPI

SEQ ID NO: 19367 - protein, 10 aa, Artificial Sequence
  source: /note="Description of Artificial Sequence: Synthetic peptide"
TPRSTPITTT

SEQ ID NO: 19368 - protein, 9 aa, Artificial Sequence
  source: /note="Description of Artificial Sequence: Synthetic peptide"
TTTVTPTPI

SEQ ID NO: 19369 - protein, 10 aa, Artificial Sequence
  source: /note="Description of Artificial Sequence: Synthetic peptide"
TTTTVTPTPI

SEQ ID NO: 19370 - protein, 10 aa, Artificial Sequence
  source: /note="Description of Artificial Sequence: Synthetic peptide"
TTVTPTPIPT

SEQ ID NO: 19371 - protein, 9 aa, Artificial Sequence
  source: /note="Description of Artificial Sequence: Synthetic peptide"
TTITTVTPT

SEQ ID NO: 19372 - protein, 9 aa, Artificial Sequence
  source: /note="Description of Artificial Sequence: Synthetic peptide"
TPITTITTV

SEQ ID NO: 19373 - protein, 10 aa, Artificial Sequence
  source: /note="Description of Artificial Sequence: Synthetic peptide"
STPITTITTV

SEQ ID NO: 19374 - protein, 10 aa, Artificial Sequence
  source: /note="Description of Artificial Sequence: Synthetic peptide"
TPITTITTVT

SEQ ID NO: 19375 - protein, 10 aa, Artificial Sequence
  source: /note="Description of Artificial Sequence: Synthetic peptide"
TPTSTPITTI

SEQ ID NO: 19376 - protein, 9 aa, Artificial Sequence
  source: /note="Description of Artificial Sequence: Synthetic peptide"
TPITTTTMV

SEQ ID NO: 19377 - protein, 9 aa, Artificial Sequence
  source: /note="Description of Artificial Sequence: Synthetic peptide"
TTTTMVTPT

SEQ ID NO: 19378 - protein, 9 aa, Artificial Sequence
  source: /note="Description of Artificial Sequence: Synthetic peptide"
TTMVTPTPT

SEQ ID NO: 19379 - protein, 9 aa, Artificial Sequence
  source: /note="Description of Artificial Sequence: Synthetic peptide"
MVTPTPTPT

SEQ ID NO: 19380 - protein, 10 aa, Artificial Sequence
  source: /note="Description of Artificial Sequence: Synthetic peptide"
STPITTTTMV

SEQ ID NO: 19381 - protein, 10 aa, Artificial Sequence
  source: /note="Description of Artificial Sequence: Synthetic peptide"
TSTPITTTTM

SEQ ID NO: 19382 - protein, 10 aa, Artificial Sequence
  source: /note="Description of Artificial Sequence: Synthetic peptide"
TMVTPTPTPT

SEQ ID NO: 19383 - protein, 10 aa, Artificial Sequence
  source: /note="Description of Artificial Sequence: Synthetic peptide"
TPITTTTMVT

SEQ ID NO: 19384 - protein, 10 aa, Artificial Sequence
  source: /note="Description of Artificial Sequence: Synthetic peptide"
STQTPTPTPI

SEQ ID NO: 19385 - protein, 9 aa, Artificial Sequence
  source: /note="Description of Artificial Sequence: Synthetic peptide"
IPISTTTTV

SEQ ID NO: 19386 - protein, 9 aa, Artificial Sequence
  source: /note="Description of Artificial Sequence: Synthetic peptide"
TQTPTPIPI

SEQ ID NO: 19387 - protein, 9 aa, Artificial Sequence
  source: /note="Description of Artificial Sequence: Synthetic peptide"
TPIPISTTT

SEQ ID NO: 19388 - protein, 10 aa, Artificial Sequence
  source: /note="Description of Artificial Sequence: Synthetic peptide"
TPIPISTTTT

SEQ ID NO: 19389 - protein, 10 aa, Artificial Sequence
  source: /note="Description of Artificial Sequence: Synthetic peptide"
IPISTTTTVT

SEQ ID NO: 19390 - protein, 9 aa, Artificial Sequence
  source: /note="Description of Artificial Sequence: Synthetic peptide"
KTSVFIGLH

SEQ ID NO: 19391 - protein, 9 aa, Artificial Sequence
  source: /note="Description of Artificial Sequence: Synthetic peptide"
FIGLHQDYK

SEQ ID NO: 19392 - protein, 9 aa, Artificial Sequence
  source: /note="Description of Artificial Sequence: Synthetic peptide"
VFIGLHQDY

SEQ ID NO: 19393 - protein, 9 aa, Artificial Sequence
  source: /note="Description of Artificial Sequence: Synthetic peptide"
RKTSVFIGL

SEQ ID NO: 19394 - protein, 10 aa, Artificial Sequence
  source: /note="Description of Artificial Sequence: Synthetic peptide"
GLHQDYKGRV

SEQ ID NO: 19395 - protein, 10 aa, Artificial Sequence
  source: /note="Description of Artificial Sequence: Synthetic peptide"
VFIGLHQDYK

SEQ ID NO: 19396 - protein, 10 aa, Artificial Sequence
  source: /note="Description of Artificial Sequence: Synthetic peptide"
SVFIGLHQDY

SEQ ID NO: 19397 - protein, 9 aa, Artificial Sequence
  source: /note="Description of Artificial Sequence: Synthetic peptide"
FIRRHQDYK

SEQ ID NO: 19398 - protein, 9 aa, Artificial Sequence
  source: /note="Description of Artificial Sequence: Synthetic peptide"
KTSVFIRRH

SEQ ID NO: 19399 - protein, 9 aa, Artificial Sequence
  source: /note="Description of Artificial Sequence: Synthetic peptide"
VFIRRHQDY

SEQ ID NO: 19400 - protein, 10 aa, Artificial Sequence
  source: /note="Description of Artificial Sequence: Synthetic peptide"
VFIRRHQDYK

SEQ ID NO: 19401 - protein, 10 aa, Artificial Sequence
  source: /note="Description of Artificial Sequence: Synthetic peptide"
SVFIRRHQDY

SEQ ID NO: 19402 - protein, 9 aa, Artificial Sequence
  source: /note="Description of Artificial Sequence: Synthetic peptide"
CTDGHFCLH

SEQ ID NO: 19403 - protein, 9 aa, Artificial Sequence
  source: /note="Description of Artificial Sequence: Synthetic peptide"
YLSNPITPS

SEQ ID NO: 19404 - protein, 9 aa, Artificial Sequence
  source: /note="Description of Artificial Sequence: Synthetic peptide"
YIPTFTHFL

SEQ ID NO: 19405 - protein, 9 aa, Artificial Sequence
  source: /note="Description of Artificial Sequence: Synthetic peptide"
FLHLFGDSK

SEQ ID NO: 19406 - protein, 9 aa, Artificial Sequence
  source: /note="Description of Artificial Sequence: Synthetic peptide"
CLHPLNANR

SEQ ID NO: 19407 - protein, 9 aa, Artificial Sequence
  source: /note="Description of Artificial Sequence: Synthetic peptide"
TYREQSLLF

SEQ ID NO: 19408 - protein, 9 aa, Artificial Sequence
  source: /note="Description of Artificial Sequence: Synthetic peptide"
SRSTFLHLF

SEQ ID NO: 19409 - protein, 9 aa, Artificial Sequence
  source: /note="Description of Artificial Sequence: Synthetic peptide"
KYSHSHHPY

SEQ ID NO: 19410 - protein, 9 aa, Artificial Sequence
  source: /note="Description of Artificial Sequence: Synthetic peptide"
SQNLYIPTF

SEQ ID NO: 19411 - protein, 9 aa, Artificial Sequence
  source: /note="Description of Artificial Sequence: Synthetic peptide"
LYIPTFTHF

SEQ ID NO: 19412 - protein, 9 aa, Artificial Sequence
  source: /note="Description of Artificial Sequence: Synthetic peptide"
SSRPTTTLH

SEQ ID NO: 19413 - protein, 9 aa, Artificial Sequence
  source: /note="Description of Artificial Sequence: Synthetic peptide"
TSHSRSTFL

SEQ ID NO: 19414 - protein, 9 aa, Artificial Sequence
  source: /note="Description of Artificial Sequence: Synthetic peptide"
HSRSTFLHL

SEQ ID NO: 19415 - protein, 9 aa, Artificial Sequence
  source: /note="Description of Artificial Sequence: Synthetic peptide"
RSTFLHLFG

SEQ ID NO: 19416 - protein, 9 aa, Artificial Sequence
  source: /note="Description of Artificial Sequence: Synthetic peptide"
RVHPHSANN

SEQ ID NO: 19417 - protein, 9 aa, Artificial Sequence
  source: /note="Description of Artificial Sequence: Synthetic peptide"
TLHHTLPTY

SEQ ID NO: 19418 - protein, 9 aa, Artificial Sequence
  source: /note="Description of Artificial Sequence: Synthetic peptide"
LHLFGDSKY

SEQ ID NO: 19419 - protein, 9 aa, Artificial Sequence
  source: /note="Description of Artificial Sequence: Synthetic peptide"
LIKHSQNLY

SEQ ID NO: 19420 - protein, 9 aa, Artificial Sequence
  source: /note="Description of Artificial Sequence: Synthetic peptide"
FTHFLHTPC

SEQ ID NO: 19421 - protein, 9 aa, Artificial Sequence
  source: /note="Description of Artificial Sequence: Synthetic peptide"
LPTYREQSL

SEQ ID NO: 19422 - protein, 9 aa, Artificial Sequence
  source: /note="Description of Artificial Sequence: Synthetic peptide"
HPHSANNDA

SEQ ID NO: 19423 - protein, 9 aa, Artificial Sequence
  source: /note="Description of Artificial Sequence: Synthetic peptide"
ELIKHSQNL

SEQ ID NO: 19424 - protein, 9 aa, Artificial Sequence
  source: /note="Description of Artificial Sequence: Synthetic peptide"
HTSHSRSTF

SEQ ID NO: 19425 - protein, 9 aa, Artificial Sequence
  source: /note="Description of Artificial Sequence: Synthetic peptide"
TSSRPTTTL

SEQ ID NO: 19426 - protein, 9 aa, Artificial Sequence
  source: /note="Description of Artificial Sequence: Synthetic peptide"
HRSHDGNIL

SEQ ID NO: 19427 - protein, 9 aa, Artificial Sequence
  source: /note="Description of Artificial Sequence: Synthetic peptide"
GNILQDHHY

SEQ ID NO: 19428 - protein, 9 aa, Artificial Sequence
  source: /note="Description of Artificial Sequence: Synthetic peptide"
HHYLSNPIT

SEQ ID NO: 19429 - protein, 9 aa, Artificial Sequence
  source: /note="Description of Artificial Sequence: Synthetic peptide"
SKYSHSHHP

SEQ ID NO: 19430 - protein, 9 aa, Artificial Sequence
  source: /note="Description of Artificial Sequence: Synthetic peptide"
AQGHRVHPH

SEQ ID NO: 19431 - protein, 9 aa, Artificial Sequence
  source: /note="Description of Artificial Sequence: Synthetic peptide"
IKHSQNLYI

SEQ ID NO: 19432 - protein, 9 aa, Artificial Sequence
  source: /note="Description of Artificial Sequence: Synthetic peptide"
HPYPCTDGH

SEQ ID NO: 19433 - protein, 9 aa, Artificial Sequence
  source: /note="Description of Artificial Sequence: Synthetic peptide"
IPTFTHFLH

SEQ ID NO: 19434 - protein, 10 aa, Artificial Sequence
  source: /note="Description of Artificial Sequence: Synthetic peptide"
TTLHHTLPTY

SEQ ID NO: 19435 - protein, 10 aa, Artificial Sequence
  source: /note="Description of Artificial Sequence: Synthetic peptide"
STDNAQGHRV

SEQ ID NO: 19436 - protein, 10 aa, Artificial Sequence
  source: /note="Description of Artificial Sequence: Synthetic peptide"
LIKHSQNLYI

SEQ ID NO: 19437 - protein, 10 aa, Artificial Sequence
  source: /note="Description of Artificial Sequence: Synthetic peptide"
TLHHTLPTYR

SEQ ID NO: 19438 - protein, 10 aa, Artificial Sequence
  source: /note="Description of Artificial Sequence: Synthetic peptide"
TSHSRSTFLH

SEQ ID NO: 19439 - protein, 10 aa, Artificial Sequence
  source: /note="Description of Artificial Sequence: Synthetic peptide"
TFLHLFGDSK

SEQ ID NO: 19440 - protein, 10 aa, Artificial Sequence
  source: /note="Description of Artificial Sequence: Synthetic peptide"
PTYREQSLLF

SEQ ID NO: 19441 - protein, 10 aa, Artificial Sequence
  source: /note="Description of Artificial Sequence: Synthetic peptide"
HSRSTFLHLF

SEQ ID NO: 19442 - protein, 10 aa, Artificial Sequence
  source: /note="Description of Artificial Sequence: Synthetic peptide"
HSQNLYIPTF

SEQ ID NO: 19443 - protein, 10 aa, Artificial Sequence
  source: /note="Description of Artificial Sequence: Synthetic peptide"
NLYIPTFTHF

SEQ ID NO: 19444 - protein, 10 aa, Artificial Sequence
  source: /note="Description of Artificial Sequence: Synthetic peptide"
LYIPTFTHFL

SEQ ID NO: 19445 - protein, 10 aa, Artificial Sequence
  source: /note="Description of Artificial Sequence: Synthetic peptide"
ATSSRPTTTL

SEQ ID NO: 19446 - protein, 10 aa, Artificial Sequence
  source: /note="Description of Artificial Sequence: Synthetic peptide"
SSRPTTTLHH

SEQ ID NO: 19447 - protein, 10 aa, Artificial Sequence
  source: /note="Description of Artificial Sequence: Synthetic peptide"
HTSHSRSTFL

SEQ ID NO: 19448 - protein, 10 aa, Artificial Sequence
  source: /note="Description of Artificial Sequence: Synthetic peptide"
RVHPHSANND

SEQ ID NO: 19449 - protein, 10 aa, Artificial Sequence
  source: /note="Description of Artificial Sequence: Synthetic peptide"
HQRDQPSPEL

SEQ ID NO: 19450 - protein, 10 aa, Artificial Sequence
  source: /note="Description of Artificial Sequence: Synthetic peptide"
FLHLFGDSKY

SEQ ID NO: 19451 - protein, 10 aa, Artificial Sequence
  source: /note="Description of Artificial Sequence: Synthetic peptide"
SKYSHSHHPY

SEQ ID NO: 19452 - protein, 10 aa, Artificial Sequence
  source: /note="Description of Artificial Sequence: Synthetic peptide"
ELIKHSQNLY

SEQ ID NO: 19453 - protein, 10 aa, Artificial Sequence
  source: /note="Description of Artificial Sequence: Synthetic peptide"
RPTTTLHHTL

SEQ ID NO: 19454 - protein, 10 aa, Artificial Sequence
  source: /note="Description of Artificial Sequence: Synthetic peptide"
LPTYREQSLL

SEQ ID NO: 19455 - protein, 10 aa, Artificial Sequence
  source: /note="Description of Artificial Sequence: Synthetic peptide"
HPYPCTDGHF

SEQ ID NO: 19456 - protein, 10 aa, Artificial Sequence
  source: /note="Description of Artificial Sequence: Synthetic peptide"
EQSLLFHRSH

SEQ ID NO: 19457 - protein, 10 aa, Artificial Sequence
  source: /note="Description of Artificial Sequence: Synthetic peptide"
FHRSHDGNIL

SEQ ID NO: 19458 - protein, 10 aa, Artificial Sequence
  source: /note="Description of Artificial Sequence: Synthetic peptide"
SHSRSTFLHL

SEQ ID NO: 19459 - protein, 10 aa, Artificial Sequence
  source: /note="Description of Artificial Sequence: Synthetic peptide"
HLFGDSKYSH

SEQ ID NO: 19460 - protein, 10 aa, Artificial Sequence
  source: /note="Description of Artificial Sequence: Synthetic peptide"
YSHSHHPYPC

SEQ ID NO: 19461 - protein, 10 aa, Artificial Sequence
  source: /note="Description of Artificial Sequence: Synthetic peptide"
KHSQNLYIPT

SEQ ID NO: 19462 - protein, 10 aa, Artificial Sequence
  source: /note="Description of Artificial Sequence: Synthetic peptide"
SQNLYIPTFT

SEQ ID NO: 19463 - protein, 10 aa, Artificial Sequence
  source: /note="Description of Artificial Sequence: Synthetic peptide"
YPCTDGHFCL

SEQ ID NO: 19464 - protein, 10 aa, Artificial Sequence
  source: /note="Description of Artificial Sequence: Synthetic peptide"
REQSLLFHRS

SEQ ID NO: 19465 - protein, 10 aa, Artificial Sequence
  source: /note="Description of Artificial Sequence: Synthetic peptide"
QDHHYLSNPI

SEQ ID NO: 19466 - protein, 10 aa, Artificial Sequence
  source: /note="Description of Artificial Sequence: Synthetic peptide"
IPTFTHFLHT

SEQ ID NO: 19467 - protein, 9 aa, Artificial Sequence
  source: /note="Description of Artificial Sequence: Synthetic peptide"
SHFSSTGPM

SEQ ID NO: 19468 - protein, 10 aa, Artificial Sequence
  source: /note="Description of Artificial Sequence: Synthetic peptide"
SSHFSSTGPM

SEQ ID NO: 19469 - protein, 10 aa, Artificial Sequence
  source: /note="Description of Artificial Sequence: Synthetic peptide"
HSPPTGSSHF

SEQ ID NO: 19470 - protein, 10 aa, Artificial Sequence
  source: /note="Description of Artificial Sequence: Synthetic peptide"
SHFSSTGPMT

SEQ ID NO: 19471 - protein, 9 aa, Artificial Sequence
  source: /note="Description of Artificial Sequence: Synthetic peptide"
TPSQPQTTL

SEQ ID NO: 19472 - protein, 9 aa, Artificial Sequence
  source: /note="Description of Artificial Sequence: Synthetic peptide"
SQPQTTLPT

SEQ ID NO: 19473 - protein, 10 aa, Artificial Sequence
  source: /note="Description of Artificial Sequence: Synthetic peptide"
SQPQTTLPTH

SEQ ID NO: 19474 - protein, 10 aa, Artificial Sequence
  source: /note="Description of Artificial Sequence: Synthetic peptide"
QPQTTLPTHV

SEQ ID NO: 19475 - protein, 9 aa, Artificial Sequence
  source: /note="Description of Artificial Sequence: Synthetic peptide"
STTNQLSSF

SEQ ID NO: 19476 - protein, 9 aa, Artificial Sequence
  source: /note="Description of Artificial Sequence: Synthetic peptide"
NQLSSFSPS

SEQ ID NO: 19477 - protein, 10 aa, Artificial Sequence
  source: /note="Description of Artificial Sequence: Synthetic peptide"
VSTTNQLSSF

SEQ ID NO: 19478 - protein, 10 aa, Artificial Sequence
  source: /note="Description of Artificial Sequence: Synthetic peptide"
NQLSSFSPSP

SEQ ID NO: 19479 - protein, 9 aa, Artificial Sequence
  source: /note="Description of Artificial Sequence: Synthetic peptide"
APTHQTTTL

SEQ ID NO: 19480 - protein, 9 aa, Artificial Sequence
  source: /note="Description of Artificial Sequence: Synthetic peptide"
HQTTTLVTT

SEQ ID NO: 19481 - protein, 10 aa, Artificial Sequence
  source: /note="Description of Artificial Sequence: Synthetic peptide"
LVTTQTTTTK

SEQ ID NO: 19482 - protein, 10 aa, Artificial Sequence
  source: /note="Description of Artificial Sequence: Synthetic peptide"
APTHQTTTLV

SEQ ID NO: 19483 - protein, 10 aa, Artificial Sequence
  source: /note="Description of Artificial Sequence: Synthetic peptide"
HQTTTLVTTQ

SEQ ID NO: 19484 - protein, 9 aa, Artificial Sequence
  source: /note="Description of Artificial Sequence: Synthetic peptide"
RAWAPAPPT

SEQ ID NO: 19485 - protein, 9 aa, Artificial Sequence
  source: /note="Description of Artificial Sequence: Synthetic peptide"
APAPPTRCV

SEQ ID NO: 19486 - protein, 9 aa, Artificial Sequence
  source: /note="Description of Artificial Sequence: Synthetic peptide"
SELPPGRAW

SEQ ID NO: 19487 - protein, 10 aa, Artificial Sequence
  source: /note="Description of Artificial Sequence: Synthetic peptide"
RAWAPAPPTR

SEQ ID NO: 19488 - protein, 10 aa, Artificial Sequence
  source: /note="Description of Artificial Sequence: Synthetic peptide"
VVWSELPPGR

SEQ ID NO: 19489 - protein, 10 aa, Artificial Sequence
  source: /note="Description of Artificial Sequence: Synthetic peptide"
WAPAPPTRCV

SEQ ID NO: 19490 - protein, 10 aa, Artificial Sequence
  source: /note="Description of Artificial Sequence: Synthetic peptide"
LPPGRAWAPA

SEQ ID NO: 19491 - protein, 10 aa, Artificial Sequence
  source: /note="Description of Artificial Sequence: Synthetic peptide"
APAPPTRCVW

SEQ ID NO: 19492 - protein, 10 aa, Artificial Sequence
  source: /note="Description of Artificial Sequence: Synthetic peptide"
SELPPGRAWA

SEQ ID NO: 19493 - protein, 9 aa, Artificial Sequence
  source: /note="Description of Artificial Sequence: Synthetic peptide"
WSISLNMTY

SEQ ID NO: 19494 - protein, 9 aa, Artificial Sequence
  source: /note="Description of Artificial Sequence: Synthetic peptide"
MTYEHGNMV

SEQ ID NO: 19495 - protein, 9 aa, Artificial Sequence
  source: /note="Description of Artificial Sequence: Synthetic peptide"
NMTYEHGNM

SEQ ID NO: 19496 - protein, 9 aa, Artificial Sequence
  source: /note="Description of Artificial Sequence: Synthetic peptide"
YEHGNMVNL

SEQ ID NO: 19497 - protein, 10 aa, Artificial Sequence
  source: /note="Description of Artificial Sequence: Synthetic peptide"
NMTYEHGNMV

SEQ ID NO: 19498 - protein, 10 aa, Artificial Sequence
  source: /note="Description of Artificial Sequence: Synthetic peptide"
TYEHGNMVNL

SEQ ID NO: 19499 - protein, 10 aa, Artificial Sequence
  source: /note="Description of Artificial Sequence: Synthetic peptide"
QWSISLNMTY

SEQ ID NO: 19500 - protein, 10 aa, Artificial Sequence
  source: /note="Description of Artificial Sequence: Synthetic peptide"
LNMTYEHGNM

SEQ ID NO: 19501 - protein, 10 aa, Artificial Sequence
  source: /note="Description of Artificial Sequence: Synthetic peptide"
YEHGNMVNLV

SEQ ID NO: 19502 - protein, 9 aa, Artificial Sequence
  source: /note="Description of Artificial Sequence: Synthetic peptide"
VILRKNGAR

SEQ ID NO: 19503 - protein, 10 aa, Artificial Sequence
  source: /note="Description of Artificial Sequence: Synthetic peptide"
ILRKNGARPA

SEQ ID NO: 19504 - protein, 10 aa, Artificial Sequence
  source: /note="Description of Artificial Sequence: Synthetic peptide"
LVILRKNGAR

SEQ ID NO: 19505 - protein, 9 aa, Artificial Sequence
  source: /note="Description of Artificial Sequence: Synthetic peptide"
PEAVHITSV

SEQ ID NO: 19506 - protein, 10 aa, Artificial Sequence
  source: /note="Description of Artificial Sequence: Synthetic peptide"
VPDPPEAVHI

SEQ ID NO: 19507 - protein, 9 aa, Artificial Sequence
  source: /note="Description of Artificial Sequence: Synthetic peptide"
TVVVVSDDY

SEQ ID NO: 19508 - protein, 9 aa, Artificial Sequence
  source: /note="Description of Artificial Sequence: Synthetic peptide"
RPRGGCRRT

SEQ ID NO: 19509 - protein, 10 aa, Artificial Sequence
  source: /note="Description of Artificial Sequence: Synthetic peptide"
RTVVVVSDDY

SEQ ID NO: 19510 - protein, 10 aa, Artificial Sequence
  source: /note="Description of Artificial Sequence: Synthetic peptide"
TVVVVSDDYL

SEQ ID NO: 19511 - protein, 10 aa, Artificial Sequence
  source: /note="Description of Artificial Sequence: Synthetic peptide"
RPRGGCRRTV

SEQ ID NO: 19512 - protein, 9 aa, Artificial Sequence
  source: /note="Description of Artificial Sequence: Synthetic peptide"
YLQNKECDF

SEQ ID NO: 19513 - protein, 10 aa, Artificial Sequence
  source: /note="Description of Artificial Sequence: Synthetic peptide"
VVSDDYLQNK

SEQ ID NO: 19514 - protein, 10 aa, Artificial Sequence
  source: /note="Description of Artificial Sequence: Synthetic peptide"
NKECDFQTKF

SEQ ID NO: 19515 - protein, 9 aa, Artificial Sequence
  source: /note="Description of Artificial Sequence: Synthetic peptide"
HQKRPIPIK

SEQ ID NO: 19516 - protein, 9 aa, Artificial Sequence
  source: /note="Description of Artificial Sequence: Synthetic peptide"
RPIPIKYKA

SEQ ID NO: 19517 - protein, 9 aa, Artificial Sequence
  source: /note="Description of Artificial Sequence: Synthetic peptide"
QKRPIPIKY

SEQ ID NO: 19518 - protein, 10 aa, Artificial Sequence
  source: /note="Description of Artificial Sequence: Synthetic peptide"
AHQKRPIPIK

SEQ ID NO: 19519 - protein, 10 aa, Artificial Sequence
  source: /note="Description of Artificial Sequence: Synthetic peptide"
QKRPIPIKYK

SEQ ID NO: 19520 - protein, 10 aa, Artificial Sequence
  source: /note="Description of Artificial Sequence: Synthetic peptide"
HQKRPIPIKY

SEQ ID NO: 19521 - protein, 10 aa, Artificial Sequence
  source: /note="Description of Artificial Sequence: Synthetic peptide"
SPGAHQKRPI

SEQ ID NO: 19522 - protein, 10 aa, Artificial Sequence
  source: /note="Description of Artificial Sequence: Synthetic peptide"
RPIPIKYKAM

SEQ ID NO: 19523 - protein, 9 aa, Artificial Sequence
  source: /note="Description of Artificial Sequence: Synthetic peptide"
ETPQLPRGL

SEQ ID NO: 19524 - protein, 10 aa, Artificial Sequence
  source: /note="Description of Artificial Sequence: Synthetic peptide"
RSHDGETPQL

SEQ ID NO: 19525 - protein, 10 aa, Artificial Sequence
  source: /note="Description of Artificial Sequence: Synthetic peptide"
GETPQLPRGL

SEQ ID NO: 19526 - protein, 9 aa, Artificial Sequence
  source: /note="Description of Artificial Sequence: Synthetic peptide"
ALGGGAWEL

SEQ ID NO: 19527 - protein, 9 aa, Artificial Sequence
  source: /note="Description of Artificial Sequence: Synthetic peptide"
SLVEDVLCA

SEQ ID NO: 19528 - protein, 9 aa, Artificial Sequence
  source: /note="Description of Artificial Sequence: Synthetic peptide"
GLARWGPLC

SEQ ID NO: 19529 - protein, 9 aa, Artificial Sequence
  source: /note="Description of Artificial Sequence: Synthetic peptide"
LVEDVLCAK

SEQ ID NO: 19530 - protein, 9 aa, Artificial Sequence
  source: /note="Description of Artificial Sequence: Synthetic peptide"
KWFICPASF

SEQ ID NO: 19531 - protein, 9 aa, Artificial Sequence
  source: /note="Description of Artificial Sequence: Synthetic peptide"
SSSSSSSLV

SEQ ID NO: 19532 - protein, 9 aa, Artificial Sequence
  source: /note="Description of Artificial Sequence: Synthetic peptide"
CAKWFICPA

SEQ ID NO: 19533 - protein, 9 aa, Artificial Sequence
  source: /note="Description of Artificial Sequence: Synthetic peptide"
DVLCAKWFI

SEQ ID NO: 19534 - protein, 9 aa, Artificial Sequence
  source: /note="Description of Artificial Sequence: Synthetic peptide"
HPQCQVLLL

SEQ ID NO: 19535 - protein, 9 aa, Artificial Sequence
  source: /note="Description of Artificial Sequence: Synthetic peptide"
VEALGGGAW

SEQ ID NO: 19536 - protein, 9 aa, Artificial Sequence
  source: /note="Description of Artificial Sequence: Synthetic peptide"
WELGGLARW

SEQ ID NO: 19537 - protein, 9 aa, Artificial Sequence
  source: /note="Description of Artificial Sequence: Synthetic peptide"
CQVLLLSSS

SEQ ID NO: 19538 - protein, 9 aa, Artificial Sequence
  source: /note="Description of Artificial Sequence: Synthetic peptide"
SFNPQNDSM

SEQ ID NO: 19539 - protein, 10 aa, Artificial Sequence
  source: /note="Description of Artificial Sequence: Synthetic peptide"
SLVEDVLCAK

SEQ ID NO: 19540 - protein, 10 aa, Artificial Sequence
  source: /note="Description of Artificial Sequence: Synthetic peptide"
SSSSSSSSLV

SEQ ID NO: 19541 - protein, 10 aa, Artificial Sequence
  source: /note="Description of Artificial Sequence: Synthetic peptide"
SFNPQNDSMR

SEQ ID NO: 19542 - protein, 10 aa, Artificial Sequence
  source: /note="Description of Artificial Sequence: Synthetic peptide"
VTVEALGGGA

SEQ ID NO: 19543 - protein, 10 aa, Artificial Sequence
  source: /note="Description of Artificial Sequence: Synthetic peptide"
EALGGGAWEL

SEQ ID NO: 19544 - protein, 10 aa, Artificial Sequence
  source: /note="Description of Artificial Sequence: Synthetic peptide"
LARWGPLCTH

SEQ ID NO: 19545 - protein, 10 aa, Artificial Sequence
  source: /note="Description of Artificial Sequence: Synthetic peptide"
CQVLLLSSST

SEQ ID NO: 19546 - protein, 10 aa, Artificial Sequence
  source: /note="Description of Artificial Sequence: Synthetic peptide"
AKWFICPASF

SEQ ID NO: 19547 - protein, 10 aa, Artificial Sequence
  source: /note="Description of Artificial Sequence: Synthetic peptide"
ASFNPQNDSM

SEQ ID NO: 19548 - protein, 10 aa, Artificial Sequence
  source: /note="Description of Artificial Sequence: Synthetic peptide"
WELGGLARWG

SEQ ID NO: 19549 - protein, 9 aa, Artificial Sequence
  source: /note="Description of Artificial Sequence: Synthetic peptide"
LLLHHHLLL

SEQ ID NO: 19550 - protein, 9 aa, Artificial Sequence
  source: /note="Description of Artificial Sequence: Synthetic peptide"
LLHHHLLLL

SEQ ID NO: 19551 - protein, 9 aa, Artificial Sequence
  source: /note="Description of Artificial Sequence: Synthetic peptide"
SPLLLHHHL

SEQ ID NO: 19552 - protein, 9 aa, Artificial Sequence
  source: /note="Description of Artificial Sequence: Synthetic peptide"
LHHHLLLLL

SEQ ID NO: 19553 - protein, 10 aa, Artificial Sequence
  source: /note="Description of Artificial Sequence: Synthetic peptide"
LLLHHHLLLL

SEQ ID NO: 19554 - protein, 10 aa, Artificial Sequence
  source: /note="Description of Artificial Sequence: Synthetic peptide"
LLHHHLLLLL

SEQ ID NO: 19555 - protein, 10 aa, Artificial Sequence
  source: /note="Description of Artificial Sequence: Synthetic peptide"
SPLLLHHHLL

SEQ ID NO: 19556 - protein, 10 aa, Artificial Sequence
  source: /note="Description of Artificial Sequence: Synthetic peptide"
LHHHLLLLLI

SEQ ID NO: 19557 - protein, 10 aa, Artificial Sequence
  source: /note="Description of Artificial Sequence: Synthetic peptide"
HHHLLLLLII

SEQ ID NO: 19558 - protein, 9 aa, Artificial Sequence
  source: /note="Description of Artificial Sequence: Synthetic peptide"
KAKRKPRRG

SEQ ID NO: 19559 - protein, 9 aa, Artificial Sequence
  source: /note="Description of Artificial Sequence: Synthetic peptide"
RPAGPDRRA

SEQ ID NO: 19560 - protein, 10 aa, Artificial Sequence
  source: /note="Description of Artificial Sequence: Synthetic peptide"
KPRRGDDRPA

SEQ ID NO: 19561 - protein, 10 aa, Artificial Sequence
  source: /note="Description of Artificial Sequence: Synthetic peptide"
RPAGPDRRAA

SEQ ID NO: 19562 - protein, 9 aa, Artificial Sequence
  source: /note="Description of Artificial Sequence: Synthetic peptide"
KLEDKILVM

SEQ ID NO: 19563 - protein, 10 aa, Artificial Sequence
  source: /note="Description of Artificial Sequence: Synthetic peptide"
KKLEDKILVM

SEQ ID NO: 19564 - protein, 9 aa, Artificial Sequence
  source: /note="Description of Artificial Sequence: Synthetic peptide"
VEHKKKLEA

SEQ ID NO: 19565 - protein, 10 aa, Artificial Sequence
  source: /note="Description of Artificial Sequence: Synthetic peptide"
KQEVEHKKKL

SEQ ID NO: 19566 - protein, 9 aa, Artificial Sequence
  source: /note="Description of Artificial Sequence: Synthetic peptide"
LISTNPFNF

SEQ ID NO: 19567 - protein, 9 aa, Artificial Sequence
  source: /note="Description of Artificial Sequence: Synthetic peptide"
STNPFNFPF

SEQ ID NO: 19568 - protein, 9 aa, Artificial Sequence
  source: /note="Description of Artificial Sequence: Synthetic peptide"
TNPFNFPFV

SEQ ID NO: 19569 - protein, 9 aa, Artificial Sequence
  source: /note="Description of Artificial Sequence: Synthetic peptide"
NPFNFPFVS

SEQ ID NO: 19570 - protein, 10 aa, Artificial Sequence
  source: /note="Description of Artificial Sequence: Synthetic peptide"
STNPFNFPFV

SEQ ID NO: 19571 - protein, 10 aa, Artificial Sequence
  source: /note="Description of Artificial Sequence: Synthetic peptide"
LLISTNPFNF

SEQ ID NO: 19572 - protein, 10 aa, Artificial Sequence
  source: /note="Description of Artificial Sequence: Synthetic peptide"
ISTNPFNFPF

SEQ ID NO: 19573 - protein, 9 aa, Artificial Sequence
  source: /note="Description of Artificial Sequence: Synthetic peptide"
KLAQLIMRT

SEQ ID NO: 19574 - protein, 9 aa, Artificial Sequence
  source: /note="Description of Artificial Sequence: Synthetic peptide"
QLIMRTQAI

SEQ ID NO: 19575 - protein, 9 aa, Artificial Sequence
  source: /note="Description of Artificial Sequence: Synthetic peptide"
IMRTQAICR

SEQ ID NO: 19576 - protein, 9 aa, Artificial Sequence
  source: /note="Description of Artificial Sequence: Synthetic peptide"
AQLIMRTQA

SEQ ID NO: 19577 - protein, 9 aa, Artificial Sequence
  source: /note="Description of Artificial Sequence: Synthetic peptide"
DEKLAQLIM

SEQ ID NO: 19578 - protein, 10 aa, Artificial Sequence
  source: /note="Description of Artificial Sequence: Synthetic peptide"
LIMRTQAICR

SEQ ID NO: 19579 - protein, 10 aa, Artificial Sequence
  source: /note="Description of Artificial Sequence: Synthetic peptide"
IMRTQAICRG

SEQ ID NO: 19580 - protein, 10 aa, Artificial Sequence
  source: /note="Description of Artificial Sequence: Synthetic peptide"
RDEKLAQLIM

SEQ ID NO: 19581 - protein, 10 aa, Artificial Sequence
  source: /note="Description of Artificial Sequence: Synthetic peptide"
AQLIMRTQAI

SEQ ID NO: 19582 - protein, 10 aa, Artificial Sequence
  source: /note="Description of Artificial Sequence: Synthetic peptide"
MRTQAICRGF

SEQ ID NO: 19583 - protein, 9 aa, Artificial Sequence
  source: /note="Description of Artificial Sequence: Synthetic peptide"
LLKSAEMEK

SEQ ID NO: 19584 - protein, 9 aa, Artificial Sequence
  source: /note="Description of Artificial Sequence: Synthetic peptide"
KPLLKSAEM

SEQ ID NO: 19585 - protein, 9 aa, Artificial Sequence
  source: /note="Description of Artificial Sequence: Synthetic peptide"
KSAEMEKEM

SEQ ID NO: 19586 - protein, 9 aa, Artificial Sequence
  source: /note="Description of Artificial Sequence: Synthetic peptide"
AEMEKEMAT

SEQ ID NO: 19587 - protein, 9 aa, Artificial Sequence
  source: /note="Description of Artificial Sequence: Synthetic peptide"
EMEKEMATM

SEQ ID NO: 19588 - protein, 10 aa, Artificial Sequence
  source: /note="Description of Artificial Sequence: Synthetic peptide"
IKPLLKSAEM

SEQ ID NO: 19589 - protein, 10 aa, Artificial Sequence
  source: /note="Description of Artificial Sequence: Synthetic peptide"
LKSAEMEKEM

SEQ ID NO: 19590 - protein, 10 aa, Artificial Sequence
  source: /note="Description of Artificial Sequence: Synthetic peptide"
AEMEKEMATM

SEQ ID NO: 19591 - protein, 9 aa, Artificial Sequence
  source: /note="Description of Artificial Sequence: Synthetic peptide"
TYEESLEHL

SEQ ID NO: 19592 - protein, 9 aa, Artificial Sequence
  source: /note="Description of Artificial Sequence: Synthetic peptide"
ELFKLKNTY

SEQ ID NO: 19593 - protein, 9 aa, Artificial Sequence
  source: /note="Description of Artificial Sequence: Synthetic peptide"
LKNTYEESL

SEQ ID NO: 19594 - protein, 10 aa, Artificial Sequence
  source: /note="Description of Artificial Sequence: Synthetic peptide"
KLKNTYEESL

SEQ ID NO: 19595 - protein, 10 aa, Artificial Sequence
  source: /note="Description of Artificial Sequence: Synthetic peptide"
NTYEESLEHL

SEQ ID NO: 19596 - protein, 10 aa, Artificial Sequence
  source: /note="Description of Artificial Sequence: Synthetic peptide"
TELFKLKNTY

SEQ ID NO: 19597 - protein, 9 aa, Artificial Sequence
  source: /note="Description of Artificial Sequence: Synthetic peptide"
AELEELCAV

SEQ ID NO: 19598 - protein, 9 aa, Artificial Sequence
  source: /note="Description of Artificial Sequence: Synthetic peptide"
EELCAVVEQ

SEQ ID NO: 19599 - protein, 10 aa, Artificial Sequence
  source: /note="Description of Artificial Sequence: Synthetic peptide"
AELEELCAVV

SEQ ID NO: 19600 - protein, 10 aa, Artificial Sequence
  source: /note="Description of Artificial Sequence: Synthetic peptide"
EELCAVVEQT

SEQ ID NO: 19601 - protein, 9 aa, Artificial Sequence
  source: /note="Description of Artificial Sequence: Synthetic peptide"
KLVQIITRT

SEQ ID NO: 19602 - protein, 9 aa, Artificial Sequence
  source: /note="Description of Artificial Sequence: Synthetic peptide"
VQIITRTQA

SEQ ID NO: 19603 - protein, 9 aa, Artificial Sequence
  source: /note="Description of Artificial Sequence: Synthetic peptide"
DEKLVQIIT

SEQ ID NO: 19604 - protein, 10 aa, Artificial Sequence
  source: /note="Description of Artificial Sequence: Synthetic peptide"
VQIITRTQAV

SEQ ID NO: 19605 - protein, 10 aa, Artificial Sequence
  source: /note="Description of Artificial Sequence: Synthetic peptide"
EMRDEKLVQI

SEQ ID NO: 19606 - protein, 9 aa, Artificial Sequence
  source: /note="Description of Artificial Sequence: Synthetic peptide"
LQETNQQTL

SEQ ID NO: 19607 - protein, 10 aa, Artificial Sequence
  source: /note="Description of Artificial Sequence: Synthetic peptide"
ALQETNQQTL

SEQ ID NO: 19608 - protein, 9 aa, Artificial Sequence
  source: /note="Description of Artificial Sequence: Synthetic peptide"
KLQMDLERA

SEQ ID NO: 19609 - protein, 9 aa, Artificial Sequence
  source: /note="Description of Artificial Sequence: Synthetic peptide"
LEQEKKLQM

SEQ ID NO: 19610 - protein, 9 aa, Artificial Sequence
  source: /note="Description of Artificial Sequence: Synthetic peptide"
LQMDLERAK

SEQ ID NO: 19611 - protein, 9 aa, Artificial Sequence
  source: /note="Description of Artificial Sequence: Synthetic peptide"
QEKKLQMDL

SEQ ID NO: 19612 - protein, 10 aa, Artificial Sequence
  source: /note="Description of Artificial Sequence: Synthetic peptide"
KLQMDLERAK

SEQ ID NO: 19613 - protein, 9 aa, Artificial Sequence
  source: /note="Description of Artificial Sequence: Synthetic peptide"
KIKELQACI

SEQ ID NO: 19614 - protein, 9 aa, Artificial Sequence
  source: /note="Description of Artificial Sequence: Synthetic peptide"
KKIKELQAC

SEQ ID NO: 19615 - protein, 10 aa, Artificial Sequence
  source: /note="Description of Artificial Sequence: Synthetic peptide"
KKIKELQACI

SEQ ID NO: 19616 - protein, 10 aa, Artificial Sequence
  source: /note="Description of Artificial Sequence: Synthetic peptide"
KELQACIEEL

SEQ ID NO: 19617 - protein, 9 aa, Artificial Sequence
  source: /note="Description of Artificial Sequence: Synthetic peptide"
GVWSTLLSL

SEQ ID NO: 19618 - protein, 9 aa, Artificial Sequence
  source: /note="Description of Artificial Sequence: Synthetic peptide"
RLMGTMWRA

SEQ ID NO: 19619 - protein, 9 aa, Artificial Sequence
  source: /note="Description of Artificial Sequence: Synthetic peptide"
TMWRASPGM

SEQ ID NO: 19620 - protein, 9 aa, Artificial Sequence
  source: /note="Description of Artificial Sequence: Synthetic peptide"
VWSTLLSLV

SEQ ID NO: 19621 - protein, 9 aa, Artificial Sequence
  source: /note="Description of Artificial Sequence: Synthetic peptide"
VQAPRTWPW

SEQ ID NO: 19622 - protein, 9 aa, Artificial Sequence
  source: /note="Description of Artificial Sequence: Synthetic peptide"
WWRLMGTMW

SEQ ID NO: 19623 - protein, 9 aa, Artificial Sequence
  source: /note="Description of Artificial Sequence: Synthetic peptide"
RARPVGVWS

SEQ ID NO: 19624 - protein, 9 aa, Artificial Sequence
  source: /note="Description of Artificial Sequence: Synthetic peptide"
GTMWRASPG

SEQ ID NO: 19625 - protein, 9 aa, Artificial Sequence
  source: /note="Description of Artificial Sequence: Synthetic peptide"
MWRASPGMR

SEQ ID NO: 19626 - protein, 9 aa, Artificial Sequence
  source: /note="Description of Artificial Sequence: Synthetic peptide"
QPCWIGAPR

SEQ ID NO: 19627 - protein, 9 aa, Artificial Sequence
  source: /note="Description of Artificial Sequence: Synthetic peptide"
CWIGAPRAR

SEQ ID NO: 19628 - protein, 9 aa, Artificial Sequence
  source: /note="Description of Artificial Sequence: Synthetic peptide"
LLSLVQAPR

SEQ ID NO: 19629 - protein, 9 aa, Artificial Sequence
  source: /note="Description of Artificial Sequence: Synthetic peptide"
ETLASPCGA

SEQ ID NO: 19630 - protein, 9 aa, Artificial Sequence
  source: /note="Description of Artificial Sequence: Synthetic peptide"
CPHLPSGSW

SEQ ID NO: 19631 - protein, 9 aa, Artificial Sequence
  source: /note="Description of Artificial Sequence: Synthetic peptide"
APRARPVGV

SEQ ID NO: 19632 - protein, 9 aa, Artificial Sequence
  source: /note="Description of Artificial Sequence: Synthetic peptide"
RPVGVWSTL

SEQ ID NO: 19633 - protein, 9 aa, Artificial Sequence
  source: /note="Description of Artificial Sequence: Synthetic peptide"
SLVQAPRTW

SEQ ID NO: 19634 - protein, 9 aa, Artificial Sequence
  source: /note="Description of Artificial Sequence: Synthetic peptide"
QEIDWWRLM

SEQ ID NO: 19635 - protein, 9 aa, Artificial Sequence
  source: /note="Description of Artificial Sequence: Synthetic peptide"
WRASPGMRL

SEQ ID NO: 19636 - protein, 9 aa, Artificial Sequence
  source: /note="Description of Artificial Sequence: Synthetic peptide"
RASPGMRLW

SEQ ID NO: 19637 - protein, 9 aa, Artificial Sequence
  source: /note="Description of Artificial Sequence: Synthetic peptide"
LPPWCPCPH

SEQ ID NO: 19638 - protein, 9 aa, Artificial Sequence
  source: /note="Description of Artificial Sequence: Synthetic peptide"
SPCGAQPCW

SEQ ID NO: 19639 - protein, 9 aa, Artificial Sequence
  source: /note="Description of Artificial Sequence: Synthetic peptide"
WPWGWCQEI

SEQ ID NO: 19640 - protein, 10 aa, Artificial Sequence
  source: /note="Description of Artificial Sequence: Synthetic peptide"
GVWSTLLSLV

SEQ ID NO: 19641 - protein, 10 aa, Artificial Sequence
  source: /note="Description of Artificial Sequence: Synthetic peptide"
WIGAPRARPV

SEQ ID NO: 19642 - protein, 10 aa, Artificial Sequence
  source: /note="Description of Artificial Sequence: Synthetic peptide"
TMWRASPGMR

SEQ ID NO: 19643 - protein, 10 aa, Artificial Sequence
  source: /note="Description of Artificial Sequence: Synthetic peptide"
TLLSLVQAPR

SEQ ID NO: 19644 - protein, 10 aa, Artificial Sequence
  source: /note="Description of Artificial Sequence: Synthetic peptide"
RASPGMRLWR

SEQ ID NO: 19645 - protein, 10 aa, Artificial Sequence
  source: /note="Description of Artificial Sequence: Synthetic peptide"
TWPWGWCQEI

SEQ ID NO: 19646 - protein, 10 aa, Artificial Sequence
  source: /note="Description of Artificial Sequence: Synthetic peptide"
DWWRLMGTMW

SEQ ID NO: 19647 - protein, 10 aa, Artificial Sequence
  source: /note="Description of Artificial Sequence: Synthetic peptide"
MWRASPGMRL

SEQ ID NO: 19648 - protein, 10 aa, Artificial Sequence
  source: /note="Description of Artificial Sequence: Synthetic peptide"
RARPVGVWST

SEQ ID NO: 19649 - protein, 10 aa, Artificial Sequence
  source: /note="Description of Artificial Sequence: Synthetic peptide"
GTMWRASPGM

SEQ ID NO: 19650 - protein, 10 aa, Artificial Sequence
  source: /note="Description of Artificial Sequence: Synthetic peptide"
WWRLMGTMWR

SEQ ID NO: 19651 - protein, 10 aa, Artificial Sequence
  source: /note="Description of Artificial Sequence: Synthetic peptide"
FPVDLRLPPW

SEQ ID NO: 19652 - protein, 10 aa, Artificial Sequence
  source: /note="Description of Artificial Sequence: Synthetic peptide"
APRARPVGVW

SEQ ID NO: 19653 - protein, 10 aa, Artificial Sequence
  source: /note="Description of Artificial Sequence: Synthetic peptide"
RPVGVWSTLL

SEQ ID NO: 19654 - protein, 10 aa, Artificial Sequence
  source: /note="Description of Artificial Sequence: Synthetic peptide"
GSWSCNDGPL

SEQ ID NO: 19655 - protein, 10 aa, Artificial Sequence
  source: /note="Description of Artificial Sequence: Synthetic peptide"
VGVWSTLLSL

SEQ ID NO: 19656 - protein, 10 aa, Artificial Sequence
  source: /note="Description of Artificial Sequence: Synthetic peptide"
LSLVQAPRTW

SEQ ID NO: 19657 - protein, 10 aa, Artificial Sequence
  source: /note="Description of Artificial Sequence: Synthetic peptide"
LVQAPRTWPW

SEQ ID NO: 19658 - protein, 10 aa, Artificial Sequence
  source: /note="Description of Artificial Sequence: Synthetic peptide"
CQEIDWWRLM

SEQ ID NO: 19659 - protein, 10 aa, Artificial Sequence
  source: /note="Description of Artificial Sequence: Synthetic peptide"
IDWWRLMGTM

SEQ ID NO: 19660 - protein, 10 aa, Artificial Sequence
  source: /note="Description of Artificial Sequence: Synthetic peptide"
WRASPGMRLW

SEQ ID NO: 19661 - protein, 10 aa, Artificial Sequence
  source: /note="Description of Artificial Sequence: Synthetic peptide"
LETLASPCGA

SEQ ID NO: 19662 - protein, 10 aa, Artificial Sequence
  source: /note="Description of Artificial Sequence: Synthetic peptide"
LPPWCPCPHL

SEQ ID NO: 19663 - protein, 9 aa, Artificial Sequence
  source: /note="Description of Artificial Sequence: Synthetic peptide"
GAGKMEASK

SEQ ID NO: 19664 - protein, 9 aa, Artificial Sequence
  source: /note="Description of Artificial Sequence: Synthetic peptide"
AGKMEASKY

SEQ ID NO: 19665 - protein, 9 aa, Artificial Sequence
  source: /note="Description of Artificial Sequence: Synthetic peptide"
GKMEASKYI

SEQ ID NO: 19666 - protein, 9 aa, Artificial Sequence
  source: /note="Description of Artificial Sequence: Synthetic peptide"
KMEASKYIM

SEQ ID NO: 19667 - protein, 10 aa, Artificial Sequence
  source: /note="Description of Artificial Sequence: Synthetic peptide"
SGAGKMEASK

SEQ ID NO: 19668 - protein, 10 aa, Artificial Sequence
  source: /note="Description of Artificial Sequence: Synthetic peptide"
GAGKMEASKY

SEQ ID NO: 19669 - protein, 10 aa, Artificial Sequence
  source: /note="Description of Artificial Sequence: Synthetic peptide"
MEASKYIMQY

SEQ ID NO: 19670 - protein, 10 aa, Artificial Sequence
  source: /note="Description of Artificial Sequence: Synthetic peptide"
GKMEASKYIM

SEQ ID NO: 19671 - protein, 10 aa, Artificial Sequence
  source: /note="Description of Artificial Sequence: Synthetic peptide"
GESGAGKMEA

SEQ ID NO: 19672 - protein, 9 aa, Artificial Sequence
  source: /note="Description of Artificial Sequence: Synthetic peptide"
KSSINDAAK

SEQ ID NO: 19673 - protein, 9 aa, Artificial Sequence
  source: /note="Description of Artificial Sequence: Synthetic peptide"
SINDAAKFR

SEQ ID NO: 19674 - protein, 9 aa, Artificial Sequence
  source: /note="Description of Artificial Sequence: Synthetic peptide"
KFRVVADAM

SEQ ID NO: 19675 - protein, 9 aa, Artificial Sequence
  source: /note="Description of Artificial Sequence: Synthetic peptide"
DAAKFRVVA

SEQ ID NO: 19676 - protein, 9 aa, Artificial Sequence
  source: /note="Description of Artificial Sequence: Synthetic peptide"
SSINDAAKF

SEQ ID NO: 19677 - protein, 10 aa, Artificial Sequence
  source: /note="Description of Artificial Sequence: Synthetic peptide"
SINDAAKFRV

SEQ ID NO: 19678 - protein, 10 aa, Artificial Sequence
  source: /note="Description of Artificial Sequence: Synthetic peptide"
SSINDAAKFR

SEQ ID NO: 19679 - protein, 10 aa, Artificial Sequence
  source: /note="Description of Artificial Sequence: Synthetic peptide"
AAKFRVVADA

SEQ ID NO: 19680 - protein, 10 aa, Artificial Sequence
  source: /note="Description of Artificial Sequence: Synthetic peptide"
KFRVVADAMK

SEQ ID NO: 19681 - protein, 10 aa, Artificial Sequence
  source: /note="Description of Artificial Sequence: Synthetic peptide"
KSSINDAAKF

SEQ ID NO: 19682 - protein, 10 aa, Artificial Sequence
  source: /note="Description of Artificial Sequence: Synthetic peptide"
AKFRVVADAM

SEQ ID NO: 19683 - protein, 9 aa, Artificial Sequence
  source: /note="Description of Artificial Sequence: Synthetic peptide"
AIGEKHFHI

SEQ ID NO: 19684 - protein, 9 aa, Artificial Sequence
  source: /note="Description of Artificial Sequence: Synthetic peptide"
IGEKHFHIF

SEQ ID NO: 19685 - protein, 9 aa, Artificial Sequence
  source: /note="Description of Artificial Sequence: Synthetic peptide"
KHFHIFYYI

SEQ ID NO: 19686 - protein, 9 aa, Artificial Sequence
  source: /note="Description of Artificial Sequence: Synthetic peptide"
HFHIFYYIY

SEQ ID NO: 19687 - protein, 9 aa, Artificial Sequence
  source: /note="Description of Artificial Sequence: Synthetic peptide"
HQAIGEKHF

SEQ ID NO: 19688 - protein, 9 aa, Artificial Sequence
  source: /note="Description of Artificial Sequence: Synthetic peptide"
GEKHFHIFY

SEQ ID NO: 19689 - protein, 9 aa, Artificial Sequence
  source: /note="Description of Artificial Sequence: Synthetic peptide"
EKHFHIFYY

SEQ ID NO: 19690 - protein, 10 aa, Artificial Sequence
  source: /note="Description of Artificial Sequence: Synthetic peptide"
HFHIFYYIYA

SEQ ID NO: 19691 - protein, 10 aa, Artificial Sequence
  source: /note="Description of Artificial Sequence: Synthetic peptide"
IGEKHFHIFY

SEQ ID NO: 19692 - protein, 10 aa, Artificial Sequence
  source: /note="Description of Artificial Sequence: Synthetic peptide"
GEKHFHIFYY

SEQ ID NO: 19693 - protein, 10 aa, Artificial Sequence
  source: /note="Description of Artificial Sequence: Synthetic peptide"
KHFHIFYYIY

SEQ ID NO: 19694 - protein, 10 aa, Artificial Sequence
  source: /note="Description of Artificial Sequence: Synthetic peptide"
QAIGEKHFHI

SEQ ID NO: 19695 - protein, 10 aa, Artificial Sequence
  source: /note="Description of Artificial Sequence: Synthetic peptide"
IHQAIGEKHF

SEQ ID NO: 19696 - protein, 10 aa, Artificial Sequence
  source: /note="Description of Artificial Sequence: Synthetic peptide"
AIGEKHFHIF

SEQ ID NO: 19697 - protein, 9 aa, Artificial Sequence
  source: /note="Description of Artificial Sequence: Synthetic peptide"
AIGEKSFHI

SEQ ID NO: 19698 - protein, 9 aa, Artificial Sequence
  source: /note="Description of Artificial Sequence: Synthetic peptide"
KSFHIFYYI

SEQ ID NO: 19699 - protein, 9 aa, Artificial Sequence
  source: /note="Description of Artificial Sequence: Synthetic peptide"
GEKSFHIFY

SEQ ID NO: 19700 - protein, 9 aa, Artificial Sequence
  source: /note="Description of Artificial Sequence: Synthetic peptide"
SFHIFYYIY

SEQ ID NO: 19701 - protein, 9 aa, Artificial Sequence
  source: /note="Description of Artificial Sequence: Synthetic peptide"
HQAIGEKSF

SEQ ID NO: 19702 - protein, 9 aa, Artificial Sequence
  source: /note="Description of Artificial Sequence: Synthetic peptide"
IGEKSFHIF

SEQ ID NO: 19703 - protein, 9 aa, Artificial Sequence
  source: /note="Description of Artificial Sequence: Synthetic peptide"
EKSFHIFYY

SEQ ID NO: 19704 - protein, 10 aa, Artificial Sequence
  source: /note="Description of Artificial Sequence: Synthetic peptide"
KSFHIFYYIY

SEQ ID NO: 19705 - protein, 10 aa, Artificial Sequence
  source: /note="Description of Artificial Sequence: Synthetic peptide"
SFHIFYYIYA

SEQ ID NO: 19706 - protein, 10 aa, Artificial Sequence
  source: /note="Description of Artificial Sequence: Synthetic peptide"
IGEKSFHIFY

SEQ ID NO: 19707 - protein, 10 aa, Artificial Sequence
  source: /note="Description of Artificial Sequence: Synthetic peptide"
GEKSFHIFYY

SEQ ID NO: 19708 - protein, 10 aa, Artificial Sequence
  source: /note="Description of Artificial Sequence: Synthetic peptide"
QAIGEKSFHI

SEQ ID NO: 19709 - protein, 10 aa, Artificial Sequence
  source: /note="Description of Artificial Sequence: Synthetic peptide"
IHQAIGEKSF

SEQ ID NO: 19710 - protein, 10 aa, Artificial Sequence
  source: /note="Description of Artificial Sequence: Synthetic peptide"
HQAIGEKSFH

SEQ ID NO: 19711 - protein, 10 aa, Artificial Sequence
  source: /note="Description of Artificial Sequence: Synthetic peptide"
AIGEKSFHIF

SEQ ID NO: 19712 - protein, 9 aa, Artificial Sequence
  source: /note="Description of Artificial Sequence: Synthetic peptide"
VINARNALV

SEQ ID NO: 19713 - protein, 9 aa, Artificial Sequence
  source: /note="Description of Artificial Sequence: Synthetic peptide"
LVKHIYAQL

SEQ ID NO: 19714 - protein, 9 aa, Artificial Sequence
  source: /note="Description of Artificial Sequence: Synthetic peptide"
RNALVKHIY

SEQ ID NO: 19715 - protein, 9 aa, Artificial Sequence
  source: /note="Description of Artificial Sequence: Synthetic peptide"
VKHIYAQLF

SEQ ID NO: 19716 - protein, 10 aa, Artificial Sequence
  source: /note="Description of Artificial Sequence: Synthetic peptide"
ALVKHIYAQL

SEQ ID NO: 19717 - protein, 10 aa, Artificial Sequence
  source: /note="Description of Artificial Sequence: Synthetic peptide"
QVINARNALV

SEQ ID NO: 19718 - protein, 10 aa, Artificial Sequence
  source: /note="Description of Artificial Sequence: Synthetic peptide"
VINARNALVK

SEQ ID NO: 19719 - protein, 10 aa, Artificial Sequence
  source: /note="Description of Artificial Sequence: Synthetic peptide"
RNALVKHIYA

SEQ ID NO: 19720 - protein, 10 aa, Artificial Sequence
  source: /note="Description of Artificial Sequence: Synthetic peptide"
LVKHIYAQLF

SEQ ID NO: 19721 - protein, 10 aa, Artificial Sequence
  source: /note="Description of Artificial Sequence: Synthetic peptide"
ARNALVKHIY

SEQ ID NO: 19722 - protein, 9 aa, Artificial Sequence
  source: /note="Description of Artificial Sequence: Synthetic peptide"
FFNRYLVLV

SEQ ID NO: 19723 - protein, 9 aa, Artificial Sequence
  source: /note="Description of Artificial Sequence: Synthetic peptide"
DFFNRYLVL

SEQ ID NO: 19724 - protein, 9 aa, Artificial Sequence
  source: /note="Description of Artificial Sequence: Synthetic peptide"
FNRYLVLVK

SEQ ID NO: 19725 - protein, 9 aa, Artificial Sequence
  source: /note="Description of Artificial Sequence: Synthetic peptide"
HDFFNRYLV

SEQ ID NO: 19726 - protein, 10 aa, Artificial Sequence
  source: /note="Description of Artificial Sequence: Synthetic peptide"
AYHDFFNRYL

SEQ ID NO: 19727 - protein, 10 aa, Artificial Sequence
  source: /note="Description of Artificial Sequence: Synthetic peptide"
HDFFNRYLVL

SEQ ID NO: 19728 - protein, 9 aa, Artificial Sequence
  source: /note="Description of Artificial Sequence: Synthetic peptide"
KTAGRGSRK

SEQ ID NO: 19729 - protein, 9 aa, Artificial Sequence
  source: /note="Description of Artificial Sequence: Synthetic peptide"
LQKKKTAGR

SEQ ID NO: 19730 - protein, 9 aa, Artificial Sequence
  source: /note="Description of Artificial Sequence: Synthetic peptide"
GSRKAEAYS

SEQ ID NO: 19731 - protein, 9 aa, Artificial Sequence
  source: /note="Description of Artificial Sequence: Synthetic peptide"
EAYSRRNGK

SEQ ID NO: 19732 - protein, 9 aa, Artificial Sequence
  source: /note="Description of Artificial Sequence: Synthetic peptide"
YSRRNGKGK

SEQ ID NO: 19733 - protein, 9 aa, Artificial Sequence
  source: /note="Description of Artificial Sequence: Synthetic peptide"
RGSRKAEAY

SEQ ID NO: 19734 - protein, 10 aa, Artificial Sequence
  source: /note="Description of Artificial Sequence: Synthetic peptide"
KTAGRGSRKA

SEQ ID NO: 19735 - protein, 10 aa, Artificial Sequence
  source: /note="Description of Artificial Sequence: Synthetic peptide"
GSRKAEAYSR

SEQ ID NO: 19736 - protein, 10 aa, Artificial Sequence
  source: /note="Description of Artificial Sequence: Synthetic peptide"
AYSRRNGKGK

SEQ ID NO: 19737 - protein, 10 aa, Artificial Sequence
  source: /note="Description of Artificial Sequence: Synthetic peptide"
YSRRNGKGKK

SEQ ID NO: 19738 - protein, 9 aa, Artificial Sequence
  source: /note="Description of Artificial Sequence: Synthetic peptide"
FIRPANQYK

SEQ ID NO: 19739 - protein, 10 aa, Artificial Sequence
  source: /note="Description of Artificial Sequence: Synthetic peptide"
IPFIRPANQY

SEQ ID NO: 19740 - protein, 9 aa, Artificial Sequence
  source: /note="Description of Artificial Sequence: Synthetic peptide"
VLLIHHKTK

SEQ ID NO: 19741 - protein, 10 aa, Artificial Sequence
  source: /note="Description of Artificial Sequence: Synthetic peptide"
LLIHHKTKDL

SEQ ID NO: 19742 - protein, 10 aa, Artificial Sequence
  source: /note="Description of Artificial Sequence: Synthetic peptide"
GVLLIHHKTK

SEQ ID NO: 19743 - protein, 10 aa, Artificial Sequence
  source: /note="Description of Artificial Sequence: Synthetic peptide"
RHGVLLIHHK

SEQ ID NO: 19744 - protein, 10 aa, Artificial Sequence
  source: /note="Description of Artificial Sequence: Synthetic peptide"
HKTKDLLTTY

SEQ ID NO: 19745 - protein, 9 aa, Artificial Sequence
  source: /note="Description of Artificial Sequence: Synthetic peptide"
LQNRFKHEK

SEQ ID NO: 19746 - protein, 9 aa, Artificial Sequence
  source: /note="Description of Artificial Sequence: Synthetic peptide"
TLLENLQNR

SEQ ID NO: 19747 - protein, 9 aa, Artificial Sequence
  source: /note="Description of Artificial Sequence: Synthetic peptide"
LLENLQNRF

SEQ ID NO: 19748 - protein, 10 aa, Artificial Sequence
  source: /note="Description of Artificial Sequence: Synthetic peptide"
KTLLENLQNR

SEQ ID NO: 19749 - protein, 10 aa, Artificial Sequence
  source: /note="Description of Artificial Sequence: Synthetic peptide"
TLLENLQNRF

SEQ ID NO: 19750 - protein, 10 aa, Artificial Sequence
  source: /note="Description of Artificial Sequence: Synthetic peptide"
LQNRFKHEKI

SEQ ID NO: 19751 - protein, 9 aa, Artificial Sequence
  source: /note="Description of Artificial Sequence: Synthetic peptide"
SVIDQLSQT

SEQ ID NO: 19752 - protein, 9 aa, Artificial Sequence
  source: /note="Description of Artificial Sequence: Synthetic peptide"
QTHLNTLER

SEQ ID NO: 19753 - protein, 9 aa, Artificial Sequence
  source: /note="Description of Artificial Sequence: Synthetic peptide"
LSQTHLNTL

SEQ ID NO: 19754 - protein, 10 aa, Artificial Sequence
  source: /note="Description of Artificial Sequence: Synthetic peptide"
QLSQTHLNTL

SEQ ID NO: 19755 - protein, 9 aa, Artificial Sequence
  source: /note="Description of Artificial Sequence: Synthetic peptide"
RVLLWPRLA

SEQ ID NO: 19756 - protein, 9 aa, Artificial Sequence
  source: /note="Description of Artificial Sequence: Synthetic peptide"
HRVLLWPRL

SEQ ID NO: 19757 - protein, 9 aa, Artificial Sequence
  source: /note="Description of Artificial Sequence: Synthetic peptide"
HPSPVHVCM

SEQ ID NO: 19758 - protein, 9 aa, Artificial Sequence
  source: /note="Description of Artificial Sequence: Synthetic peptide"
MEESLMSSL

SEQ ID NO: 19759 - protein, 10 aa, Artificial Sequence
  source: /note="Description of Artificial Sequence: Synthetic peptide"
CMEESLMSSL

SEQ ID NO: 19760 - protein, 10 aa, Artificial Sequence
  source: /note="Description of Artificial Sequence: Synthetic peptide"
VHVCMEESLM

SEQ ID NO: 19761 - protein, 9 aa, Artificial Sequence
  source: /note="Description of Artificial Sequence: Synthetic peptide"
GKQGLGPPA

SEQ ID NO: 19762 - protein, 10 aa, Artificial Sequence
  source: /note="Description of Artificial Sequence: Synthetic peptide"
SQQQQQQHRF

SEQ ID NO: 19763 - protein, 9 aa, Artificial Sequence
  source: /note="Description of Artificial Sequence: Synthetic peptide"
GPGAQGASW

SEQ ID NO: 19764 - protein, 10 aa, Artificial Sequence
  source: /note="Description of Artificial Sequence: Synthetic peptide"
SACSEAHQSK

SEQ ID NO: 19765 - protein, 10 aa, Artificial Sequence
  source: /note="Description of Artificial Sequence: Synthetic peptide"
AVRGPGAQGA

SEQ ID NO: 19766 - protein, 9 aa, Artificial Sequence
  source: /note="Description of Artificial Sequence: Synthetic peptide"
AFRQASASS

SEQ ID NO: 19767 - protein, 9 aa, Artificial Sequence
  source: /note="Description of Artificial Sequence: Synthetic peptide"
RESEAFRQA

SEQ ID NO: 19768 - protein, 9 aa, Artificial Sequence
  source: /note="Description of Artificial Sequence: Synthetic peptide"
SEAFRQASA

SEQ ID NO: 19769 - protein, 9 aa, Artificial Sequence
  source: /note="Description of Artificial Sequence: Synthetic peptide"
RQASASSSQ

SEQ ID NO: 19770 - protein, 10 aa, Artificial Sequence
  source: /note="Description of Artificial Sequence: Synthetic peptide"
AFRQASASSS

SEQ ID NO: 19771 - protein, 10 aa, Artificial Sequence
  source: /note="Description of Artificial Sequence: Synthetic peptide"
RESEAFRQAS

SEQ ID NO: 19772 - protein, 10 aa, Artificial Sequence
  source: /note="Description of Artificial Sequence: Synthetic peptide"
RQASASSSQQ

SEQ ID NO: 19773 - protein, 10 aa, Artificial Sequence
  source: /note="Description of Artificial Sequence: Synthetic peptide"
SEAFRQASAS

SEQ ID NO: 19774 - protein, 9 aa, Artificial Sequence
  source: /note="Description of Artificial Sequence: Synthetic peptide"
VSVSDTNGV

SEQ ID NO: 19775 - protein, 9 aa, Artificial Sequence
  source: /note="Description of Artificial Sequence: Synthetic peptide"
DTNGVSSSF

SEQ ID NO: 19776 - protein, 9 aa, Artificial Sequence
  source: /note="Description of Artificial Sequence: Synthetic peptide"
NGVSSSFVL

SEQ ID NO: 19777 - protein, 10 aa, Artificial Sequence
  source: /note="Description of Artificial Sequence: Synthetic peptide"
SVSVSDTNGV

SEQ ID NO: 19778 - protein, 10 aa, Artificial Sequence
  source: /note="Description of Artificial Sequence: Synthetic peptide"
DTNGVSSSFV

SEQ ID NO: 19779 - protein, 10 aa, Artificial Sequence
  source: /note="Description of Artificial Sequence: Synthetic peptide"
SDTNGVSSSF

SEQ ID NO: 19780 - protein, 10 aa, Artificial Sequence
  source: /note="Description of Artificial Sequence: Synthetic peptide"
TTKPTDDTTV

SEQ ID NO: 19781 - protein, 9 aa, Artificial Sequence
  source: /note="Description of Artificial Sequence: Synthetic peptide"
EVVKVTTER

SEQ ID NO: 19782 - protein, 9 aa, Artificial Sequence
  source: /note="Description of Artificial Sequence: Synthetic peptide"
AEEVVKVTT

SEQ ID NO: 19783 - protein, 9 aa, Artificial Sequence
  source: /note="Description of Artificial Sequence: Synthetic peptide"
QERNQQQNM

SEQ ID NO: 19784 - protein, 10 aa, Artificial Sequence
  source: /note="Description of Artificial Sequence: Synthetic peptide"
QQQNMNIRQH

SEQ ID NO: 19785 - protein, 9 aa, Artificial Sequence
  source: /note="Description of Artificial Sequence: Synthetic peptide"
LLGQSCIGV

SEQ ID NO: 19786 - protein, 9 aa, Artificial Sequence
  source: /note="Description of Artificial Sequence: Synthetic peptide"
FDLLGQSCI

SEQ ID NO: 19787 - protein, 10 aa, Artificial Sequence
  source: /note="Description of Artificial Sequence: Synthetic peptide"
LLGQSCIGVK

SEQ ID NO: 19788 - protein, 9 aa, Artificial Sequence
  source: /note="Description of Artificial Sequence: Synthetic peptide"
NQETQGSKL

SEQ ID NO: 19789 - protein, 9 aa, Artificial Sequence
  source: /note="Description of Artificial Sequence: Synthetic peptide"
HEVERHFLR

SEQ ID NO: 19790 - protein, 9 aa, Artificial Sequence
  source: /note="Description of Artificial Sequence: Synthetic peptide"
YLLDQLKDV

SEQ ID NO: 19791 - protein, 9 aa, Artificial Sequence
  source: /note="Description of Artificial Sequence: Synthetic peptide"
RIENSFKYL

SEQ ID NO: 19792 - protein, 9 aa, Artificial Sequence
  source: /note="Description of Artificial Sequence: Synthetic peptide"
IENSFKYLL

SEQ ID NO: 19793 - protein, 10 aa, Artificial Sequence
  source: /note="Description of Artificial Sequence: Synthetic peptide"
KYLLDQLKDV

SEQ ID NO: 19794 - protein, 10 aa, Artificial Sequence
  source: /note="Description of Artificial Sequence: Synthetic peptide"
YLLDQLKDVF

SEQ ID NO: 19795 - protein, 10 aa, Artificial Sequence
  source: /note="Description of Artificial Sequence: Synthetic peptide"
SFKYLLDQLK

SEQ ID NO: 19796 - protein, 10 aa, Artificial Sequence
  source: /note="Description of Artificial Sequence: Synthetic peptide"
QERIENSFKY

SEQ ID NO: 19797 - protein, 10 aa, Artificial Sequence
  source: /note="Description of Artificial Sequence: Synthetic peptide"
NSFKYLLDQL

SEQ ID NO: 19798 - protein, 9 aa, Artificial Sequence
  source: /note="Description of Artificial Sequence: Synthetic peptide"
RLQKAFRDW

SEQ ID NO: 19799 - protein, 9 aa, Artificial Sequence
  source: /note="Description of Artificial Sequence: Synthetic peptide"
HVRRLQKAF

SEQ ID NO: 19800 - protein, 9 aa, Artificial Sequence
  source: /note="Description of Artificial Sequence: Synthetic peptide"
LQKAFRDWV

SEQ ID NO: 19801 - protein, 10 aa, Artificial Sequence
  source: /note="Description of Artificial Sequence: Synthetic peptide"
RLQKAFRDWV

SEQ ID NO: 19802 - protein, 10 aa, Artificial Sequence
  source: /note="Description of Artificial Sequence: Synthetic peptide"
HVRRLQKAFR

SEQ ID NO: 19803 - protein, 10 aa, Artificial Sequence
  source: /note="Description of Artificial Sequence: Synthetic peptide"
LHVRRLQKAF

SEQ ID NO: 19804 - protein, 10 aa, Artificial Sequence
  source: /note="Description of Artificial Sequence: Synthetic peptide"
RRLQKAFRDW

SEQ ID NO: 19805 - protein, 10 aa, Artificial Sequence
  source: /note="Description of Artificial Sequence: Synthetic peptide"
LQKAFRDWVT

SEQ ID NO: 19806 - protein, 9 aa, Artificial Sequence
  source: /note="Description of Artificial Sequence: Synthetic peptide"
RGAGKSEPL

SEQ ID NO: 19807 - protein, 10 aa, Artificial Sequence
  source: /note="Description of Artificial Sequence: Synthetic peptide"
EPLPSCSPSM

SEQ ID NO: 19808 - protein, 10 aa, Artificial Sequence
  source: /note="Description of Artificial Sequence: Synthetic peptide"
FRGAGKSEPL

SEQ ID NO: 19809 - protein, 9 aa, Artificial Sequence
  source: /note="Description of Artificial Sequence: Synthetic peptide"
RVSYTFEFH

SEQ ID NO: 19810 - protein, 9 aa, Artificial Sequence
  source: /note="Description of Artificial Sequence: Synthetic peptide"
PGQRVSYTF

SEQ ID NO: 19811 - protein, 9 aa, Artificial Sequence
  source: /note="Description of Artificial Sequence: Synthetic peptide"
QRVSYTFEF

SEQ ID NO: 19812 - protein, 9 aa, Artificial Sequence
  source: /note="Description of Artificial Sequence: Synthetic peptide"
SKPGQRVSY

SEQ ID NO: 19813 - protein, 10 aa, Artificial Sequence
  source: /note="Description of Artificial Sequence: Synthetic peptide"
RVSYTFEFHF

SEQ ID NO: 19814 - protein, 10 aa, Artificial Sequence
  source: /note="Description of Artificial Sequence: Synthetic peptide"
SLKFSKPGQR

SEQ ID NO: 19815 - protein, 10 aa, Artificial Sequence
  source: /note="Description of Artificial Sequence: Synthetic peptide"
FSKPGQRVSY

SEQ ID NO: 19816 - protein, 10 aa, Artificial Sequence
  source: /note="Description of Artificial Sequence: Synthetic peptide"
KPGQRVSYTF

SEQ ID NO: 19817 - protein, 10 aa, Artificial Sequence
  source: /note="Description of Artificial Sequence: Synthetic peptide"
GQRVSYTFEF

SEQ ID NO: 19818 - protein, 10 aa, Artificial Sequence
  source: /note="Description of Artificial Sequence: Synthetic peptide"
LKFSKPGQRV

SEQ ID NO: 19819 - protein, 9 aa, Artificial Sequence
  source: /note="Description of Artificial Sequence: Synthetic peptide"
VQNESFFNF

SEQ ID NO: 19820 - protein, 9 aa, Artificial Sequence
  source: /note="Description of Artificial Sequence: Synthetic peptide"
KQVQNESFF

SEQ ID NO: 19821 - protein, 9 aa, Artificial Sequence
  source: /note="Description of Artificial Sequence: Synthetic peptide"
TKQVQNESF

SEQ ID NO: 19822 - protein, 10 aa, Artificial Sequence
  source: /note="Description of Artificial Sequence: Synthetic peptide"
QVQNESFFNF

SEQ ID NO: 19823 - protein, 10 aa, Artificial Sequence
  source: /note="Description of Artificial Sequence: Synthetic peptide"
VQNESFFNFF

SEQ ID NO: 19824 - protein, 10 aa, Artificial Sequence
  source: /note="Description of Artificial Sequence: Synthetic peptide"
ITKQVQNESF

SEQ ID NO: 19825 - protein, 10 aa, Artificial Sequence
  source: /note="Description of Artificial Sequence: Synthetic peptide"
TKQVQNESFF

SEQ ID NO: 19826 - protein, 9 aa, Artificial Sequence
  source: /note="Description of Artificial Sequence: Synthetic peptide"
WLHHQFDPK

SEQ ID NO: 19827 - protein, 9 aa, Artificial Sequence
  source: /note="Description of Artificial Sequence: Synthetic peptide"
VPCWLHHQF

SEQ ID NO: 19828 - protein, 9 aa, Artificial Sequence
  source: /note="Description of Artificial Sequence: Synthetic peptide"
HQFDPKASS

SEQ ID NO: 19829 - protein, 10 aa, Artificial Sequence
  source: /note="Description of Artificial Sequence: Synthetic peptide"
WLHHQFDPKA

SEQ ID NO: 19830 - protein, 10 aa, Artificial Sequence
  source: /note="Description of Artificial Sequence: Synthetic peptide"
CWLHHQFDPK

SEQ ID NO: 19831 - protein, 10 aa, Artificial Sequence
  source: /note="Description of Artificial Sequence: Synthetic peptide"
SVPCWLHHQF

SEQ ID NO: 19832 - protein, 10 aa, Artificial Sequence
  source: /note="Description of Artificial Sequence: Synthetic peptide"
QFDPKASSSF

SEQ ID NO: 19833 - protein, 10 aa, Artificial Sequence
  source: /note="Description of Artificial Sequence: Synthetic peptide"
HQFDPKASSS

SEQ ID NO: 19834 - protein, 9 aa, Artificial Sequence
  source: /note="Description of Artificial Sequence: Synthetic peptide"
FTFGRTFRA

SEQ ID NO: 19835 - protein, 9 aa, Artificial Sequence
  source: /note="Description of Artificial Sequence: Synthetic peptide"
FTQVFTFGR

SEQ ID NO: 19836 - protein, 9 aa, Artificial Sequence
  source: /note="Description of Artificial Sequence: Synthetic peptide"
VFTFGRTFR

SEQ ID NO: 19837 - protein, 9 aa, Artificial Sequence
  source: /note="Description of Artificial Sequence: Synthetic peptide"
QVFTFGRTF

SEQ ID NO: 19838 - protein, 10 aa, Artificial Sequence
  source: /note="Description of Artificial Sequence: Synthetic peptide"
QVFTFGRTFR

SEQ ID NO: 19839 - protein, 10 aa, Artificial Sequence
  source: /note="Description of Artificial Sequence: Synthetic peptide"
AFTQVFTFGR

SEQ ID NO: 19840 - protein, 10 aa, Artificial Sequence
  source: /note="Description of Artificial Sequence: Synthetic peptide"
TQVFTFGRTF

SEQ ID NO: 19841 - protein, 9 aa, Artificial Sequence
  source: /note="Description of Artificial Sequence: Synthetic peptide"
AAATPLPLV

SEQ ID NO: 19842 - protein, 9 aa, Artificial Sequence
  source: /note="Description of Artificial Sequence: Synthetic peptide"
AATPLPLVK

SEQ ID NO: 19843 - protein, 9 aa, Artificial Sequence
  source: /note="Description of Artificial Sequence: Synthetic peptide"
EAAATPLPL

SEQ ID NO: 19844 - protein, 9 aa, Artificial Sequence
  source: /note="Description of Artificial Sequence: Synthetic peptide"
TPLPLVKSL

SEQ ID NO: 19845 - protein, 9 aa, Artificial Sequence
  source: /note="Description of Artificial Sequence: Synthetic peptide"
IDEAAATPL

SEQ ID NO: 19846 - protein, 9 aa, Artificial Sequence
  source: /note="Description of Artificial Sequence: Synthetic peptide"
DEAAATPLP

SEQ ID NO: 19847 - protein, 10 aa, Artificial Sequence
  source: /note="Description of Artificial Sequence: Synthetic peptide"
VIDEAAATPL

SEQ ID NO: 19848 - protein, 10 aa, Artificial Sequence
  source: /note="Description of Artificial Sequence: Synthetic peptide"
AAATPLPLVK

SEQ ID NO: 19849 - protein, 10 aa, Artificial Sequence
  source: /note="Description of Artificial Sequence: Synthetic peptide"
EAAATPLPLV

SEQ ID NO: 19850 - protein, 10 aa, Artificial Sequence
  source: /note="Description of Artificial Sequence: Synthetic peptide"
TPLPLVKSLL

SEQ ID NO: 19851 - protein, 10 aa, Artificial Sequence
  source: /note="Description of Artificial Sequence: Synthetic peptide"
DEAAATPLPL

SEQ ID NO: 19852 - protein, 10 aa, Artificial Sequence
  source: /note="Description of Artificial Sequence: Synthetic peptide"
KKGPVSPRNL

SEQ ID NO: 19853 - protein, 10 aa, Artificial Sequence
  source: /note="Description of Artificial Sequence: Synthetic peptide"
KLCPQLAENK

SEQ ID NO: 19854 - protein, 9 aa, Artificial Sequence
  source: /note="Description of Artificial Sequence: Synthetic peptide"
RCYSTPSDI

SEQ ID NO: 19855 - protein, 9 aa, Artificial Sequence
  source: /note="Description of Artificial Sequence: Synthetic peptide"
TPSDILNCL

SEQ ID NO: 19856 - protein, 10 aa, Artificial Sequence
  source: /note="Description of Artificial Sequence: Synthetic peptide"
STPSDILNCL

SEQ ID NO: 19857 - protein, 10 aa, Artificial Sequence
  source: /note="Description of Artificial Sequence: Synthetic peptide"
RCYSTPSDIL

SEQ ID NO: 19858 - protein, 9 aa, Artificial Sequence
  source: /note="Description of Artificial Sequence: Synthetic peptide"
LPEVVEPEV

SEQ ID NO: 19859 - protein, 10 aa, Artificial Sequence
  source: /note="Description of Artificial Sequence: Synthetic peptide"
ELPEVVEPEV

SEQ ID NO: 19860 - protein, 9 aa, Artificial Sequence
  source: /note="Description of Artificial Sequence: Synthetic peptide"
DTLFNCLGL

SEQ ID NO: 19861 - protein, 10 aa, Artificial Sequence
  source: /note="Description of Artificial Sequence: Synthetic peptide"
TLFNCLGLGA

SEQ ID NO: 19862 - protein, 10 aa, Artificial Sequence
  source: /note="Description of Artificial Sequence: Synthetic peptide"
IIKDTLFNCL

SEQ ID NO: 19863 - protein, 10 aa, Artificial Sequence
  source: /note="Description of Artificial Sequence: Synthetic peptide"
KDTLFNCLGL

SEQ ID NO: 19864 - protein, 9 aa, Artificial Sequence
  source: /note="Description of Artificial Sequence: Synthetic peptide"
TLEAITHLL

SEQ ID NO: 19865 - protein, 9 aa, Artificial Sequence
  source: /note="Description of Artificial Sequence: Synthetic peptide"
KNRPTLEAI

SEQ ID NO: 19866 - protein, 9 aa, Artificial Sequence
  source: /note="Description of Artificial Sequence: Synthetic peptide"
LEAITHLLG

SEQ ID NO: 19867 - protein, 10 aa, Artificial Sequence
  source: /note="Description of Artificial Sequence: Synthetic peptide"
HQKNRPTLEA

SEQ ID NO: 19868 - protein, 10 aa, Artificial Sequence
  source: /note="Description of Artificial Sequence: Synthetic peptide"
RPTLEAITHL

SEQ ID NO: 19869 - protein, 10 aa, Artificial Sequence
  source: /note="Description of Artificial Sequence: Synthetic peptide"
INHQKNRPTL

SEQ ID NO: 19870 - protein, 10 aa, Artificial Sequence
  source: /note="Description of Artificial Sequence: Synthetic peptide"
QKNRPTLEAI

SEQ ID NO: 19871 - protein, 10 aa, Artificial Sequence
  source: /note="Description of Artificial Sequence: Synthetic peptide"
LEAITHLLGV

SEQ ID NO: 19872 - protein, 9 aa, Artificial Sequence
  source: /note="Description of Artificial Sequence: Synthetic peptide"
QPPPRSEVL

SEQ ID NO: 19873 - protein, 9 aa, Artificial Sequence
  source: /note="Description of Artificial Sequence: Synthetic peptide"
RSEVLSCPL

SEQ ID NO: 19874 - protein, 10 aa, Artificial Sequence
  source: /note="Description of Artificial Sequence: Synthetic peptide"
EAPASQPPPR

SEQ ID NO: 19875 - protein, 10 aa, Artificial Sequence
  source: /note="Description of Artificial Sequence: Synthetic peptide"
SQPPPRSEVL

SEQ ID NO: 19876 - protein, 9 aa, Artificial Sequence
  source: /note="Description of Artificial Sequence: Synthetic peptide"
KMILTLMYI

SEQ ID NO: 19877 - protein, 9 aa, Artificial Sequence
  source: /note="Description of Artificial Sequence: Synthetic peptide"
MILTLMYIL

SEQ ID NO: 19878 - protein, 9 aa, Artificial Sequence
  source: /note="Description of Artificial Sequence: Synthetic peptide"
YILEKQRLL

SEQ ID NO: 19879 - protein, 9 aa, Artificial Sequence
  source: /note="Description of Artificial Sequence: Synthetic peptide"
ILKLTLKMI

SEQ ID NO: 19880 - protein, 9 aa, Artificial Sequence
  source: /note="Description of Artificial Sequence: Synthetic peptide"
TLKMILTLM

SEQ ID NO: 19881 - protein, 9 aa, Artificial Sequence
  source: /note="Description of Artificial Sequence: Synthetic peptide"
LTLMYILEK

SEQ ID NO: 19882 - protein, 9 aa, Artificial Sequence
  source: /note="Description of Artificial Sequence: Synthetic peptide"
MYILEKQRL

SEQ ID NO: 19883 - protein, 9 aa, Artificial Sequence
  source: /note="Description of Artificial Sequence: Synthetic peptide"
KKSTKKILK

SEQ ID NO: 19884 - protein, 9 aa, Artificial Sequence
  source: /note="Description of Artificial Sequence: Synthetic peptide"
KILKLTLKM

SEQ ID NO: 19885 - protein, 9 aa, Artificial Sequence
  source: /note="Description of Artificial Sequence: Synthetic peptide"
LKMILTLMY

SEQ ID NO: 19886 - protein, 9 aa, Artificial Sequence
  source: /note="Description of Artificial Sequence: Synthetic peptide"
LMYILEKQR

SEQ ID NO: 19887 - protein, 9 aa, Artificial Sequence
  source: /note="Description of Artificial Sequence: Synthetic peptide"
LKLTLKMIL

SEQ ID NO: 19888 - protein, 9 aa, Artificial Sequence
  source: /note="Description of Artificial Sequence: Synthetic peptide"
LTLKMILTL

SEQ ID NO: 19889 - protein, 9 aa, Artificial Sequence
  source: /note="Description of Artificial Sequence: Synthetic peptide"
LEKQRLLLF

SEQ ID NO: 19890 - protein, 10 aa, Artificial Sequence
  source: /note="Description of Artificial Sequence: Synthetic peptide"
KLTLKMILTL

SEQ ID NO: 19891 - protein, 10 aa, Artificial Sequence
  source: /note="Description of Artificial Sequence: Synthetic peptide"
KMILTLMYIL

SEQ ID NO: 19892 - protein, 10 aa, Artificial Sequence
  source: /note="Description of Artificial Sequence: Synthetic peptide"
YILEKQRLLL

SEQ ID NO: 19893 - protein, 10 aa, Artificial Sequence
  source: /note="Description of Artificial Sequence: Synthetic peptide"
ILTLMYILEK

SEQ ID NO: 19894 - protein, 10 aa, Artificial Sequence
  source: /note="Description of Artificial Sequence: Synthetic peptide"
MYILEKQRLL

SEQ ID NO: 19895 - protein, 10 aa, Artificial Sequence
  source: /note="Description of Artificial Sequence: Synthetic peptide"
ILEKQRLLLF

SEQ ID NO: 19896 - protein, 10 aa, Artificial Sequence
  source: /note="Description of Artificial Sequence: Synthetic peptide"
KKKSTKKILK

SEQ ID NO: 19897 - protein, 10 aa, Artificial Sequence
  source: /note="Description of Artificial Sequence: Synthetic peptide"
STKKILKLTL

SEQ ID NO: 19898 - protein, 10 aa, Artificial Sequence
  source: /note="Description of Artificial Sequence: Synthetic peptide"
TLKMILTLMY

SEQ ID NO: 19899 - protein, 10 aa, Artificial Sequence
  source: /note="Description of Artificial Sequence: Synthetic peptide"
TLMYILEKQR

SEQ ID NO: 19900 - protein, 10 aa, Artificial Sequence
  source: /note="Description of Artificial Sequence: Synthetic peptide"
ILKLTLKMIL

SEQ ID NO: 19901 - protein, 10 aa, Artificial Sequence
  source: /note="Description of Artificial Sequence: Synthetic peptide"
KKSTKKILKL

SEQ ID NO: 19902 - protein, 10 aa, Artificial Sequence
  source: /note="Description of Artificial Sequence: Synthetic peptide"
KKILKLTLKM

SEQ ID NO: 19903 - protein, 10 aa, Artificial Sequence
  source: /note="Description of Artificial Sequence: Synthetic peptide"
LTLKMILTLM

SEQ ID NO: 19904 - protein, 10 aa, Artificial Sequence
  source: /note="Description of Artificial Sequence: Synthetic peptide"
LKMILTLMYI

SEQ ID NO: 19905 - protein, 10 aa, Artificial Sequence
  source: /note="Description of Artificial Sequence: Synthetic peptide"
LMYILEKQRL

SEQ ID NO: 19906 - protein, 9 aa, Artificial Sequence
  source: /note="Description of Artificial Sequence: Synthetic peptide"
QTAAAAAAA

SEQ ID NO: 19907 - protein, 9 aa, Artificial Sequence
  source: /note="Description of Artificial Sequence: Synthetic peptide"
MQQQQQQTA

SEQ ID NO: 19908 - protein, 9 aa, Artificial Sequence
  source: /note="Description of Artificial Sequence: Synthetic peptide"
QQQQQQTAA

SEQ ID NO: 19909 - protein, 9 aa, Artificial Sequence
  source: /note="Description of Artificial Sequence: Synthetic peptide"
QQQQQTAAA

SEQ ID NO: 19910 - protein, 9 aa, Artificial Sequence
  source: /note="Description of Artificial Sequence: Synthetic peptide"
QQQQTAAAA

SEQ ID NO: 19911 - protein, 9 aa, Artificial Sequence
  source: /note="Description of Artificial Sequence: Synthetic peptide"
QQQTAAAAA

SEQ ID NO: 19912 - protein, 9 aa, Artificial Sequence
  source: /note="Description of Artificial Sequence: Synthetic peptide"
QQTAAAAAA

SEQ ID NO: 19913 - protein, 10 aa, Artificial Sequence
  source: /note="Description of Artificial Sequence: Synthetic peptide"
MMMQQQQQQT

SEQ ID NO: 19914 - protein, 10 aa, Artificial Sequence
  source: /note="Description of Artificial Sequence: Synthetic peptide"
MMQQQQQQTA

SEQ ID NO: 19915 - protein, 10 aa, Artificial Sequence
  source: /note="Description of Artificial Sequence: Synthetic peptide"
ATATATATAA

SEQ ID NO: 19916 - protein, 10 aa, Artificial Sequence
  source: /note="Description of Artificial Sequence: Synthetic peptide"
ATATATAATA

SEQ ID NO: 19917 - protein, 10 aa, Artificial Sequence
  source: /note="Description of Artificial Sequence: Synthetic peptide"
QTAAAAAAAA

SEQ ID NO: 19918 - protein, 10 aa, Artificial Sequence
  source: /note="Description of Artificial Sequence: Synthetic peptide"
TAATAANPGL

SEQ ID NO: 19919 - protein, 10 aa, Artificial Sequence
  source: /note="Description of Artificial Sequence: Synthetic peptide"
MQQQQQQTAA

SEQ ID NO: 19920 - protein, 10 aa, Artificial Sequence
  source: /note="Description of Artificial Sequence: Synthetic peptide"
QQQQQQTAAA

SEQ ID NO: 19921 - protein, 10 aa, Artificial Sequence
  source: /note="Description of Artificial Sequence: Synthetic peptide"
QQQQQTAAAA

SEQ ID NO: 19922 - protein, 10 aa, Artificial Sequence
  source: /note="Description of Artificial Sequence: Synthetic peptide"
QQQQTAAAAA

SEQ ID NO: 19923 - protein, 10 aa, Artificial Sequence
  source: /note="Description of Artificial Sequence: Synthetic peptide"
QQQTAAAAAA

SEQ ID NO: 19924 - protein, 10 aa, Artificial Sequence
  source: /note="Description of Artificial Sequence: Synthetic peptide"
QQTAAAAAAA

SEQ ID NO: 19925 - protein, 9 aa, Artificial Sequence
  source: /note="Description of Artificial Sequence: Synthetic peptide"
LLQKKAQEV

SEQ ID NO: 19926 - protein, 9 aa, Artificial Sequence
  source: /note="Description of Artificial Sequence: Synthetic peptide"
LQKKAQEVL

SEQ ID NO: 19927 - protein, 10 aa, Artificial Sequence
  source: /note="Description of Artificial Sequence: Synthetic peptide"
WLLQKKAQEV

SEQ ID NO: 19928 - protein, 10 aa, Artificial Sequence
  source: /note="Description of Artificial Sequence: Synthetic peptide"
LLQKKAQEVL

SEQ ID NO: 19929 - protein, 10 aa, Artificial Sequence
  source: /note="Description of Artificial Sequence: Synthetic peptide"
LQKKAQEVLL

SEQ ID NO: 19930 - protein, 9 aa, Artificial Sequence
  source: /note="Description of Artificial Sequence: Synthetic peptide"
SSVSDKLKK

SEQ ID NO: 19931 - protein, 10 aa, Artificial Sequence
  source: /note="Description of Artificial Sequence: Synthetic peptide"
GSSVSDKLKK

SEQ ID NO: 19932 - protein, 9 aa, Artificial Sequence
  source: /note="Description of Artificial Sequence: Synthetic peptide"
YQSHLPTHL

SEQ ID NO: 19933 - protein, 9 aa, Artificial Sequence
  source: /note="Description of Artificial Sequence: Synthetic peptide"
EVYQSHLPT

SEQ ID NO: 19934 - protein, 10 aa, Artificial Sequence
  source: /note="Description of Artificial Sequence: Synthetic peptide"
VYQSHLPTHL

SEQ ID NO: 19935 - protein, 10 aa, Artificial Sequence
  source: /note="Description of Artificial Sequence: Synthetic peptide"
EVYQSHLPTH

SEQ ID NO: 19936 - protein, 10 aa, Artificial Sequence
  source: /note="Description of Artificial Sequence: Synthetic peptide"
GEVYQSHLPT

SEQ ID NO: 19937 - protein, 9 aa, Artificial Sequence
  source: /note="Description of Artificial Sequence: Synthetic peptide"
LLWMGLAFL

SEQ ID NO: 19938 - protein, 9 aa, Artificial Sequence
  source: /note="Description of Artificial Sequence: Synthetic peptide"
WMGLAFLVL

SEQ ID NO: 19939 - protein, 9 aa, Artificial Sequence
  source: /note="Description of Artificial Sequence: Synthetic peptide"
AQNLLWMGL

SEQ ID NO: 19940 - protein, 9 aa, Artificial Sequence
  source: /note="Description of Artificial Sequence: Synthetic peptide"
LWMGLAFLV

SEQ ID NO: 19941 - protein, 9 aa, Artificial Sequence
  source: /note="Description of Artificial Sequence: Synthetic peptide"
HTAQNLLWM

SEQ ID NO: 19942 - protein, 9 aa, Artificial Sequence
  source: /note="Description of Artificial Sequence: Synthetic peptide"
NLLWMGLAF

SEQ ID NO: 19943 - protein, 10 aa, Artificial Sequence
  source: /note="Description of Artificial Sequence: Synthetic peptide"
NLLWMGLAFL

SEQ ID NO: 19944 - protein, 10 aa, Artificial Sequence
  source: /note="Description of Artificial Sequence: Synthetic peptide"
LLWMGLAFLV

SEQ ID NO: 19945 - protein, 10 aa, Artificial Sequence
  source: /note="Description of Artificial Sequence: Synthetic peptide"
WMGLAFLVLV

SEQ ID NO: 19946 - protein, 10 aa, Artificial Sequence
  source: /note="Description of Artificial Sequence: Synthetic peptide"
AQNLLWMGLA

SEQ ID NO: 19947 - protein, 10 aa, Artificial Sequence
  source: /note="Description of Artificial Sequence: Synthetic peptide"
LWMGLAFLVL

SEQ ID NO: 19948 - protein, 10 aa, Artificial Sequence
  source: /note="Description of Artificial Sequence: Synthetic peptide"
QNLLWMGLAF

SEQ ID NO: 19949 - protein, 9 aa, Artificial Sequence
  source: /note="Description of Artificial Sequence: Synthetic peptide"
GIYPVHVQL

SEQ ID NO: 19950 - protein, 9 aa, Artificial Sequence
  source: /note="Description of Artificial Sequence: Synthetic peptide"
AVAPHHSGI

SEQ ID NO: 19951 - protein, 9 aa, Artificial Sequence
  source: /note="Description of Artificial Sequence: Synthetic peptide"
IYPVHVQLY

SEQ ID NO: 19952 - protein, 9 aa, Artificial Sequence
  source: /note="Description of Artificial Sequence: Synthetic peptide"
VAPHHSGIY

SEQ ID NO: 19953 - protein, 10 aa, Artificial Sequence
  source: /note="Description of Artificial Sequence: Synthetic peptide"
GIYPVHVQLY

SEQ ID NO: 19954 - protein, 10 aa, Artificial Sequence
  source: /note="Description of Artificial Sequence: Synthetic peptide"
AVAPHHSGIY

SEQ ID NO: 19955 - protein, 10 aa, Artificial Sequence
  source: /note="Description of Artificial Sequence: Synthetic peptide"
YAVAPHHSGI

SEQ ID NO: 19956 - protein, 10 aa, Artificial Sequence
  source: /note="Description of Artificial Sequence: Synthetic peptide"
APHHSGIYPV

SEQ ID NO: 19957 - protein, 10 aa, Artificial Sequence
  source: /note="Description of Artificial Sequence: Synthetic peptide"
SGIYPVHVQL

SEQ ID NO: 19958 - protein, 9 aa, Artificial Sequence
  source: /note="Description of Artificial Sequence: Synthetic peptide"
HQEELPPPL

SEQ ID NO: 19959 - protein, 9 aa, Artificial Sequence
  source: /note="Description of Artificial Sequence: Synthetic peptide"
LPPPLPPGW

SEQ ID NO: 19960 - protein, 9 aa, Artificial Sequence
  source: /note="Description of Artificial Sequence: Synthetic peptide"
VMATKMATL

SEQ ID NO: 19961 - protein, 9 aa, Artificial Sequence
  source: /note="Description of Artificial Sequence: Synthetic peptide"
TLHYPSTTA

SEQ ID NO: 19962 - protein, 9 aa, Artificial Sequence
  source: /note="Description of Artificial Sequence: Synthetic peptide"
ATKMATLHY

SEQ ID NO: 19963 - protein, 9 aa, Artificial Sequence
  source: /note="Description of Artificial Sequence: Synthetic peptide"
KMATLHYPS

SEQ ID NO: 19964 - protein, 10 aa, Artificial Sequence
  source: /note="Description of Artificial Sequence: Synthetic peptide"
MATKMATLHY

SEQ ID NO: 19965 - protein, 10 aa, Artificial Sequence
  source: /note="Description of Artificial Sequence: Synthetic peptide"
IVMATKMATL

SEQ ID NO: 19966 - protein, 10 aa, Artificial Sequence
  source: /note="Description of Artificial Sequence: Synthetic peptide"
KMATLHYPST

SEQ ID NO: 19967 - protein, 10 aa, Artificial Sequence
  source: /note="Description of Artificial Sequence: Synthetic peptide"
TLHYPSTTAL

SEQ ID NO: 19968 - protein, 10 aa, Artificial Sequence
  source: /note="Description of Artificial Sequence: Synthetic peptide"
ATKMATLHYP

SEQ ID NO: 19969 - protein, 10 aa, Artificial Sequence
  source: /note="Description of Artificial Sequence: Synthetic peptide"
ATLHYPSTTA

SEQ ID NO: 19970 - protein, 10 aa, Artificial Sequence
  source: /note="Description of Artificial Sequence: Synthetic peptide"
VMATKMATLH

SEQ ID NO: 19971 - protein, 10 aa, Artificial Sequence
  source: /note="Description of Artificial Sequence: Synthetic peptide"
TKMATLHYPS

SEQ ID NO: 19972 - protein, 9 aa, Artificial Sequence
  source: /note="Description of Artificial Sequence: Synthetic peptide"
SVGSQNDTY

SEQ ID NO: 19973 - protein, 9 aa, Artificial Sequence
  source: /note="Description of Artificial Sequence: Synthetic peptide"
DTYDVPRGV

SEQ ID NO: 19974 - protein, 10 aa, Artificial Sequence
  source: /note="Description of Artificial Sequence: Synthetic peptide"
TYDVPRGVQF

SEQ ID NO: 19975 - protein, 10 aa, Artificial Sequence
  source: /note="Description of Artificial Sequence: Synthetic peptide"
QSVGSQNDTY

SEQ ID NO: 19976 - protein, 9 aa, Artificial Sequence
  source: /note="Description of Artificial Sequence: Synthetic peptide"
KAKSPTKEK

SEQ ID NO: 19977 - protein, 9 aa, Artificial Sequence
  source: /note="Description of Artificial Sequence: Synthetic peptide"
KSPTKEKAK

SEQ ID NO: 19978 - protein, 9 aa, Artificial Sequence
  source: /note="Description of Artificial Sequence: Synthetic peptide"
KEKAKSPEK

SEQ ID NO: 19979 - protein, 10 aa, Artificial Sequence
  source: /note="Description of Artificial Sequence: Synthetic peptide"
KAKSPTKEKA

SEQ ID NO: 19980 - protein, 10 aa, Artificial Sequence
  source: /note="Description of Artificial Sequence: Synthetic peptide"
KEKAKSPEKA

SEQ ID NO: 19981 - protein, 9 aa, Artificial Sequence
  source: /note="Description of Artificial Sequence: Synthetic peptide"
EEAKSPVKA

SEQ ID NO: 19982 - protein, 10 aa, Artificial Sequence
  source: /note="Description of Artificial Sequence: Synthetic peptide"
KEEAKSPVKA

SEQ ID NO: 19983 - protein, 9 aa, Artificial Sequence
  source: /note="Description of Artificial Sequence: Synthetic peptide"
KSPEKAEAK

SEQ ID NO: 19984 - protein, 10 aa, Artificial Sequence
  source: /note="Description of Artificial Sequence: Synthetic peptide"
KAKSPEKAEA

SEQ ID NO: 19985 - protein, 9 aa, Artificial Sequence
  source: /note="Description of Artificial Sequence: Synthetic peptide"
ALRKDIEEV

SEQ ID NO: 19986 - protein, 9 aa, Artificial Sequence
  source: /note="Description of Artificial Sequence: Synthetic peptide"
EVSLVKVEL

SEQ ID NO: 19987 - protein, 9 aa, Artificial Sequence
  source: /note="Description of Artificial Sequence: Synthetic peptide"
RKDIEEVSL

SEQ ID NO: 19988 - protein, 9 aa, Artificial Sequence
  source: /note="Description of Artificial Sequence: Synthetic peptide"
IEEVSLVKV

SEQ ID NO: 19989 - protein, 10 aa, Artificial Sequence
  source: /note="Description of Artificial Sequence: Synthetic peptide"
VSLVKVELDK

SEQ ID NO: 19990 - protein, 10 aa, Artificial Sequence
  source: /note="Description of Artificial Sequence: Synthetic peptide"
EEVSLVKVEL

SEQ ID NO: 19991 - protein, 9 aa, Artificial Sequence
  source: /note="Description of Artificial Sequence: Synthetic peptide"
KAKLCGEKK

SEQ ID NO: 19992 - protein, 10 aa, Artificial Sequence
  source: /note="Description of Artificial Sequence: Synthetic peptide"
QIKAKLCGEK

SEQ ID NO: 19993 - protein, 9 aa, Artificial Sequence
  source: /note="Description of Artificial Sequence: Synthetic peptide"
NSKQMQELR

SEQ ID NO: 19994 - protein, 10 aa, Artificial Sequence
  source: /note="Description of Artificial Sequence: Synthetic peptide"
QMQELRSRNF

SEQ ID NO: 19995 - protein, 10 aa, Artificial Sequence
  source: /note="Description of Artificial Sequence: Synthetic peptide"
EKYEENSKQM

SEQ ID NO: 19996 - protein, 10 aa, Artificial Sequence
  source: /note="Description of Artificial Sequence: Synthetic peptide"
KQMQELRSRN

SEQ ID NO: 19997 - protein, 9 aa, Artificial Sequence
  source: /note="Description of Artificial Sequence: Synthetic peptide"
KFRRIPYSY

SEQ ID NO: 19998 - protein, 9 aa, Artificial Sequence
  source: /note="Description of Artificial Sequence: Synthetic peptide"
SYSDELNEI

SEQ ID NO: 19999 - protein, 9 aa, Artificial Sequence
  source: /note="Description of Artificial Sequence: Synthetic peptide"
IPYSYSDEL

SEQ ID NO: 20000 - protein, 10 aa, Artificial Sequence
  source: /note="Description of Artificial Sequence: Synthetic peptide"
SYSDELNEII

SEQ ID NO: 20001 - protein, 10 aa, Artificial Sequence
  source: /note="Description of Artificial Sequence: Synthetic peptide"
KFRRIPYSYS

SEQ ID NO: 20002 - protein, 10 aa, Artificial Sequence
  source: /note="Description of Artificial Sequence: Synthetic peptide"
GKFRRIPYSY

SEQ ID NO: 20003 - protein, 10 aa, Artificial Sequence
  source: /note="Description of Artificial Sequence: Synthetic peptide"
YSYSDELNEI

SEQ ID NO: 20004 - protein, 10 aa, Artificial Sequence
  source: /note="Description of Artificial Sequence: Synthetic peptide"
EPVPPEAPGF

SEQ ID NO: 20005 - protein, 9 aa, Artificial Sequence
  source: /note="Description of Artificial Sequence: Synthetic peptide"
ESSDHRNEV

SEQ ID NO: 20006 - protein, 10 aa, Artificial Sequence
  source: /note="Description of Artificial Sequence: Synthetic peptide"
ESSDHRNEVR

SEQ ID NO: 20007 - protein, 10 aa, Artificial Sequence
  source: /note="Description of Artificial Sequence: Synthetic peptide"
LESSDHRNEV

SEQ ID NO: 20008 - protein, 9 aa, Artificial Sequence
  source: /note="Description of Artificial Sequence: Synthetic peptide"
LEKEALGQL

SEQ ID NO: 20009 - protein, 10 aa, Artificial Sequence
  source: /note="Description of Artificial Sequence: Synthetic peptide"
ALGQLKPTGK

SEQ ID NO: 20010 - protein, 10 aa, Artificial Sequence
  source: /note="Description of Artificial Sequence: Synthetic peptide"
KEALGQLKPT

SEQ ID NO: 20011 - protein, 9 aa, Artificial Sequence
  source: /note="Description of Artificial Sequence: Synthetic peptide"
QTRSGPVHV

SEQ ID NO: 20012 - protein, 9 aa, Artificial Sequence
  source: /note="Description of Artificial Sequence: Synthetic peptide"
RSGPVHVSV

SEQ ID NO: 20013 - protein, 10 aa, Artificial Sequence
  source: /note="Description of Artificial Sequence: Synthetic peptide"
SPDQTRSGPV

SEQ ID NO: 20014 - protein, 9 aa, Artificial Sequence
  source: /note="Description of Artificial Sequence: Synthetic peptide"
KTDFLSGLL

SEQ ID NO: 20015 - protein, 9 aa, Artificial Sequence
  source: /note="Description of Artificial Sequence: Synthetic peptide"
FLSGLLFFL

SEQ ID NO: 20016 - protein, 9 aa, Artificial Sequence
  source: /note="Description of Artificial Sequence: Synthetic peptide"
GLLFFLALL

SEQ ID NO: 20017 - protein, 9 aa, Artificial Sequence
  source: /note="Description of Artificial Sequence: Synthetic peptide"
FLALLTTTS

SEQ ID NO: 20018 - protein, 9 aa, Artificial Sequence
  source: /note="Description of Artificial Sequence: Synthetic peptide"
DFLSGLLFF

SEQ ID NO: 20019 - protein, 9 aa, Artificial Sequence
  source: /note="Description of Artificial Sequence: Synthetic peptide"
RFKTDFLSG

SEQ ID NO: 20020 - protein, 9 aa, Artificial Sequence
  source: /note="Description of Artificial Sequence: Synthetic peptide"
TTSPQSISI

SEQ ID NO: 20021 - protein, 9 aa, Artificial Sequence
  source: /note="Description of Artificial Sequence: Synthetic peptide"
STPSIMSGC

SEQ ID NO: 20022 - protein, 9 aa, Artificial Sequence
  source: /note="Description of Artificial Sequence: Synthetic peptide"
SPQSISITV

SEQ ID NO: 20023 - protein, 9 aa, Artificial Sequence
  source: /note="Description of Artificial Sequence: Synthetic peptide"
FKTDFLSGL

SEQ ID NO: 20024 - protein, 9 aa, Artificial Sequence
  source: /note="Description of Artificial Sequence: Synthetic peptide"
TDFLSGLLF

SEQ ID NO: 20025 - protein, 9 aa, Artificial Sequence
  source: /note="Description of Artificial Sequence: Synthetic peptide"
SGLLFFLAL

SEQ ID NO: 20026 - protein, 9 aa, Artificial Sequence
  source: /note="Description of Artificial Sequence: Synthetic peptide"
GSGSTPSIM

SEQ ID NO: 20027 - protein, 10 aa, Artificial Sequence
  source: /note="Description of Artificial Sequence: Synthetic peptide"
KTDFLSGLLF

SEQ ID NO: 20028 - protein, 10 aa, Artificial Sequence
  source: /note="Description of Artificial Sequence: Synthetic peptide"
FLSGLLFFLA

SEQ ID NO: 20029 - protein, 10 aa, Artificial Sequence
  source: /note="Description of Artificial Sequence: Synthetic peptide"
LLFFLALLTT

SEQ ID NO: 20030 - protein, 10 aa, Artificial Sequence
  source: /note="Description of Artificial Sequence: Synthetic peptide"
FLALLTTTSP

SEQ ID NO: 20031 - protein, 10 aa, Artificial Sequence
  source: /note="Description of Artificial Sequence: Synthetic peptide"
LLTTTSPQSI

SEQ ID NO: 20032 - protein, 10 aa, Artificial Sequence
  source: /note="Description of Artificial Sequence: Synthetic peptide"
DFLSGLLFFL

SEQ ID NO: 20033 - protein, 10 aa, Artificial Sequence
  source: /note="Description of Artificial Sequence: Synthetic peptide"
RFKTDFLSGL

SEQ ID NO: 20034 - protein, 10 aa, Artificial Sequence
  source: /note="Description of Artificial Sequence: Synthetic peptide"
TTTSPQSISI

SEQ ID NO: 20035 - protein, 10 aa, Artificial Sequence
  source: /note="Description of Artificial Sequence: Synthetic peptide"
TSPQSISITV

SEQ ID NO: 20036 - protein, 10 aa, Artificial Sequence
  source: /note="Description of Artificial Sequence: Synthetic peptide"
TPGSGSTPSI

SEQ ID NO: 20037 - protein, 10 aa, Artificial Sequence
  source: /note="Description of Artificial Sequence: Synthetic peptide"
FKTDFLSGLL

SEQ ID NO: 20038 - protein, 10 aa, Artificial Sequence
  source: /note="Description of Artificial Sequence: Synthetic peptide"
TDFLSGLLFF

SEQ ID NO: 20039 - protein, 10 aa, Artificial Sequence
  source: /note="Description of Artificial Sequence: Synthetic peptide"
LSGLLFFLAL

SEQ ID NO: 20040 - protein, 9 aa, Artificial Sequence
  source: /note="Description of Artificial Sequence: Synthetic peptide"
AILRLSPYV

SEQ ID NO: 20041 - protein, 9 aa, Artificial Sequence
  source: /note="Description of Artificial Sequence: Synthetic peptide"
GSVNSAILR

SEQ ID NO: 20042 - protein, 9 aa, Artificial Sequence
  source: /note="Description of Artificial Sequence: Synthetic peptide"
SAILRLSPY

SEQ ID NO: 20043 - protein, 9 aa, Artificial Sequence
  source: /note="Description of Artificial Sequence: Synthetic peptide"
YPGSVNSAI

SEQ ID NO: 20044 - protein, 10 aa, Artificial Sequence
  source: /note="Description of Artificial Sequence: Synthetic peptide"
NSAILRLSPY

SEQ ID NO: 20045 - protein, 10 aa, Artificial Sequence
  source: /note="Description of Artificial Sequence: Synthetic peptide"
SAILRLSPYV

SEQ ID NO: 20046 - protein, 10 aa, Artificial Sequence
  source: /note="Description of Artificial Sequence: Synthetic peptide"
KYPGSVNSAI

SEQ ID NO: 20047 - protein, 10 aa, Artificial Sequence
  source: /note="Description of Artificial Sequence: Synthetic peptide"
ILRLSPYVNY

SEQ ID NO: 20048 - protein, 10 aa, Artificial Sequence
  source: /note="Description of Artificial Sequence: Synthetic peptide"
YPGSVNSAIL

SEQ ID NO: 20049 - protein, 9 aa, Artificial Sequence
  source: /note="Description of Artificial Sequence: Synthetic peptide"
EMQQSICEA

SEQ ID NO: 20050 - protein, 9 aa, Artificial Sequence
  source: /note="Description of Artificial Sequence: Synthetic peptide"
SICEAAAQI

SEQ ID NO: 20051 - protein, 9 aa, Artificial Sequence
  source: /note="Description of Artificial Sequence: Synthetic peptide"
MQQSICEAA

SEQ ID NO: 20052 - protein, 9 aa, Artificial Sequence
  source: /note="Description of Artificial Sequence: Synthetic peptide"
CEAAAQIQS

SEQ ID NO: 20053 - protein, 10 aa, Artificial Sequence
  source: /note="Description of Artificial Sequence: Synthetic peptide"
QSICEAAAQI

SEQ ID NO: 20054 - protein, 10 aa, Artificial Sequence
  source: /note="Description of Artificial Sequence: Synthetic peptide"
EAAAQIQSEL

SEQ ID NO: 20055 - protein, 10 aa, Artificial Sequence
  source: /note="Description of Artificial Sequence: Synthetic peptide"
MEMQQSICEA

SEQ ID NO: 20056 - protein, 10 aa, Artificial Sequence
  source: /note="Description of Artificial Sequence: Synthetic peptide"
MQQSICEAAA

SEQ ID NO: 20057 - protein, 10 aa, Artificial Sequence
  source: /note="Description of Artificial Sequence: Synthetic peptide"
IDLGVSGEVF

SEQ ID NO: 20058 - protein, 10 aa, Artificial Sequence
  source: /note="Description of Artificial Sequence: Synthetic peptide"
LGVSGEVFDF

SEQ ID NO: 20059 - protein, 10 aa, Artificial Sequence
  source: /note="Description of Artificial Sequence: Synthetic peptide"
IDLGVSQEVF

SEQ ID NO: 20060 - protein, 10 aa, Artificial Sequence
  source: /note="Description of Artificial Sequence: Synthetic peptide"
LGVSQEVFDF

SEQ ID NO: 20061 - protein, 10 aa, Artificial Sequence
  source: /note="Description of Artificial Sequence: Synthetic peptide"
QLDEKTGEFL

SEQ ID NO: 20062 - protein, 10 aa, Artificial Sequence
  source: /note="Description of Artificial Sequence: Synthetic peptide"
LQLDEKTGEF

SEQ ID NO: 20063 - protein, 10 aa, Artificial Sequence
  source: /note="Description of Artificial Sequence: Synthetic peptide"
DEKTGEFLPI

SEQ ID NO: 20064 - protein, 9 aa, Artificial Sequence
  source: /note="Description of Artificial Sequence: Synthetic peptide"
AQLQLDEQT

SEQ ID NO: 20065 - protein, 9 aa, Artificial Sequence
  source: /note="Description of Artificial Sequence: Synthetic peptide"
QLDEQTGEF

SEQ ID NO: 20066 - protein, 9 aa, Artificial Sequence
  source: /note="Description of Artificial Sequence: Synthetic peptide"
EQTGEFLPI

SEQ ID NO: 20067 - protein, 10 aa, Artificial Sequence
  source: /note="Description of Artificial Sequence: Synthetic peptide"
QLDEQTGEFL

SEQ ID NO: 20068 - protein, 10 aa, Artificial Sequence
  source: /note="Description of Artificial Sequence: Synthetic peptide"
LQLDEQTGEF

SEQ ID NO: 20069 - protein, 10 aa, Artificial Sequence
  source: /note="Description of Artificial Sequence: Synthetic peptide"
DEQTGEFLPI

SEQ ID NO: 20070 - protein, 9 aa, Artificial Sequence
  source: /note="Description of Artificial Sequence: Synthetic peptide"
QLDEETSEF

SEQ ID NO: 20071 - protein, 9 aa, Artificial Sequence
  source: /note="Description of Artificial Sequence: Synthetic peptide"
EETSEFLPI

SEQ ID NO: 20072 - protein, 9 aa, Artificial Sequence
  source: /note="Description of Artificial Sequence: Synthetic peptide"
SEFLPIQPA

SEQ ID NO: 20073 - protein, 10 aa, Artificial Sequence
  source: /note="Description of Artificial Sequence: Synthetic peptide"
QLDEETSEFL

SEQ ID NO: 20074 - protein, 10 aa, Artificial Sequence
  source: /note="Description of Artificial Sequence: Synthetic peptide"
LQLDEETSEF

SEQ ID NO: 20075 - protein, 10 aa, Artificial Sequence
  source: /note="Description of Artificial Sequence: Synthetic peptide"
DEETSEFLPI

SEQ ID NO: 20076 - protein, 10 aa, Artificial Sequence
  source: /note="Description of Artificial Sequence: Synthetic peptide"
SEFLPIQPAQ

SEQ ID NO: 20077 - protein, 9 aa, Artificial Sequence
  source: /note="Description of Artificial Sequence: Synthetic peptide"
ILWRQDIHL

SEQ ID NO: 20078 - protein, 9 aa, Artificial Sequence
  source: /note="Description of Artificial Sequence: Synthetic peptide"
HLGVSREVF

SEQ ID NO: 20079 - protein, 10 aa, Artificial Sequence
  source: /note="Description of Artificial Sequence: Synthetic peptide"
DIHLGVSREV

SEQ ID NO: 20080 - protein, 10 aa, Artificial Sequence
  source: /note="Description of Artificial Sequence: Synthetic peptide"
IHLGVSREVF

SEQ ID NO: 20081 - protein, 9 aa, Artificial Sequence
  source: /note="Description of Artificial Sequence: Synthetic peptide"
ILWRQDIDF

SEQ ID NO: 20082 - protein, 9 aa, Artificial Sequence
  source: /note="Description of Artificial Sequence: Synthetic peptide"
IDFGVSREV

SEQ ID NO: 20083 - protein, 10 aa, Artificial Sequence
  source: /note="Description of Artificial Sequence: Synthetic peptide"
IDFGVSREVF

SEQ ID NO: 20084 - protein, 10 aa, Artificial Sequence
  source: /note="Description of Artificial Sequence: Synthetic peptide"
FGVSREVFDF

SEQ ID NO: 20085 - protein, 9 aa, Artificial Sequence
  source: /note="Description of Artificial Sequence: Synthetic peptide"
DLAVSREVF

SEQ ID NO: 20086 - protein, 9 aa, Artificial Sequence
  source: /note="Description of Artificial Sequence: Synthetic peptide"
WRQDIDLAV

SEQ ID NO: 20087 - protein, 9 aa, Artificial Sequence
  source: /note="Description of Artificial Sequence: Synthetic peptide"
AVSREVFDF

SEQ ID NO: 20088 - protein, 10 aa, Artificial Sequence
  source: /note="Description of Artificial Sequence: Synthetic peptide"
ILWRQDIDLA

SEQ ID NO: 20089 - protein, 10 aa, Artificial Sequence
  source: /note="Description of Artificial Sequence: Synthetic peptide"
IDLAVSREVF

SEQ ID NO: 20090 - protein, 10 aa, Artificial Sequence
  source: /note="Description of Artificial Sequence: Synthetic peptide"
LAVSREVFDF

SEQ ID NO: 20091 - protein, 9 aa, Artificial Sequence
  source: /note="Description of Artificial Sequence: Synthetic peptide"
LSDFESSSY

SEQ ID NO: 20092 - protein, 9 aa, Artificial Sequence
  source: /note="Description of Artificial Sequence: Synthetic peptide"
SDFESSSYY

SEQ ID NO: 20093 - protein, 9 aa, Artificial Sequence
  source: /note="Description of Artificial Sequence: Synthetic peptide"
FESSSYYSM

SEQ ID NO: 20094 - protein, 9 aa, Artificial Sequence
  source: /note="Description of Artificial Sequence: Synthetic peptide"
GPNFSLSDF

SEQ ID NO: 20095 - protein, 10 aa, Artificial Sequence
  source: /note="Description of Artificial Sequence: Synthetic peptide"
LSDFESSSYY

SEQ ID NO: 20096 - protein, 10 aa, Artificial Sequence
  source: /note="Description of Artificial Sequence: Synthetic peptide"
SLSDFESSSY

SEQ ID NO: 20097 - protein, 10 aa, Artificial Sequence
  source: /note="Description of Artificial Sequence: Synthetic peptide"
FESSSYYSMS

SEQ ID NO: 20098 - protein, 9 aa, Artificial Sequence
  source: /note="Description of Artificial Sequence: Synthetic peptide"
RVQSELSGL

SEQ ID NO: 20099 - protein, 9 aa, Artificial Sequence
  source: /note="Description of Artificial Sequence: Synthetic peptide"
QSELSGLPF

SEQ ID NO: 20100 - protein, 10 aa, Artificial Sequence
  source: /note="Description of Artificial Sequence: Synthetic peptide"
QSELSGLPFY

SEQ ID NO: 20101 - protein, 10 aa, Artificial Sequence
  source: /note="Description of Artificial Sequence: Synthetic peptide"
ALILRVQSEL

SEQ ID NO: 20102 - protein, 10 aa, Artificial Sequence
  source: /note="Description of Artificial Sequence: Synthetic peptide"
VQSELSGLPF

SEQ ID NO: 20103 - protein, 10 aa, Artificial Sequence
  source: /note="Description of Artificial Sequence: Synthetic peptide"
LRVQSELSGL

SEQ ID NO: 20104 - protein, 9 aa, Artificial Sequence
  source: /note="Description of Artificial Sequence: Synthetic peptide"
LSLEANSPY

SEQ ID NO: 20105 - protein, 9 aa, Artificial Sequence
  source: /note="Description of Artificial Sequence: Synthetic peptide"
FLARSSLSL

SEQ ID NO: 20106 - protein, 9 aa, Artificial Sequence
  source: /note="Description of Artificial Sequence: Synthetic peptide"
SLEANSPYL

SEQ ID NO: 20107 - protein, 9 aa, Artificial Sequence
  source: /note="Description of Artificial Sequence: Synthetic peptide"
YLGVWRPPL

SEQ ID NO: 20108 - protein, 9 aa, Artificial Sequence
  source: /note="Description of Artificial Sequence: Synthetic peptide"
RSIKVFDFL

SEQ ID NO: 20109 - protein, 9 aa, Artificial Sequence
  source: /note="Description of Artificial Sequence: Synthetic peptide"
SIKVFDFLA

SEQ ID NO: 20110 - protein, 9 aa, Artificial Sequence
  source: /note="Description of Artificial Sequence: Synthetic peptide"
LGVWRPPLR

SEQ ID NO: 20111 - protein, 9 aa, Artificial Sequence
  source: /note="Description of Artificial Sequence: Synthetic peptide"
EANSPYLGV

SEQ ID NO: 20112 - protein, 9 aa, Artificial Sequence
  source: /note="Description of Artificial Sequence: Synthetic peptide"
FDFLARSSL

SEQ ID NO: 20113 - protein, 9 aa, Artificial Sequence
  source: /note="Description of Artificial Sequence: Synthetic peptide"
ANSPYLGVW

SEQ ID NO: 20114 - protein, 10 aa, Artificial Sequence
  source: /note="Description of Artificial Sequence: Synthetic peptide"
SIKVFDFLAR

SEQ ID NO: 20115 - protein, 10 aa, Artificial Sequence
  source: /note="Description of Artificial Sequence: Synthetic peptide"
DFLARSSLSL

SEQ ID NO: 20116 - protein, 10 aa, Artificial Sequence
  source: /note="Description of Artificial Sequence: Synthetic peptide"
PYLGVWRPPL

SEQ ID NO: 20117 - protein, 10 aa, Artificial Sequence
  source: /note="Description of Artificial Sequence: Synthetic peptide"
RSIKVFDFLA

SEQ ID NO: 20118 - protein, 10 aa, Artificial Sequence
  source: /note="Description of Artificial Sequence: Synthetic peptide"
LARSSLSLEA

SEQ ID NO: 20119 - protein, 10 aa, Artificial Sequence
  source: /note="Description of Artificial Sequence: Synthetic peptide"
VWRPPLRMGL

SEQ ID NO: 20120 - protein, 10 aa, Artificial Sequence
  source: /note="Description of Artificial Sequence: Synthetic peptide"
SLSLEANSPY

SEQ ID NO: 20121 - protein, 10 aa, Artificial Sequence
  source: /note="Description of Artificial Sequence: Synthetic peptide"
YLGVWRPPLR

SEQ ID NO: 20122 - protein, 10 aa, Artificial Sequence
  source: /note="Description of Artificial Sequence: Synthetic peptide"
LSLEANSPYL

SEQ ID NO: 20123 - protein, 10 aa, Artificial Sequence
  source: /note="Description of Artificial Sequence: Synthetic peptide"
LEANSPYLGV

SEQ ID NO: 20124 - protein, 10 aa, Artificial Sequence
  source: /note="Description of Artificial Sequence: Synthetic peptide"
LGVWRPPLRM

SEQ ID NO: 20125 - protein, 10 aa, Artificial Sequence
  source: /note="Description of Artificial Sequence: Synthetic peptide"
EANSPYLGVW

SEQ ID NO: 20126 - protein, 10 aa, Artificial Sequence
  source: /note="Description of Artificial Sequence: Synthetic peptide"
YVFVCSKQAL

SEQ ID NO: 20127 - protein, 10 aa, Artificial Sequence
  source: /note="Description of Artificial Sequence: Synthetic peptide"
NVPYVFVCSK

SEQ ID NO: 20128 - protein, 10 aa, Artificial Sequence
  source: /note="Description of Artificial Sequence: Synthetic peptide"
FVCSKQALGR

SEQ ID NO: 20129 - protein, 10 aa, Artificial Sequence
  source: /note="Description of Artificial Sequence: Synthetic peptide"
AESPQSTNDA

SEQ ID NO: 20130 - protein, 9 aa, Artificial Sequence
  source: /note="Description of Artificial Sequence: Synthetic peptide"
GMTSTCPSA

SEQ ID NO: 20131 - protein, 9 aa, Artificial Sequence
  source: /note="Description of Artificial Sequence: Synthetic peptide"
ATSAGVWTK

SEQ ID NO: 20132 - protein, 9 aa, Artificial Sequence
  source: /note="Description of Artificial Sequence: Synthetic peptide"
SLHPWSGPR

SEQ ID NO: 20133 - protein, 9 aa, Artificial Sequence
  source: /note="Description of Artificial Sequence: Synthetic peptide"
GVWTKMAER

SEQ ID NO: 20134 - protein, 9 aa, Artificial Sequence
  source: /note="Description of Artificial Sequence: Synthetic peptide"
VYPPSLHPW

SEQ ID NO: 20135 - protein, 9 aa, Artificial Sequence
  source: /note="Description of Artificial Sequence: Synthetic peptide"
RVYPPSLHP

SEQ ID NO: 20136 - protein, 9 aa, Artificial Sequence
  source: /note="Description of Artificial Sequence: Synthetic peptide"
MTSTCPSAM

SEQ ID NO: 20137 - protein, 9 aa, Artificial Sequence
  source: /note="Description of Artificial Sequence: Synthetic peptide"
SQAPPLRVY

SEQ ID NO: 20138 - protein, 9 aa, Artificial Sequence
  source: /note="Description of Artificial Sequence: Synthetic peptide"
WTKMAERCR

SEQ ID NO: 20139 - protein, 9 aa, Artificial Sequence
  source: /note="Description of Artificial Sequence: Synthetic peptide"
MTWATSSPC

SEQ ID NO: 20140 - protein, 9 aa, Artificial Sequence
  source: /note="Description of Artificial Sequence: Synthetic peptide"
TSAGVWTKM

SEQ ID NO: 20141 - protein, 9 aa, Artificial Sequence
  source: /note="Description of Artificial Sequence: Synthetic peptide"
HPWSGPRPG

SEQ ID NO: 20142 - protein, 9 aa, Artificial Sequence
  source: /note="Description of Artificial Sequence: Synthetic peptide"
PLRVYPPSL

SEQ ID NO: 20143 - protein, 9 aa, Artificial Sequence
  source: /note="Description of Artificial Sequence: Synthetic peptide"
LEHYGGTPG

SEQ ID NO: 20144 - protein, 9 aa, Artificial Sequence
  source: /note="Description of Artificial Sequence: Synthetic peptide"
EHYGGTPGM

SEQ ID NO: 20145 - protein, 9 aa, Artificial Sequence
  source: /note="Description of Artificial Sequence: Synthetic peptide"
STCPSAMTW

SEQ ID NO: 20146 - protein, 9 aa, Artificial Sequence
  source: /note="Description of Artificial Sequence: Synthetic peptide"
AMTWATSSP

SEQ ID NO: 20147 - protein, 9 aa, Artificial Sequence
  source: /note="Description of Artificial Sequence: Synthetic peptide"
TERATSAGV

SEQ ID NO: 20148 - protein, 9 aa, Artificial Sequence
  source: /note="Description of Artificial Sequence: Synthetic peptide"
CPSAMTWAT

SEQ ID NO: 20149 - protein, 9 aa, Artificial Sequence
  source: /note="Description of Artificial Sequence: Synthetic peptide"
AERCRAPAP

SEQ ID NO: 20150 - protein, 10 aa, Artificial Sequence
  source: /note="Description of Artificial Sequence: Synthetic peptide"
KMAERCRAPA

SEQ ID NO: 20151 - protein, 10 aa, Artificial Sequence
  source: /note="Description of Artificial Sequence: Synthetic peptide"
GMTSTCPSAM

SEQ ID NO: 20152 - protein, 10 aa, Artificial Sequence
  source: /note="Description of Artificial Sequence: Synthetic peptide"
AMTWATSSPC

SEQ ID NO: 20153 - protein, 10 aa, Artificial Sequence
  source: /note="Description of Artificial Sequence: Synthetic peptide"
TSSPCSATER

SEQ ID NO: 20154 - protein, 10 aa, Artificial Sequence
  source: /note="Description of Artificial Sequence: Synthetic peptide"
RATSAGVWTK

SEQ ID NO: 20155 - protein, 10 aa, Artificial Sequence
  source: /note="Description of Artificial Sequence: Synthetic peptide"
RVYPPSLHPW

SEQ ID NO: 20156 - protein, 10 aa, Artificial Sequence
  source: /note="Description of Artificial Sequence: Synthetic peptide"
WTKMAERCRA

SEQ ID NO: 20157 - protein, 10 aa, Artificial Sequence
  source: /note="Description of Artificial Sequence: Synthetic peptide"
RCRAPAPSQA

SEQ ID NO: 20158 - protein, 10 aa, Artificial Sequence
  source: /note="Description of Artificial Sequence: Synthetic peptide"
MTSTCPSAMT

SEQ ID NO: 20159 - protein, 10 aa, Artificial Sequence
  source: /note="Description of Artificial Sequence: Synthetic peptide"
MTWATSSPCS

SEQ ID NO: 20160 - protein, 10 aa, Artificial Sequence
  source: /note="Description of Artificial Sequence: Synthetic peptide"
TSAGVWTKMA

SEQ ID NO: 20161 - protein, 10 aa, Artificial Sequence
  source: /note="Description of Artificial Sequence: Synthetic peptide"
APAPSQAPPL

SEQ ID NO: 20162 - protein, 10 aa, Artificial Sequence
  source: /note="Description of Artificial Sequence: Synthetic peptide"
APSQAPPLRV

SEQ ID NO: 20163 - protein, 10 aa, Artificial Sequence
  source: /note="Description of Artificial Sequence: Synthetic peptide"
LEHYGGTPGM

SEQ ID NO: 20164 - protein, 10 aa, Artificial Sequence
  source: /note="Description of Artificial Sequence: Synthetic peptide"
TERATSAGVW

SEQ ID NO: 20165 - protein, 10 aa, Artificial Sequence
  source: /note="Description of Artificial Sequence: Synthetic peptide"
ATSAGVWTKM

SEQ ID NO: 20166 - protein, 10 aa, Artificial Sequence
  source: /note="Description of Artificial Sequence: Synthetic peptide"
SQAPPLRVYP

SEQ ID NO: 20167 - protein, 10 aa, Artificial Sequence
  source: /note="Description of Artificial Sequence: Synthetic peptide"
CPSAMTWATS

SEQ ID NO: 20168 - protein, 10 aa, Artificial Sequence
  source: /note="Description of Artificial Sequence: Synthetic peptide"
AERCRAPAPS

SEQ ID NO: 20169 - protein, 10 aa, Artificial Sequence
  source: /note="Description of Artificial Sequence: Synthetic peptide"
TSTCPSAMTW

SEQ ID NO: 20170 - protein, 9 aa, Artificial Sequence
  source: /note="Description of Artificial Sequence: Synthetic peptide"
LLEEKVCAL

SEQ ID NO: 20171 - protein, 9 aa, Artificial Sequence
  source: /note="Description of Artificial Sequence: Synthetic peptide"
KVCALNKLV

SEQ ID NO: 20172 - protein, 9 aa, Artificial Sequence
  source: /note="Description of Artificial Sequence: Synthetic peptide"
CALNKLVSR

SEQ ID NO: 20173 - protein, 10 aa, Artificial Sequence
  source: /note="Description of Artificial Sequence: Synthetic peptide"
RLLEEKVCAL

SEQ ID NO: 20174 - protein, 9 aa, Artificial Sequence
  source: /note="Description of Artificial Sequence: Synthetic peptide"
HLQSHSISL

SEQ ID NO: 20175 - protein, 9 aa, Artificial Sequence
  source: /note="Description of Artificial Sequence: Synthetic peptide"
AQKSELPPP

SEQ ID NO: 20176 - protein, 9 aa, Artificial Sequence
  source: /note="Description of Artificial Sequence: Synthetic peptide"
LQSHSISLP

SEQ ID NO: 20177 - protein, 10 aa, Artificial Sequence
  source: /note="Description of Artificial Sequence: Synthetic peptide"
AQKSELPPPH

SEQ ID NO: 20178 - protein, 10 aa, Artificial Sequence
  source: /note="Description of Artificial Sequence: Synthetic peptide"
QKSELPPPHL

SEQ ID NO: 20179 - protein, 10 aa, Artificial Sequence
  source: /note="Description of Artificial Sequence: Synthetic peptide"
EHHHHHHHHF

SEQ ID NO: 20180 - protein, 9 aa, Artificial Sequence
  source: /note="Description of Artificial Sequence: Synthetic peptide"
IMYSLPLTY

SEQ ID NO: 20181 - protein, 9 aa, Artificial Sequence
  source: /note="Description of Artificial Sequence: Synthetic peptide"
YSNLHTLTI

SEQ ID NO: 20182 - protein, 9 aa, Artificial Sequence
  source: /note="Description of Artificial Sequence: Synthetic peptide"
KMLCFLSMI

SEQ ID NO: 20183 - protein, 9 aa, Artificial Sequence
  source: /note="Description of Artificial Sequence: Synthetic peptide"
FLSMIMYSL

SEQ ID NO: 20184 - protein, 9 aa, Artificial Sequence
  source: /note="Description of Artificial Sequence: Synthetic peptide"
SMIMYSLPL

SEQ ID NO: 20185 - protein, 9 aa, Artificial Sequence
  source: /note="Description of Artificial Sequence: Synthetic peptide"
MIMYSLPLT

SEQ ID NO: 20186 - protein, 9 aa, Artificial Sequence
  source: /note="Description of Artificial Sequence: Synthetic peptide"
LTYSNLHTL

SEQ ID NO: 20187 - protein, 9 aa, Artificial Sequence
  source: /note="Description of Artificial Sequence: Synthetic peptide"
SLPLTYSNL

SEQ ID NO: 20188 - protein, 9 aa, Artificial Sequence
  source: /note="Description of Artificial Sequence: Synthetic peptide"
NLHTLTILK

SEQ ID NO: 20189 - protein, 9 aa, Artificial Sequence
  source: /note="Description of Artificial Sequence: Synthetic peptide"
HTLTILKKY

SEQ ID NO: 20190 - protein, 9 aa, Artificial Sequence
  source: /note="Description of Artificial Sequence: Synthetic peptide"
LTILKKYML

SEQ ID NO: 20191 - protein, 9 aa, Artificial Sequence
  source: /note="Description of Artificial Sequence: Synthetic peptide"
MLCFLSMIM

SEQ ID NO: 20192 - protein, 9 aa, Artificial Sequence
  source: /note="Description of Artificial Sequence: Synthetic peptide"
RELKMLCFL

SEQ ID NO: 20193 - protein, 9 aa, Artificial Sequence
  source: /note="Description of Artificial Sequence: Synthetic peptide"
LKMLCFLSM

SEQ ID NO: 20194 - protein, 9 aa, Artificial Sequence
  source: /note="Description of Artificial Sequence: Synthetic peptide"
LCFLSMIMY

SEQ ID NO: 20195 - protein, 9 aa, Artificial Sequence
  source: /note="Description of Artificial Sequence: Synthetic peptide"
SNLHTLTIL

SEQ ID NO: 20196 - protein, 9 aa, Artificial Sequence
  source: /note="Description of Artificial Sequence: Synthetic peptide"
LPLTYSNLH

SEQ ID NO: 20197 - protein, 10 aa, Artificial Sequence
  source: /note="Description of Artificial Sequence: Synthetic peptide"
MIMYSLPLTY

SEQ ID NO: 20198 - protein, 10 aa, Artificial Sequence
  source: /note="Description of Artificial Sequence: Synthetic peptide"
KMLCFLSMIM

SEQ ID NO: 20199 - protein, 10 aa, Artificial Sequence
  source: /note="Description of Artificial Sequence: Synthetic peptide"
SMIMYSLPLT

SEQ ID NO: 20200 - protein, 10 aa, Artificial Sequence
  source: /note="Description of Artificial Sequence: Synthetic peptide"
IMYSLPLTYS

SEQ ID NO: 20201 - protein, 10 aa, Artificial Sequence
  source: /note="Description of Artificial Sequence: Synthetic peptide"
FLSMIMYSLP

SEQ ID NO: 20202 - protein, 10 aa, Artificial Sequence
  source: /note="Description of Artificial Sequence: Synthetic peptide"
MLCFLSMIMY

SEQ ID NO: 20203 - protein, 10 aa, Artificial Sequence
  source: /note="Description of Artificial Sequence: Synthetic peptide"
NLHTLTILKK

SEQ ID NO: 20204 - protein, 10 aa, Artificial Sequence
  source: /note="Description of Artificial Sequence: Synthetic peptide"
SNLHTLTILK

SEQ ID NO: 20205 - protein, 10 aa, Artificial Sequence
  source: /note="Description of Artificial Sequence: Synthetic peptide"
CFLSMIMYSL

SEQ ID NO: 20206 - protein, 10 aa, Artificial Sequence
  source: /note="Description of Artificial Sequence: Synthetic peptide"
YSLPLTYSNL

SEQ ID NO: 20207 - protein, 10 aa, Artificial Sequence
  source: /note="Description of Artificial Sequence: Synthetic peptide"
TYSNLHTLTI

SEQ ID NO: 20208 - protein, 10 aa, Artificial Sequence
  source: /note="Description of Artificial Sequence: Synthetic peptide"
ELKMLCFLSM

SEQ ID NO: 20209 - protein, 10 aa, Artificial Sequence
  source: /note="Description of Artificial Sequence: Synthetic peptide"
LSMIMYSLPL

SEQ ID NO: 20210 - protein, 10 aa, Artificial Sequence
  source: /note="Description of Artificial Sequence: Synthetic peptide"
LKMLCFLSMI

SEQ ID NO: 20211 - protein, 10 aa, Artificial Sequence
  source: /note="Description of Artificial Sequence: Synthetic peptide"
YSNLHTLTIL

SEQ ID NO: 20212 - protein, 10 aa, Artificial Sequence
  source: /note="Description of Artificial Sequence: Synthetic peptide"
LHTLTILKKY

SEQ ID NO: 20213 - protein, 10 aa, Artificial Sequence
  source: /note="Description of Artificial Sequence: Synthetic peptide"
RELKMLCFLS

SEQ ID NO: 20214 - protein, 10 aa, Artificial Sequence
  source: /note="Description of Artificial Sequence: Synthetic peptide"
LPLTYSNLHT

SEQ ID NO: 20215 - protein, 9 aa, Artificial Sequence
  source: /note="Description of Artificial Sequence: Synthetic peptide"
VFSHKFDFK

SEQ ID NO: 20216 - protein, 9 aa, Artificial Sequence
  source: /note="Description of Artificial Sequence: Synthetic peptide"
FSHKFDFKL

SEQ ID NO: 20217 - protein, 9 aa, Artificial Sequence
  source: /note="Description of Artificial Sequence: Synthetic peptide"
FKLQDVSSV

SEQ ID NO: 20218 - protein, 10 aa, Artificial Sequence
  source: /note="Description of Artificial Sequence: Synthetic peptide"
GVFSHKFDFK

SEQ ID NO: 20219 - protein, 10 aa, Artificial Sequence
  source: /note="Description of Artificial Sequence: Synthetic peptide"
VFSHKFDFKL

SEQ ID NO: 20220 - protein, 10 aa, Artificial Sequence
  source: /note="Description of Artificial Sequence: Synthetic peptide"
HKFDFKLQDV

SEQ ID NO: 20221 - protein, 9 aa, Artificial Sequence
  source: /note="Description of Artificial Sequence: Synthetic peptide"
NIPNYLFDF

SEQ ID NO: 20222 - protein, 9 aa, Artificial Sequence
  source: /note="Description of Artificial Sequence: Synthetic peptide"
INSGNIPNY

SEQ ID NO: 20223 - protein, 9 aa, Artificial Sequence
  source: /note="Description of Artificial Sequence: Synthetic peptide"
IPNYLFDFF

SEQ ID NO: 20224 - protein, 9 aa, Artificial Sequence
  source: /note="Description of Artificial Sequence: Synthetic peptide"
SGNIPNYLF

SEQ ID NO: 20225 - protein, 10 aa, Artificial Sequence
  source: /note="Description of Artificial Sequence: Synthetic peptide"
NSGNIPNYLF

SEQ ID NO: 20226 - protein, 10 aa, Artificial Sequence
  source: /note="Description of Artificial Sequence: Synthetic peptide"
GNIPNYLFDF

SEQ ID NO: 20227 - protein, 10 aa, Artificial Sequence
  source: /note="Description of Artificial Sequence: Synthetic peptide"
NIPNYLFDFF

SEQ ID NO: 20228 - protein, 10 aa, Artificial Sequence
  source: /note="Description of Artificial Sequence: Synthetic peptide"
NYLFDFFEHL

SEQ ID NO: 20229 - protein, 10 aa, Artificial Sequence
  source: /note="Description of Artificial Sequence: Synthetic peptide"
YINSGNIPNY

SEQ ID NO: 20230 - protein, 9 aa, Artificial Sequence
  source: /note="Description of Artificial Sequence: Synthetic peptide"
ECLRHIWQF

SEQ ID NO: 20231 - protein, 9 aa, Artificial Sequence
  source: /note="Description of Artificial Sequence: Synthetic peptide"
RHIWQFGAL

SEQ ID NO: 20232 - protein, 9 aa, Artificial Sequence
  source: /note="Description of Artificial Sequence: Synthetic peptide"
WQFGALTAE

SEQ ID NO: 20233 - protein, 10 aa, Artificial Sequence
  source: /note="Description of Artificial Sequence: Synthetic peptide"
WQFGALTAEV

SEQ ID NO: 20234 - protein, 10 aa, Artificial Sequence
  source: /note="Description of Artificial Sequence: Synthetic peptide"
CLRHIWQFGA

SEQ ID NO: 20235 - protein, 10 aa, Artificial Sequence
  source: /note="Description of Artificial Sequence: Synthetic peptide"
TECLRHIWQF

SEQ ID NO: 20236 - protein, 10 aa, Artificial Sequence
  source: /note="Description of Artificial Sequence: Synthetic peptide"
LRHIWQFGAL

SEQ ID NO: 20237 - protein, 10 aa, Artificial Sequence
  source: /note="Description of Artificial Sequence: Synthetic peptide"
RHIWQFGALT

SEQ ID NO: 20238 - protein, 10 aa, Artificial Sequence
  source: /note="Description of Artificial Sequence: Synthetic peptide"
HIWQFGALTA

SEQ ID NO: 20239 - protein, 9 aa, Artificial Sequence
  source: /note="Description of Artificial Sequence: Synthetic peptide"
RNACLGESV

SEQ ID NO: 20240 - protein, 10 aa, Artificial Sequence
  source: /note="Description of Artificial Sequence: Synthetic peptide"
CLGESVSLNK

SEQ ID NO: 20241 - protein, 9 aa, Artificial Sequence
  source: /note="Description of Artificial Sequence: Synthetic peptide"
SQPERLLFI

SEQ ID NO: 20242 - protein, 9 aa, Artificial Sequence
  source: /note="Description of Artificial Sequence: Synthetic peptide"
FIIDSFEEL

SEQ ID NO: 20243 - protein, 9 aa, Artificial Sequence
  source: /note="Description of Artificial Sequence: Synthetic peptide"
RLLFIIDSF

SEQ ID NO: 20244 - protein, 9 aa, Artificial Sequence
  source: /note="Description of Artificial Sequence: Synthetic peptide"
QPERLLFII

SEQ ID NO: 20245 - protein, 10 aa, Artificial Sequence
  source: /note="Description of Artificial Sequence: Synthetic peptide"
SQPERLLFII

SEQ ID NO: 20246 - protein, 10 aa, Artificial Sequence
  source: /note="Description of Artificial Sequence: Synthetic peptide"
LFIIDSFEEL

SEQ ID NO: 20247 - protein, 9 aa, Artificial Sequence
  source: /note="Description of Artificial Sequence: Synthetic peptide"
LIHSLLRKV

SEQ ID NO: 20248 - protein, 9 aa, Artificial Sequence
  source: /note="Description of Artificial Sequence: Synthetic peptide"
TLIHSLLRK

SEQ ID NO: 20249 - protein, 9 aa, Artificial Sequence
  source: /note="Description of Artificial Sequence: Synthetic peptide"
FTLIHSLLR

SEQ ID NO: 20250 - protein, 9 aa, Artificial Sequence
  source: /note="Description of Artificial Sequence: Synthetic peptide"
PFTLIHSLL

SEQ ID NO: 20251 - protein, 9 aa, Artificial Sequence
  source: /note="Description of Artificial Sequence: Synthetic peptide"
HSLLRKVLL

SEQ ID NO: 20252 - protein, 9 aa, Artificial Sequence
  source: /note="Description of Artificial Sequence: Synthetic peptide"
PPFTLIHSL

SEQ ID NO: 20253 - protein, 9 aa, Artificial Sequence
  source: /note="Description of Artificial Sequence: Synthetic peptide"
KQPPFTLIH

SEQ ID NO: 20254 - protein, 10 aa, Artificial Sequence
  source: /note="Description of Artificial Sequence: Synthetic peptide"
TLIHSLLRKV

SEQ ID NO: 20255 - protein, 10 aa, Artificial Sequence
  source: /note="Description of Artificial Sequence: Synthetic peptide"
FTLIHSLLRK

SEQ ID NO: 20256 - protein, 10 aa, Artificial Sequence
  source: /note="Description of Artificial Sequence: Synthetic peptide"
QPPFTLIHSL

SEQ ID NO: 20257 - protein, 10 aa, Artificial Sequence
  source: /note="Description of Artificial Sequence: Synthetic peptide"
LIHSLLRKVL

SEQ ID NO: 20258 - protein, 9 aa, Artificial Sequence
  source: /note="Description of Artificial Sequence: Synthetic peptide"
YLRKIWVDV

SEQ ID NO: 20259 - protein, 9 aa, Artificial Sequence
  source: /note="Description of Artificial Sequence: Synthetic peptide"
IWVDVKGIF

SEQ ID NO: 20260 - protein, 9 aa, Artificial Sequence
  source: /note="Description of Artificial Sequence: Synthetic peptide"
CPYLRKIWV

SEQ ID NO: 20261 - protein, 10 aa, Artificial Sequence
  source: /note="Description of Artificial Sequence: Synthetic peptide"
YLRKIWVDVK

SEQ ID NO: 20262 - protein, 10 aa, Artificial Sequence
  source: /note="Description of Artificial Sequence: Synthetic peptide"
PYLRKIWVDV

SEQ ID NO: 20263 - protein, 10 aa, Artificial Sequence
  source: /note="Description of Artificial Sequence: Synthetic peptide"
WVDVKGIFPR

SEQ ID NO: 20264 - protein, 10 aa, Artificial Sequence
  source: /note="Description of Artificial Sequence: Synthetic peptide"
RKIWVDVKGI

SEQ ID NO: 20265 - protein, 10 aa, Artificial Sequence
  source: /note="Description of Artificial Sequence: Synthetic peptide"
KIWVDVKGIF

SEQ ID NO: 20266 - protein, 9 aa, Artificial Sequence
  source: /note="Description of Artificial Sequence: Synthetic peptide"
EEGGEEPNY

SEQ ID NO: 20267 - protein, 10 aa, Artificial Sequence
  source: /note="Description of Artificial Sequence: Synthetic peptide"
EEEGGEEPNY

SEQ ID NO: 20268 - protein, 10 aa, Artificial Sequence
  source: /note="Description of Artificial Sequence: Synthetic peptide"
KKYRGKCEPT

SEQ ID NO: 20269 - protein, 9 aa, Artificial Sequence
  source: /note="Description of Artificial Sequence: Synthetic peptide"
QVAEASPLL

SEQ ID NO: 20270 - protein, 9 aa, Artificial Sequence
  source: /note="Description of Artificial Sequence: Synthetic peptide"
EASPLLLLL

SEQ ID NO: 20271 - protein, 9 aa, Artificial Sequence
  source: /note="Description of Artificial Sequence: Synthetic peptide"
GQVAEASPL

SEQ ID NO: 20272 - protein, 9 aa, Artificial Sequence
  source: /note="Description of Artificial Sequence: Synthetic peptide"
AEASPLLLL

SEQ ID NO: 20273 - protein, 10 aa, Artificial Sequence
  source: /note="Description of Artificial Sequence: Synthetic peptide"
QVAEASPLLL

SEQ ID NO: 20274 - protein, 10 aa, Artificial Sequence
  source: /note="Description of Artificial Sequence: Synthetic peptide"
EASPLLLLLL

SEQ ID NO: 20275 - protein, 10 aa, Artificial Sequence
  source: /note="Description of Artificial Sequence: Synthetic peptide"
GQVAEASPLL

SEQ ID NO: 20276 - protein, 10 aa, Artificial Sequence
  source: /note="Description of Artificial Sequence: Synthetic peptide"
AEASPLLLLL

SEQ ID NO: 20277 - protein, 9 aa, Artificial Sequence
  source: /note="Description of Artificial Sequence: Synthetic peptide"
QVAAESPLL

SEQ ID NO: 20278 - protein, 9 aa, Artificial Sequence
  source: /note="Description of Artificial Sequence: Synthetic peptide"
GQVAAESPL

SEQ ID NO: 20279 - protein, 9 aa, Artificial Sequence
  source: /note="Description of Artificial Sequence: Synthetic peptide"
VAAESPLLL

SEQ ID NO: 20280 - protein, 9 aa, Artificial Sequence
  source: /note="Description of Artificial Sequence: Synthetic peptide"
AESPLLLLL

SEQ ID NO: 20281 - protein, 10 aa, Artificial Sequence
  source: /note="Description of Artificial Sequence: Synthetic peptide"
QVAAESPLLL

SEQ ID NO: 20282 - protein, 10 aa, Artificial Sequence
  source: /note="Description of Artificial Sequence: Synthetic peptide"
GQVAAESPLL

SEQ ID NO: 20283 - protein, 10 aa, Artificial Sequence
  source: /note="Description of Artificial Sequence: Synthetic peptide"
VAAESPLLLL

SEQ ID NO: 20284 - protein, 10 aa, Artificial Sequence
  source: /note="Description of Artificial Sequence: Synthetic peptide"
AESPLLLLLL

SEQ ID NO: 20285 - protein, 9 aa, Artificial Sequence
  source: /note="Description of Artificial Sequence: Synthetic peptide"
YTIKWFEVI

SEQ ID NO: 20286 - protein, 9 aa, Artificial Sequence
  source: /note="Description of Artificial Sequence: Synthetic peptide"
GYTIKWFEV

SEQ ID NO: 20287 - protein, 9 aa, Artificial Sequence
  source: /note="Description of Artificial Sequence: Synthetic peptide"
KEAGYTIKW

SEQ ID NO: 20288 - protein, 10 aa, Artificial Sequence
  source: /note="Description of Artificial Sequence: Synthetic peptide"
AVKEAGYTIK

SEQ ID NO: 20289 - protein, 10 aa, Artificial Sequence
  source: /note="Description of Artificial Sequence: Synthetic peptide"
GYTIKWFEVI

SEQ ID NO: 20290 - protein, 10 aa, Artificial Sequence
  source: /note="Description of Artificial Sequence: Synthetic peptide"
KWFEVISQSY

SEQ ID NO: 20291 - protein, 10 aa, Artificial Sequence
  source: /note="Description of Artificial Sequence: Synthetic peptide"
KEAGYTIKWF

SEQ ID NO: 20292 - protein, 9 aa, Artificial Sequence
  source: /note="Description of Artificial Sequence: Synthetic peptide"
WRLLQAQAA

SEQ ID NO: 20293 - protein, 10 aa, Artificial Sequence
  source: /note="Description of Artificial Sequence: Synthetic peptide"
RWRLLQAQAA

SEQ ID NO: 20294 - protein, 9 aa, Artificial Sequence
  source: /note="Description of Artificial Sequence: Synthetic peptide"
LMRKADSSS

SEQ ID NO: 20295 - protein, 10 aa, Artificial Sequence
  source: /note="Description of Artificial Sequence: Synthetic peptide"
LMRKADSSSS

SEQ ID NO: 20296 - protein, 9 aa, Artificial Sequence
  source: /note="Description of Artificial Sequence: Synthetic peptide"
RMKGRGGRG

SEQ ID NO: 20297 - protein, 9 aa, Artificial Sequence
  source: /note="Description of Artificial Sequence: Synthetic peptide"
KGRGGRGPR

SEQ ID NO: 20298 - protein, 10 aa, Artificial Sequence
  source: /note="Description of Artificial Sequence: Synthetic peptide"
QGRVVRMKGR

SEQ ID NO: 20299 - protein, 10 aa, Artificial Sequence
  source: /note="Description of Artificial Sequence: Synthetic peptide"
VVRMKGRGGR

SEQ ID NO: 20300 - protein, 10 aa, Artificial Sequence
  source: /note="Description of Artificial Sequence: Synthetic peptide"
KGRGGRGPRR

SEQ ID NO: 20301 - protein, 9 aa, Artificial Sequence
  source: /note="Description of Artificial Sequence: Synthetic peptide"
LQQQQQTQV

SEQ ID NO: 20302 - protein, 10 aa, Artificial Sequence
  source: /note="Description of Artificial Sequence: Synthetic peptide"
LLQQQQQTQV

SEQ ID NO: 20303 - protein, 10 aa, Artificial Sequence
  source: /note="Description of Artificial Sequence: Synthetic peptide"
LQQQQQTQVA

SEQ ID NO: 20304 - protein, 9 aa, Artificial Sequence
  source: /note="Description of Artificial Sequence: Synthetic peptide"
HPFLTPSRV

SEQ ID NO: 20305 - protein, 9 aa, Artificial Sequence
  source: /note="Description of Artificial Sequence: Synthetic peptide"
ALRRSAVGA

SEQ ID NO: 20306 - protein, 9 aa, Artificial Sequence
  source: /note="Description of Artificial Sequence: Synthetic peptide"
AAGALAVLR

SEQ ID NO: 20307 - protein, 9 aa, Artificial Sequence
  source: /note="Description of Artificial Sequence: Synthetic peptide"
RSAVGAAGA

SEQ ID NO: 20308 - protein, 9 aa, Artificial Sequence
  source: /note="Description of Artificial Sequence: Synthetic peptide"
VLRGPRACI

SEQ ID NO: 20309 - protein, 9 aa, Artificial Sequence
  source: /note="Description of Artificial Sequence: Synthetic peptide"
ALAVLRGPR

SEQ ID NO: 20310 - protein, 9 aa, Artificial Sequence
  source: /note="Description of Artificial Sequence: Synthetic peptide"
MPALRRSAV

SEQ ID NO: 20311 - protein, 9 aa, Artificial Sequence
  source: /note="Description of Artificial Sequence: Synthetic peptide"
SAVGAAGAL

SEQ ID NO: 20312 - protein, 9 aa, Artificial Sequence
  source: /note="Description of Artificial Sequence: Synthetic peptide"
LRRSAVGAA

SEQ ID NO: 20313 - protein, 9 aa, Artificial Sequence
  source: /note="Description of Artificial Sequence: Synthetic peptide"
GAAGALAVL

SEQ ID NO: 20314 - protein, 9 aa, Artificial Sequence
  source: /note="Description of Artificial Sequence: Synthetic peptide"
RACIAVSRW

SEQ ID NO: 20315 - protein, 10 aa, Artificial Sequence
  source: /note="Description of Artificial Sequence: Synthetic peptide"
ALRRSAVGAA

SEQ ID NO: 20316 - protein, 10 aa, Artificial Sequence
  source: /note="Description of Artificial Sequence: Synthetic peptide"
AVGAAGALAV

SEQ ID NO: 20317 - protein, 10 aa, Artificial Sequence
  source: /note="Description of Artificial Sequence: Synthetic peptide"
ALAVLRGPRA

SEQ ID NO: 20318 - protein, 10 aa, Artificial Sequence
  source: /note="Description of Artificial Sequence: Synthetic peptide"
RSAVGAAGAL

SEQ ID NO: 20319 - protein, 10 aa, Artificial Sequence
  source: /note="Description of Artificial Sequence: Synthetic peptide"
GALAVLRGPR

SEQ ID NO: 20320 - protein, 10 aa, Artificial Sequence
  source: /note="Description of Artificial Sequence: Synthetic peptide"
VLRGPRACIA

SEQ ID NO: 20321 - protein, 10 aa, Artificial Sequence
  source: /note="Description of Artificial Sequence: Synthetic peptide"
RACIAVSRWL

SEQ ID NO: 20322 - protein, 10 aa, Artificial Sequence
  source: /note="Description of Artificial Sequence: Synthetic peptide"
MPALRRSAVG

SEQ ID NO: 20323 - protein, 10 aa, Artificial Sequence
  source: /note="Description of Artificial Sequence: Synthetic peptide"
VGAAGALAVL

SEQ ID NO: 20324 - protein, 9 aa, Artificial Sequence
  source: /note="Description of Artificial Sequence: Synthetic peptide"
LLALWLCWA

SEQ ID NO: 20325 - protein, 9 aa, Artificial Sequence
  source: /note="Description of Artificial Sequence: Synthetic peptide"
CWAAPAHAL

SEQ ID NO: 20326 - protein, 9 aa, Artificial Sequence
  source: /note="Description of Artificial Sequence: Synthetic peptide"
ALLALWLCW

SEQ ID NO: 20327 - protein, 9 aa, Artificial Sequence
  source: /note="Description of Artificial Sequence: Synthetic peptide"
WLCWAAPAH

SEQ ID NO: 20328 - protein, 10 aa, Artificial Sequence
  source: /note="Description of Artificial Sequence: Synthetic peptide"
ALLALWLCWA

SEQ ID NO: 20329 - protein, 10 aa, Artificial Sequence
  source: /note="Description of Artificial Sequence: Synthetic peptide"
LLALWLCWAA

SEQ ID NO: 20330 - protein, 10 aa, Artificial Sequence
  source: /note="Description of Artificial Sequence: Synthetic peptide"
ALWLCWAAPA

SEQ ID NO: 20331 - protein, 10 aa, Artificial Sequence
  source: /note="Description of Artificial Sequence: Synthetic peptide"
WLCWAAPAHA

SEQ ID NO: 20332 - protein, 10 aa, Artificial Sequence
  source: /note="Description of Artificial Sequence: Synthetic peptide"
WALLALWLCW

SEQ ID NO: 20333 - protein, 10 aa, Artificial Sequence
  source: /note="Description of Artificial Sequence: Synthetic peptide"
LCWAAPAHAL

SEQ ID NO: 20334 - protein, 9 aa, Artificial Sequence
  source: /note="Description of Artificial Sequence: Synthetic peptide"
KSRLPSAKS

SEQ ID NO: 20335 - protein, 9 aa, Artificial Sequence
  source: /note="Description of Artificial Sequence: Synthetic peptide"
TPMGKKSRL

SEQ ID NO: 20336 - protein, 9 aa, Artificial Sequence
  source: /note="Description of Artificial Sequence: Synthetic peptide"
RLPSAKSTM

SEQ ID NO: 20337 - protein, 10 aa, Artificial Sequence
  source: /note="Description of Artificial Sequence: Synthetic peptide"
MGKKSRLPSA

SEQ ID NO: 20338 - protein, 10 aa, Artificial Sequence
  source: /note="Description of Artificial Sequence: Synthetic peptide"
KSRLPSAKST

SEQ ID NO: 20339 - protein, 10 aa, Artificial Sequence
  source: /note="Description of Artificial Sequence: Synthetic peptide"
LPSAKSTMPT

SEQ ID NO: 20340 - protein, 10 aa, Artificial Sequence
  source: /note="Description of Artificial Sequence: Synthetic peptide"
SRLPSAKSTM

SEQ ID NO: 20341 - protein, 9 aa, Artificial Sequence
  source: /note="Description of Artificial Sequence: Synthetic peptide"
HITTPWEPL

SEQ ID NO: 20342 - protein, 9 aa, Artificial Sequence
  source: /note="Description of Artificial Sequence: Synthetic peptide"
TPWEPLPPI

SEQ ID NO: 20343 - protein, 9 aa, Artificial Sequence
  source: /note="Description of Artificial Sequence: Synthetic peptide"
WEPLPPIVT

SEQ ID NO: 20344 - protein, 10 aa, Artificial Sequence
  source: /note="Description of Artificial Sequence: Synthetic peptide"
TTPWEPLPPI

SEQ ID NO: 20345 - protein, 10 aa, Artificial Sequence
  source: /note="Description of Artificial Sequence: Synthetic peptide"
KHITTPWEPL

SEQ ID NO: 20346 - protein, 10 aa, Artificial Sequence
  source: /note="Description of Artificial Sequence: Synthetic peptide"
WEPLPPIVTF

SEQ ID NO: 20347 - protein, 10 aa, Artificial Sequence
  source: /note="Description of Artificial Sequence: Synthetic peptide"
TPWEPLPPIV

SEQ ID NO: 20348 - protein, 9 aa, Artificial Sequence
  source: /note="Description of Artificial Sequence: Synthetic peptide"
RSHSLRCSS

SEQ ID NO: 20349 - protein, 9 aa, Artificial Sequence
  source: /note="Description of Artificial Sequence: Synthetic peptide"
SLRCSSEIY

SEQ ID NO: 20350 - protein, 9 aa, Artificial Sequence
  source: /note="Description of Artificial Sequence: Synthetic peptide"
VFHYPVCVR

SEQ ID NO: 20351 - protein, 9 aa, Artificial Sequence
  source: /note="Description of Artificial Sequence: Synthetic peptide"
HSLRCSSEI

SEQ ID NO: 20352 - protein, 9 aa, Artificial Sequence
  source: /note="Description of Artificial Sequence: Synthetic peptide"
LRCSSEIYM

SEQ ID NO: 20353 - protein, 10 aa, Artificial Sequence
  source: /note="Description of Artificial Sequence: Synthetic peptide"
SLRCSSEIYM

SEQ ID NO: 20354 - protein, 10 aa, Artificial Sequence
  source: /note="Description of Artificial Sequence: Synthetic peptide"
CVRCRGDRSH

SEQ ID NO: 20355 - protein, 10 aa, Artificial Sequence
  source: /note="Description of Artificial Sequence: Synthetic peptide"
RSHSLRCSSE

SEQ ID NO: 20356 - protein, 10 aa, Artificial Sequence
  source: /note="Description of Artificial Sequence: Synthetic peptide"
HSLRCSSEIY

SEQ ID NO: 20357 - protein, 10 aa, Artificial Sequence
  source: /note="Description of Artificial Sequence: Synthetic peptide"
DVFHYPVCVR

SEQ ID NO: 20358 - protein, 10 aa, Artificial Sequence
  source: /note="Description of Artificial Sequence: Synthetic peptide"
RCRGDRSHSL

SEQ ID NO: 20359 - protein, 10 aa, Artificial Sequence
  source: /note="Description of Artificial Sequence: Synthetic peptide"
CSSEIYMVQM

SEQ ID NO: 20360 - protein, 9 aa, Artificial Sequence
  source: /note="Description of Artificial Sequence: Synthetic peptide"
FTIDLVTTC

SEQ ID NO: 20361 - protein, 9 aa, Artificial Sequence
  source: /note="Description of Artificial Sequence: Synthetic peptide"
RPPFFTIDL

SEQ ID NO: 20362 - protein, 9 aa, Artificial Sequence
  source: /note="Description of Artificial Sequence: Synthetic peptide"
IKRPPFFTI

SEQ ID NO: 20363 - protein, 9 aa, Artificial Sequence
  source: /note="Description of Artificial Sequence: Synthetic peptide"
PPFFTIDLV

SEQ ID NO: 20364 - protein, 10 aa, Artificial Sequence
  source: /note="Description of Artificial Sequence: Synthetic peptide"
LLIKRPPFFT

SEQ ID NO: 20365 - protein, 10 aa, Artificial Sequence
  source: /note="Description of Artificial Sequence: Synthetic peptide"
FTIDLVTTCI

SEQ ID NO: 20366 - protein, 10 aa, Artificial Sequence
  source: /note="Description of Artificial Sequence: Synthetic peptide"
LIKRPPFFTI

SEQ ID NO: 20367 - protein, 9 aa, Artificial Sequence
  source: /note="Description of Artificial Sequence: Synthetic peptide"
SLGELVRAW

SEQ ID NO: 20368 - protein, 9 aa, Artificial Sequence
  source: /note="Description of Artificial Sequence: Synthetic peptide"
GELVRAWHL

SEQ ID NO: 20369 - protein, 10 aa, Artificial Sequence
  source: /note="Description of Artificial Sequence: Synthetic peptide"
ELVRAWHLGA

SEQ ID NO: 20370 - protein, 10 aa, Artificial Sequence
  source: /note="Description of Artificial Sequence: Synthetic peptide"
ASLGELVRAW

SEQ ID NO: 20371 - protein, 10 aa, Artificial Sequence
  source: /note="Description of Artificial Sequence: Synthetic peptide"
GELVRAWHLG

SEQ ID NO: 20372 - protein, 9 aa, Artificial Sequence
  source: /note="Description of Artificial Sequence: Synthetic peptide"
FSARGSPGA

SEQ ID NO: 20373 - protein, 9 aa, Artificial Sequence
  source: /note="Description of Artificial Sequence: Synthetic peptide"
LVRRQRHLR

SEQ ID NO: 20374 - protein, 9 aa, Artificial Sequence
  source: /note="Description of Artificial Sequence: Synthetic peptide"
RQRHLRAQE

SEQ ID NO: 20375 - protein, 9 aa, Artificial Sequence
  source: /note="Description of Artificial Sequence: Synthetic peptide"
HLRAQELGR

SEQ ID NO: 20376 - protein, 9 aa, Artificial Sequence
  source: /note="Description of Artificial Sequence: Synthetic peptide"
CLLCALVRR

SEQ ID NO: 20377 - protein, 9 aa, Artificial Sequence
  source: /note="Description of Artificial Sequence: Synthetic peptide"
NVCLLCALV

SEQ ID NO: 20378 - protein, 9 aa, Artificial Sequence
  source: /note="Description of Artificial Sequence: Synthetic peptide"
LPGGGGPAA

SEQ ID NO: 20379 - protein, 9 aa, Artificial Sequence
  source: /note="Description of Artificial Sequence: Synthetic peptide"
ALVRRQRHL

SEQ ID NO: 20380 - protein, 9 aa, Artificial Sequence
  source: /note="Description of Artificial Sequence: Synthetic peptide"
QRHLRAQEL

SEQ ID NO: 20381 - protein, 9 aa, Artificial Sequence
  source: /note="Description of Artificial Sequence: Synthetic peptide"
MAGPPIPSF

SEQ ID NO: 20382 - protein, 9 aa, Artificial Sequence
  source: /note="Description of Artificial Sequence: Synthetic peptide"
QEAPNVCLL

SEQ ID NO: 20383 - protein, 9 aa, Artificial Sequence
  source: /note="Description of Artificial Sequence: Synthetic peptide"
AQELGRIQA

SEQ ID NO: 20384 - protein, 9 aa, Artificial Sequence
  source: /note="Description of Artificial Sequence: Synthetic peptide"
QELGRIQAA

SEQ ID NO: 20385 - protein, 10 aa, Artificial Sequence
  source: /note="Description of Artificial Sequence: Synthetic peptide"
HLRAQELGRI

SEQ ID NO: 20386 - protein, 10 aa, Artificial Sequence
  source: /note="Description of Artificial Sequence: Synthetic peptide"
SFSARGSPGA

SEQ ID NO: 20387 - protein, 10 aa, Artificial Sequence
  source: /note="Description of Artificial Sequence: Synthetic peptide"
LVRRQRHLRA

SEQ ID NO: 20388 - protein, 10 aa, Artificial Sequence
  source: /note="Description of Artificial Sequence: Synthetic peptide"
RQRHLRAQEL

SEQ ID NO: 20389 - protein, 10 aa, Artificial Sequence
  source: /note="Description of Artificial Sequence: Synthetic peptide"
RAQELGRIQA

SEQ ID NO: 20390 - protein, 10 aa, Artificial Sequence
  source: /note="Description of Artificial Sequence: Synthetic peptide"
NVCLLCALVR

SEQ ID NO: 20391 - protein, 10 aa, Artificial Sequence
  source: /note="Description of Artificial Sequence: Synthetic peptide"
LLCALVRRQR

SEQ ID NO: 20392 - protein, 10 aa, Artificial Sequence
  source: /note="Description of Artificial Sequence: Synthetic peptide"
ALVRRQRHLR

SEQ ID NO: 20393 - protein, 10 aa, Artificial Sequence
  source: /note="Description of Artificial Sequence: Synthetic peptide"
APNVCLLCAL

SEQ ID NO: 20394 - protein, 10 aa, Artificial Sequence
  source: /note="Description of Artificial Sequence: Synthetic peptide"
CALVRRQRHL

SEQ ID NO: 20395 - protein, 10 aa, Artificial Sequence
  source: /note="Description of Artificial Sequence: Synthetic peptide"
AQELGRIQAA

SEQ ID NO: 20396 - protein, 9 aa, Artificial Sequence
  source: /note="Description of Artificial Sequence: Synthetic peptide"
NLLNFLPER

SEQ ID NO: 20397 - protein, 9 aa, Artificial Sequence
  source: /note="Description of Artificial Sequence: Synthetic peptide"
PEREHSEVY

SEQ ID NO: 20398 - protein, 9 aa, Artificial Sequence
  source: /note="Description of Artificial Sequence: Synthetic peptide"
REHSEVYKI

SEQ ID NO: 20399 - protein, 9 aa, Artificial Sequence
  source: /note="Description of Artificial Sequence: Synthetic peptide"
LPEREHSEV

SEQ ID NO: 20400 - protein, 10 aa, Artificial Sequence
  source: /note="Description of Artificial Sequence: Synthetic peptide"
FLPEREHSEV

SEQ ID NO: 20401 - protein, 10 aa, Artificial Sequence
  source: /note="Description of Artificial Sequence: Synthetic peptide"
LPEREHSEVY

SEQ ID NO: 20402 - protein, 10 aa, Artificial Sequence
  source: /note="Description of Artificial Sequence: Synthetic peptide"
REHSEVYKIL

SEQ ID NO: 20403 - protein, 9 aa, Artificial Sequence
  source: /note="Description of Artificial Sequence: Synthetic peptide"
AIKNITASY

SEQ ID NO: 20404 - protein, 9 aa, Artificial Sequence
  source: /note="Description of Artificial Sequence: Synthetic peptide"
LQIAIKNIT

SEQ ID NO: 20405 - protein, 10 aa, Artificial Sequence
  source: /note="Description of Artificial Sequence: Synthetic peptide"
QVLDLQIAIK

SEQ ID NO: 20406 - protein, 10 aa, Artificial Sequence
  source: /note="Description of Artificial Sequence: Synthetic peptide"
IAIKNITASY

SEQ ID NO: 20407 - protein, 10 aa, Artificial Sequence
  source: /note="Description of Artificial Sequence: Synthetic peptide"
LQIAIKNITA

SEQ ID NO: 20408 - protein, 9 aa, Artificial Sequence
  source: /note="Description of Artificial Sequence: Synthetic peptide"
LKTPSELSV

SEQ ID NO: 20409 - protein, 9 aa, Artificial Sequence
  source: /note="Description of Artificial Sequence: Synthetic peptide"
SELSVHSPS

SEQ ID NO: 20410 - protein, 9 aa, Artificial Sequence
  source: /note="Description of Artificial Sequence: Synthetic peptide"
LSVHSPSTL

SEQ ID NO: 20411 - protein, 10 aa, Artificial Sequence
  source: /note="Description of Artificial Sequence: Synthetic peptide"
SLKTPSELSV

SEQ ID NO: 20412 - protein, 10 aa, Artificial Sequence
  source: /note="Description of Artificial Sequence: Synthetic peptide"
LKTPSELSVH

SEQ ID NO: 20413 - protein, 10 aa, Artificial Sequence
  source: /note="Description of Artificial Sequence: Synthetic peptide"
SELSVHSPST

SEQ ID NO: 20414 - protein, 9 aa, Artificial Sequence
  source: /note="Description of Artificial Sequence: Synthetic peptide"
AIQDLCLAV

SEQ ID NO: 20415 - protein, 9 aa, Artificial Sequence
  source: /note="Description of Artificial Sequence: Synthetic peptide"
AVEEVSLRK

SEQ ID NO: 20416 - protein, 9 aa, Artificial Sequence
  source: /note="Description of Artificial Sequence: Synthetic peptide"
EAIQDLCLA

SEQ ID NO: 20417 - protein, 9 aa, Artificial Sequence
  source: /note="Description of Artificial Sequence: Synthetic peptide"
QEAIQDLCL

SEQ ID NO: 20418 - protein, 10 aa, Artificial Sequence
  source: /note="Description of Artificial Sequence: Synthetic peptide"
LAVEEVSLRK

SEQ ID NO: 20419 - protein, 10 aa, Artificial Sequence
  source: /note="Description of Artificial Sequence: Synthetic peptide"
EAIQDLCLAV

SEQ ID NO: 20420 - protein, 10 aa, Artificial Sequence
  source: /note="Description of Artificial Sequence: Synthetic peptide"
QEAIQDLCLA

SEQ ID NO: 20421 - protein, 9 aa, Artificial Sequence
  source: /note="Description of Artificial Sequence: Synthetic peptide"
AIQDLLLAV

SEQ ID NO: 20422 - protein, 9 aa, Artificial Sequence
  source: /note="Description of Artificial Sequence: Synthetic peptide"
LLAVEEVSL

SEQ ID NO: 20423 - protein, 9 aa, Artificial Sequence
  source: /note="Description of Artificial Sequence: Synthetic peptide"
AVEEVSLRK

SEQ ID NO: 20424 - protein, 9 aa, Artificial Sequence
  source: /note="Description of Artificial Sequence: Synthetic peptide"
EAIQDLLLA

SEQ ID NO: 20425 - protein, 9 aa, Artificial Sequence
  source: /note="Description of Artificial Sequence: Synthetic peptide"
QEAIQDLLL

SEQ ID NO: 20426 - protein, 10 aa, Artificial Sequence
  source: /note="Description of Artificial Sequence: Synthetic peptide"
LLLAVEEVSL

SEQ ID NO: 20427 - protein, 10 aa, Artificial Sequence
  source: /note="Description of Artificial Sequence: Synthetic peptide"
LAVEEVSLRK

SEQ ID NO: 20428 - protein, 10 aa, Artificial Sequence
  source: /note="Description of Artificial Sequence: Synthetic peptide"
EAIQDLLLAV

SEQ ID NO: 20429 - protein, 10 aa, Artificial Sequence
  source: /note="Description of Artificial Sequence: Synthetic peptide"
QEAIQDLLLA

SEQ ID NO: 20430 - protein, 9 aa, Artificial Sequence
  source: /note="Description of Artificial Sequence: Synthetic peptide"
AIQDLCLAV

SEQ ID NO: 20431 - protein, 9 aa, Artificial Sequence
  source: /note="Description of Artificial Sequence: Synthetic peptide"
AVEEVSLRK

SEQ ID NO: 20432 - protein, 9 aa, Artificial Sequence
  source: /note="Description of Artificial Sequence: Synthetic peptide"
EAIQDLCLA

SEQ ID NO: 20433 - protein, 9 aa, Artificial Sequence
  source: /note="Description of Artificial Sequence: Synthetic peptide"
QEAIQDLCL

SEQ ID NO: 20434 - protein, 10 aa, Artificial Sequence
  source: /note="Description of Artificial Sequence: Synthetic peptide"
LAVEEVSLRK

SEQ ID NO: 20435 - protein, 10 aa, Artificial Sequence
  source: /note="Description of Artificial Sequence: Synthetic peptide"
EAIQDLCLAV

SEQ ID NO: 20436 - protein, 10 aa, Artificial Sequence
  source: /note="Description of Artificial Sequence: Synthetic peptide"
QEAIQDLCLA

SEQ ID NO: 20437 - protein, 9 aa, Artificial Sequence
  source: /note="Description of Artificial Sequence: Synthetic peptide"
ILGPVCEHA

SEQ ID NO: 20438 - protein, 9 aa, Artificial Sequence
  source: /note="Description of Artificial Sequence: Synthetic peptide"
HAAAPVARL

SEQ ID NO: 20439 - protein, 9 aa, Artificial Sequence
  source: /note="Description of Artificial Sequence: Synthetic peptide"
CEHAAAPVA

SEQ ID NO: 20440 - protein, 9 aa, Artificial Sequence
  source: /note="Description of Artificial Sequence: Synthetic peptide"
GPVCEHAAA

SEQ ID NO: 20441 - protein, 10 aa, Artificial Sequence
  source: /note="Description of Artificial Sequence: Synthetic peptide"
ILGPVCEHAA

SEQ ID NO: 20442 - protein, 10 aa, Artificial Sequence
  source: /note="Description of Artificial Sequence: Synthetic peptide"
HAAAPVARLA

SEQ ID NO: 20443 - protein, 9 aa, Artificial Sequence
  source: /note="Description of Artificial Sequence: Synthetic peptide"
IMYGIVIQT

SEQ ID NO: 20444 - protein, 9 aa, Artificial Sequence
  source: /note="Description of Artificial Sequence: Synthetic peptide"
IVIQTIWIK

SEQ ID NO: 20445 - protein, 9 aa, Artificial Sequence
  source: /note="Description of Artificial Sequence: Synthetic peptide"
MYGIVIQTI

SEQ ID NO: 20446 - protein, 9 aa, Artificial Sequence
  source: /note="Description of Artificial Sequence: Synthetic peptide"
QTIWIKSKT

SEQ ID NO: 20447 - protein, 9 aa, Artificial Sequence
  source: /note="Description of Artificial Sequence: Synthetic peptide"
YGIVIQTIW

SEQ ID NO: 20448 - protein, 10 aa, Artificial Sequence
  source: /note="Description of Artificial Sequence: Synthetic peptide"
IMYGIVIQTI

SEQ ID NO: 20449 - protein, 10 aa, Artificial Sequence
  source: /note="Description of Artificial Sequence: Synthetic peptide"
SIMYGIVIQT

SEQ ID NO: 20450 - protein, 10 aa, Artificial Sequence
  source: /note="Description of Artificial Sequence: Synthetic peptide"
VIQTIWIKSK

SEQ ID NO: 20451 - protein, 10 aa, Artificial Sequence
  source: /note="Description of Artificial Sequence: Synthetic peptide"
GIVIQTIWIK

SEQ ID NO: 20452 - protein, 10 aa, Artificial Sequence
  source: /note="Description of Artificial Sequence: Synthetic peptide"
MYGIVIQTIW

SEQ ID NO: 20453 - protein, 10 aa, Artificial Sequence
  source: /note="Description of Artificial Sequence: Synthetic peptide"
QTIWIKSKTY

SEQ ID NO: 20454 - protein, 9 aa, Artificial Sequence
  source: /note="Description of Artificial Sequence: Synthetic peptide"
LKSSTTPGV

SEQ ID NO: 20455 - protein, 10 aa, Artificial Sequence
  source: /note="Description of Artificial Sequence: Synthetic peptide"
WLKSSTTPGV

SEQ ID NO: 20456 - protein, 10 aa, Artificial Sequence
  source: /note="Description of Artificial Sequence: Synthetic peptide"
STTPGVGTPF

SEQ ID NO: 20457 - protein, 9 aa, Artificial Sequence
  source: /note="Description of Artificial Sequence: Synthetic peptide"
KQASPVTFK

SEQ ID NO: 20458 - protein, 9 aa, Artificial Sequence
  source: /note="Description of Artificial Sequence: Synthetic peptide"
QASPVTFKK

SEQ ID NO: 20459 - protein, 9 aa, Artificial Sequence
  source: /note="Description of Artificial Sequence: Synthetic peptide"
LKQASPVTF

SEQ ID NO: 20460 - protein, 10 aa, Artificial Sequence
  source: /note="Description of Artificial Sequence: Synthetic peptide"
KQASPVTFKK

SEQ ID NO: 20461 - protein, 10 aa, Artificial Sequence
  source: /note="Description of Artificial Sequence: Synthetic peptide"
SLKQASPVTF

SEQ ID NO: 20462 - protein, 9 aa, Artificial Sequence
  source: /note="Description of Artificial Sequence: Synthetic peptide"
AESCQGDLI

SEQ ID NO: 20463 - protein, 10 aa, Artificial Sequence
  source: /note="Description of Artificial Sequence: Synthetic peptide"
ITLANVVTSL

SEQ ID NO: 20464 - protein, 10 aa, Artificial Sequence
  source: /note="Description of Artificial Sequence: Synthetic peptide"
GDLITLANVV

SEQ ID NO: 20465 - protein, 10 aa, Artificial Sequence
  source: /note="Description of Artificial Sequence: Synthetic peptide"
AESCQGDLIT

SEQ ID NO: 20466 - protein, 9 aa, Artificial Sequence
  source: /note="Description of Artificial Sequence: Synthetic peptide"
RNLCQYCRF

SEQ ID NO: 20467 - protein, 9 aa, Artificial Sequence
  source: /note="Description of Artificial Sequence: Synthetic peptide"
KRRRNLCQY

SEQ ID NO: 20468 - protein, 10 aa, Artificial Sequence
  source: /note="Description of Artificial Sequence: Synthetic peptide"
NLCQYCRFQK

SEQ ID NO: 20469 - protein, 10 aa, Artificial Sequence
  source: /note="Description of Artificial Sequence: Synthetic peptide"
CPVDKRRRNL

SEQ ID NO: 20470 - protein, 10 aa, Artificial Sequence
  source: /note="Description of Artificial Sequence: Synthetic peptide"
RRNLCQYCRF

SEQ ID NO: 20471 - protein, 9 aa, Artificial Sequence
  source: /note="Description of Artificial Sequence: Synthetic peptide"
KMVNYSYDK

SEQ ID NO: 20472 - protein, 9 aa, Artificial Sequence
  source: /note="Description of Artificial Sequence: Synthetic peptide"
KDLEELCPV

SEQ ID NO: 20473 - protein, 10 aa, Artificial Sequence
  source: /note="Description of Artificial Sequence: Synthetic peptide"
YSYDKDLEEL

SEQ ID NO: 20474 - protein, 9 aa, Artificial Sequence
  source: /note="Description of Artificial Sequence: Synthetic peptide"
YQNAKKAHK

SEQ ID NO: 20475 - protein, 9 aa, Artificial Sequence
  source: /note="Description of Artificial Sequence: Synthetic peptide"
KAHKLASDI

SEQ ID NO: 20476 - protein, 9 aa, Artificial Sequence
  source: /note="Description of Artificial Sequence: Synthetic peptide"
KLASDIKYR

SEQ ID NO: 20477 - protein, 9 aa, Artificial Sequence
  source: /note="Description of Artificial Sequence: Synthetic peptide"
HKLASDIKY

SEQ ID NO: 20478 - protein, 10 aa, Artificial Sequence
  source: /note="Description of Artificial Sequence: Synthetic peptide"
YQNAKKAHKL

SEQ ID NO: 20479 - protein, 10 aa, Artificial Sequence
  source: /note="Description of Artificial Sequence: Synthetic peptide"
KAHKLASDIK

SEQ ID NO: 20480 - protein, 10 aa, Artificial Sequence
  source: /note="Description of Artificial Sequence: Synthetic peptide"
AYQNAKKAHK

SEQ ID NO: 20481 - protein, 10 aa, Artificial Sequence
  source: /note="Description of Artificial Sequence: Synthetic peptide"
KKAHKLASDI

SEQ ID NO: 20482 - protein, 10 aa, Artificial Sequence
  source: /note="Description of Artificial Sequence: Synthetic peptide"
AHKLASDIKY

SEQ ID NO: 20483 - protein, 9 aa, Artificial Sequence
  source: /note="Description of Artificial Sequence: Synthetic peptide"
LDTAGKEEY

SEQ ID NO: 20484 - protein, 9 aa, Artificial Sequence
  source: /note="Description of Artificial Sequence: Synthetic peptide"
AGKEEYSAM

SEQ ID NO: 20485 - protein, 10 aa, Artificial Sequence
  source: /note="Description of Artificial Sequence: Synthetic peptide"
ILDTAGKEEY

SEQ ID NO: 20486 - protein, 10 aa, Artificial Sequence
  source: /note="Description of Artificial Sequence: Synthetic peptide"
DTAGKEEYSA

SEQ ID NO: 20487 - protein, 9 aa, Artificial Sequence
  source: /note="Description of Artificial Sequence: Synthetic peptide"
LDTAGREEY

SEQ ID NO: 20488 - protein, 9 aa, Artificial Sequence
  source: /note="Description of Artificial Sequence: Synthetic peptide"
AGREEYSAM

SEQ ID NO: 20489 - protein, 10 aa, Artificial Sequence
  source: /note="Description of Artificial Sequence: Synthetic peptide"
ILDTAGREEY

SEQ ID NO: 20490 - protein, 10 aa, Artificial Sequence
  source: /note="Description of Artificial Sequence: Synthetic peptide"
AGREEYSAMR

SEQ ID NO: 20491 - protein, 10 aa, Artificial Sequence
  source: /note="Description of Artificial Sequence: Synthetic peptide"
DTAGREEYSA

SEQ ID NO: 20492 - protein, 9 aa, Artificial Sequence
  source: /note="Description of Artificial Sequence: Synthetic peptide"
LDTAGLEEY

SEQ ID NO: 20493 - protein, 9 aa, Artificial Sequence
  source: /note="Description of Artificial Sequence: Synthetic peptide"
AGLEEYSAM

SEQ ID NO: 20494 - protein, 10 aa, Artificial Sequence
  source: /note="Description of Artificial Sequence: Synthetic peptide"
ILDTAGLEEY

SEQ ID NO: 20495 - protein, 10 aa, Artificial Sequence
  source: /note="Description of Artificial Sequence: Synthetic peptide"
LLDILDTAGL

SEQ ID NO: 20496 - protein, 10 aa, Artificial Sequence
  source: /note="Description of Artificial Sequence: Synthetic peptide"
DTAGLEEYSA

SEQ ID NO: 20497 - protein, 9 aa, Artificial Sequence
  source: /note="Description of Artificial Sequence: Synthetic peptide"
LDTAGHEEY

SEQ ID NO: 20498 - protein, 9 aa, Artificial Sequence
  source: /note="Description of Artificial Sequence: Synthetic peptide"
AGHEEYSAM

SEQ ID NO: 20499 - protein, 10 aa, Artificial Sequence
  source: /note="Description of Artificial Sequence: Synthetic peptide"
ILDTAGHEEY

SEQ ID NO: 20500 - protein, 10 aa, Artificial Sequence
  source: /note="Description of Artificial Sequence: Synthetic peptide"
DTAGHEEYSA

SEQ ID NO: 20501 - protein, 9 aa, Artificial Sequence
  source: /note="Description of Artificial Sequence: Synthetic peptide"
LDTAGHEEY

SEQ ID NO: 20502 - protein, 9 aa, Artificial Sequence
  source: /note="Description of Artificial Sequence: Synthetic peptide"
AGHEEYSAM

SEQ ID NO: 20503 - protein, 10 aa, Artificial Sequence
  source: /note="Description of Artificial Sequence: Synthetic peptide"
ILDTAGHEEY

SEQ ID NO: 20504 - protein, 10 aa, Artificial Sequence
  source: /note="Description of Artificial Sequence: Synthetic peptide"
DTAGHEEYSA

SEQ ID NO: 20505 - protein, 9 aa, Artificial Sequence
  source: /note="Description of Artificial Sequence: Synthetic peptide"
LVVVGACGV

SEQ ID NO: 20506 - protein, 9 aa, Artificial Sequence
  source: /note="Description of Artificial Sequence: Synthetic peptide"
VVGACGVGK

SEQ ID NO: 20507 - protein, 10 aa, Artificial Sequence
  source: /note="Description of Artificial Sequence: Synthetic peptide"
KLVVVGACGV

SEQ ID NO: 20508 - protein, 10 aa, Artificial Sequence
  source: /note="Description of Artificial Sequence: Synthetic peptide"
VVVGACGVGK

SEQ ID NO: 20509 - protein, 9 aa, Artificial Sequence
  source: /note="Description of Artificial Sequence: Synthetic peptide"
LVVVGADGV

SEQ ID NO: 20510 - protein, 9 aa, Artificial Sequence
  source: /note="Description of Artificial Sequence: Synthetic peptide"
VVGADGVGK

SEQ ID NO: 20511 - protein, 10 aa, Artificial Sequence
  source: /note="Description of Artificial Sequence: Synthetic peptide"
KLVVVGADGV

SEQ ID NO: 20512 - protein, 10 aa, Artificial Sequence
  source: /note="Description of Artificial Sequence: Synthetic peptide"
VVVGADGVGK

SEQ ID NO: 20513 - protein, 9 aa, Artificial Sequence
  source: /note="Description of Artificial Sequence: Synthetic peptide"
VVGAGRVGK

SEQ ID NO: 20514 - protein, 9 aa, Artificial Sequence
  source: /note="Description of Artificial Sequence: Synthetic peptide"
RVGKSALTI

SEQ ID NO: 20515 - protein, 9 aa, Artificial Sequence
  source: /note="Description of Artificial Sequence: Synthetic peptide"
KLVVVGAGR

SEQ ID NO: 20516 - protein, 9 aa, Artificial Sequence
  source: /note="Description of Artificial Sequence: Synthetic peptide"
AGRVGKSAL

SEQ ID NO: 20517 - protein, 10 aa, Artificial Sequence
  source: /note="Description of Artificial Sequence: Synthetic peptide"
KLVVVGAGRV

SEQ ID NO: 20518 - protein, 10 aa, Artificial Sequence
  source: /note="Description of Artificial Sequence: Synthetic peptide"
VVVGAGRVGK

SEQ ID NO: 20519 - protein, 10 aa, Artificial Sequence
  source: /note="Description of Artificial Sequence: Synthetic peptide"
GRVGKSALTI

SEQ ID NO: 20520 - protein, 9 aa, Artificial Sequence
  source: /note="Description of Artificial Sequence: Synthetic peptide"
VVGAGDVGK

SEQ ID NO: 20521 - protein, 10 aa, Artificial Sequence
  source: /note="Description of Artificial Sequence: Synthetic peptide"
KLVVVGAGDV

SEQ ID NO: 20522 - protein, 10 aa, Artificial Sequence
  source: /note="Description of Artificial Sequence: Synthetic peptide"
VVVGAGDVGK

SEQ ID NO: 20523 - protein, 9 aa, Artificial Sequence
  source: /note="Description of Artificial Sequence: Synthetic peptide"
LLLLTPPRL

SEQ ID NO: 20524 - protein, 9 aa, Artificial Sequence
  source: /note="Description of Artificial Sequence: Synthetic peptide"
LTPPRLREK

SEQ ID NO: 20525 - protein, 9 aa, Artificial Sequence
  source: /note="Description of Artificial Sequence: Synthetic peptide"
LLLTPPRLR

SEQ ID NO: 20526 - protein, 9 aa, Artificial Sequence
  source: /note="Description of Artificial Sequence: Synthetic peptide"
EEERPLLLL

SEQ ID NO: 20527 - protein, 9 aa, Artificial Sequence
  source: /note="Description of Artificial Sequence: Synthetic peptide"
EERPLLLLT

SEQ ID NO: 20528 - protein, 10 aa, Artificial Sequence
  source: /note="Description of Artificial Sequence: Synthetic peptide"
LLTPPRLREK

SEQ ID NO: 20529 - protein, 10 aa, Artificial Sequence
  source: /note="Description of Artificial Sequence: Synthetic peptide"
MEEERPLLLL

SEQ ID NO: 20530 - protein, 9 aa, Artificial Sequence
  source: /note="Description of Artificial Sequence: Synthetic peptide"
KMKSQMGQV

SEQ ID NO: 20531 - protein, 9 aa, Artificial Sequence
  source: /note="Description of Artificial Sequence: Synthetic peptide"
SQMGQVGEK

SEQ ID NO: 20532 - protein, 9 aa, Artificial Sequence
  source: /note="Description of Artificial Sequence: Synthetic peptide"
KLKKMKSQM

SEQ ID NO: 20533 - protein, 9 aa, Artificial Sequence
  source: /note="Description of Artificial Sequence: Synthetic peptide"
MKSQMGQVG

SEQ ID NO: 20534 - protein, 10 aa, Artificial Sequence
  source: /note="Description of Artificial Sequence: Synthetic peptide"
KSQMGQVGEK

SEQ ID NO: 20535 - protein, 10 aa, Artificial Sequence
  source: /note="Description of Artificial Sequence: Synthetic peptide"
KLKKMKSQMG

SEQ ID NO: 20536 - protein, 10 aa, Artificial Sequence
  source: /note="Description of Artificial Sequence: Synthetic peptide"
KMKSQMGQVG

SEQ ID NO: 20537 - protein, 10 aa, Artificial Sequence
  source: /note="Description of Artificial Sequence: Synthetic peptide"
KKMKSQMGQV

SEQ ID NO: 20538 - protein, 9 aa, Artificial Sequence
  source: /note="Description of Artificial Sequence: Synthetic peptide"
VLPEWGAVV

SEQ ID NO: 20539 - protein, 9 aa, Artificial Sequence
  source: /note="Description of Artificial Sequence: Synthetic peptide"
LPEWGAVVM

SEQ ID NO: 20540 - protein, 10 aa, Artificial Sequence
  source: /note="Description of Artificial Sequence: Synthetic peptide"
VVLPEWGAVV

SEQ ID NO: 20541 - protein, 10 aa, Artificial Sequence
  source: /note="Description of Artificial Sequence: Synthetic peptide"
VLPEWGAVVM

SEQ ID NO: 20542 - protein, 10 aa, Artificial Sequence
  source: /note="Description of Artificial Sequence: Synthetic peptide"
QVVLPEWGAV

SEQ ID NO: 20543 - protein, 9 aa, Artificial Sequence
  source: /note="Description of Artificial Sequence: Synthetic peptide"
CTTEPNGLI

SEQ ID NO: 20544 - protein, 9 aa, Artificial Sequence
  source: /note="Description of Artificial Sequence: Synthetic peptide"
GSHVSNNFM

SEQ ID NO: 20545 - protein, 9 aa, Artificial Sequence
  source: /note="Description of Artificial Sequence: Synthetic peptide"
STADLPGSH

SEQ ID NO: 20546 - protein, 10 aa, Artificial Sequence
  source: /note="Description of Artificial Sequence: Synthetic peptide"
STADLPGSHV

SEQ ID NO: 20547 - protein, 10 aa, Artificial Sequence
  source: /note="Description of Artificial Sequence: Synthetic peptide"
HVSNNFMGCL

SEQ ID NO: 20548 - protein, 10 aa, Artificial Sequence
  source: /note="Description of Artificial Sequence: Synthetic peptide"
LPGSHVSNNF

SEQ ID NO: 20549 - protein, 9 aa, Artificial Sequence
  source: /note="Description of Artificial Sequence: Synthetic peptide"
KVFNPEKER

SEQ ID NO: 20550 - protein, 9 aa, Artificial Sequence
  source: /note="Description of Artificial Sequence: Synthetic peptide"
HEIPKVFNP

SEQ ID NO: 20551 - protein, 10 aa, Artificial Sequence
  source: /note="Description of Artificial Sequence: Synthetic peptide"
HEIPKVFNPE

SEQ ID NO: 20552 - protein, 9 aa, Artificial Sequence
  source: /note="Description of Artificial Sequence: Synthetic peptide"
FQSLYQLWY

SEQ ID NO: 20553 - protein, 9 aa, Artificial Sequence
  source: /note="Description of Artificial Sequence: Synthetic peptide"
YQLWYGHSF

SEQ ID NO: 20554 - protein, 9 aa, Artificial Sequence
  source: /note="Description of Artificial Sequence: Synthetic peptide"
SLKNFQSLY

SEQ ID NO: 20555 - protein, 9 aa, Artificial Sequence
  source: /note="Description of Artificial Sequence: Synthetic peptide"
SSLKNFQSL

SEQ ID NO: 20556 - protein, 9 aa, Artificial Sequence
  source: /note="Description of Artificial Sequence: Synthetic peptide"
NFQSLYQLW

SEQ ID NO: 20557 - protein, 9 aa, Artificial Sequence
  source: /note="Description of Artificial Sequence: Synthetic peptide"
KNFQSLYQL

SEQ ID NO: 20558 - protein, 9 aa, Artificial Sequence
  source: /note="Description of Artificial Sequence: Synthetic peptide"
SLYQLWYGH

SEQ ID NO: 20559 - protein, 10 aa, Artificial Sequence
  source: /note="Description of Artificial Sequence: Synthetic peptide"
SSLKNFQSLY

SEQ ID NO: 20560 - protein, 10 aa, Artificial Sequence
  source: /note="Description of Artificial Sequence: Synthetic peptide"
KNFQSLYQLW

SEQ ID NO: 20561 - protein, 10 aa, Artificial Sequence
  source: /note="Description of Artificial Sequence: Synthetic peptide"
LYQLWYGHSF

SEQ ID NO: 20562 - protein, 10 aa, Artificial Sequence
  source: /note="Description of Artificial Sequence: Synthetic peptide"
NFQSLYQLWY

SEQ ID NO: 20563 - protein, 10 aa, Artificial Sequence
  source: /note="Description of Artificial Sequence: Synthetic peptide"
LSSLKNFQSL

SEQ ID NO: 20564 - protein, 10 aa, Artificial Sequence
  source: /note="Description of Artificial Sequence: Synthetic peptide"
LKNFQSLYQL

SEQ ID NO: 20565 - protein, 9 aa, Artificial Sequence
  source: /note="Description of Artificial Sequence: Synthetic peptide"
RPPSMDRAA

SEQ ID NO: 20566 - protein, 9 aa, Artificial Sequence
  source: /note="Description of Artificial Sequence: Synthetic peptide"
PPSMDRAAV

SEQ ID NO: 20567 - protein, 10 aa, Artificial Sequence
  source: /note="Description of Artificial Sequence: Synthetic peptide"
RPPSMDRAAV

SEQ ID NO: 20568 - protein, 9 aa, Artificial Sequence
  source: /note="Description of Artificial Sequence: Synthetic peptide"
LQLQPPAAG

SEQ ID NO: 20569 - protein, 10 aa, Artificial Sequence
  source: /note="Description of Artificial Sequence: Synthetic peptide"
NQHLQLQPPA

SEQ ID NO: 20570 - protein, 9 aa, Artificial Sequence
  source: /note="Description of Artificial Sequence: Synthetic peptide"
EVSNCTSRR

SEQ ID NO: 20571 - protein, 9 aa, Artificial Sequence
  source: /note="Description of Artificial Sequence: Synthetic peptide"
TTCGQNATK

SEQ ID NO: 20572 - protein, 9 aa, Artificial Sequence
  source: /note="Description of Artificial Sequence: Synthetic peptide"
ATKLYCFYS

SEQ ID NO: 20573 - protein, 9 aa, Artificial Sequence
  source: /note="Description of Artificial Sequence: Synthetic peptide"
CGQNATKLY

SEQ ID NO: 20574 - protein, 9 aa, Artificial Sequence
  source: /note="Description of Artificial Sequence: Synthetic peptide"
NATKLYCFY

SEQ ID NO: 20575 - protein, 10 aa, Artificial Sequence
  source: /note="Description of Artificial Sequence: Synthetic peptide"
KLYCFYSENT

SEQ ID NO: 20576 - protein, 10 aa, Artificial Sequence
  source: /note="Description of Artificial Sequence: Synthetic peptide"
QNATKLYCFY

SEQ ID NO: 20577 - protein, 10 aa, Artificial Sequence
  source: /note="Description of Artificial Sequence: Synthetic peptide"
DTTCGQNATK

SEQ ID NO: 20578 - protein, 10 aa, Artificial Sequence
  source: /note="Description of Artificial Sequence: Synthetic peptide"
GQNATKLYCF

SEQ ID NO: 20579 - protein, 10 aa, Artificial Sequence
  source: /note="Description of Artificial Sequence: Synthetic peptide"
AVHYCHKNCV

SEQ ID NO: 20580 - protein, 10 aa, Artificial Sequence
  source: /note="Description of Artificial Sequence: Synthetic peptide"
KNCVVHRDLK

SEQ ID NO: 20581 - protein, 10 aa, Artificial Sequence
  source: /note="Description of Artificial Sequence: Synthetic peptide"
VHYCHKNCVV

SEQ ID NO: 20582 - protein, 10 aa, Artificial Sequence
  source: /note="Description of Artificial Sequence: Synthetic peptide"
HKNCVVHRDL

SEQ ID NO: 20583 - protein, 9 aa, Artificial Sequence
  source: /note="Description of Artificial Sequence: Synthetic peptide"
YLLQGIQNY

SEQ ID NO: 20584 - protein, 10 aa, Artificial Sequence
  source: /note="Description of Artificial Sequence: Synthetic peptide"
IQNYHSGNDV

SEQ ID NO: 20585 - protein, 9 aa, Artificial Sequence
  source: /note="Description of Artificial Sequence: Synthetic peptide"
FASVVNYFI

SEQ ID NO: 20586 - protein, 9 aa, Artificial Sequence
  source: /note="Description of Artificial Sequence: Synthetic peptide"
SVVNYFIEK

SEQ ID NO: 20587 - protein, 9 aa, Artificial Sequence
  source: /note="Description of Artificial Sequence: Synthetic peptide"
HFASVVNYF

SEQ ID NO: 20588 - protein, 9 aa, Artificial Sequence
  source: /note="Description of Artificial Sequence: Synthetic peptide"
VHFASVVNY

SEQ ID NO: 20589 - protein, 10 aa, Artificial Sequence
  source: /note="Description of Artificial Sequence: Synthetic peptide"
ASVVNYFIEK

SEQ ID NO: 20590 - protein, 10 aa, Artificial Sequence
  source: /note="Description of Artificial Sequence: Synthetic peptide"
VHFASVVNYF

SEQ ID NO: 20591 - protein, 10 aa, Artificial Sequence
  source: /note="Description of Artificial Sequence: Synthetic peptide"
HFASVVNYFI

SEQ ID NO: 20592 - protein, 10 aa, Artificial Sequence
  source: /note="Description of Artificial Sequence: Synthetic peptide"
YFIEKENYHY

SEQ ID NO: 20593 - protein, 10 aa, Artificial Sequence
  source: /note="Description of Artificial Sequence: Synthetic peptide"
NVHFASVVNY

SEQ ID NO: 20594 - protein, 10 aa, Artificial Sequence
  source: /note="Description of Artificial Sequence: Synthetic peptide"
VNYFIEKENY

SEQ ID NO: 20595 - protein, 9 aa, Artificial Sequence
  source: /note="Description of Artificial Sequence: Synthetic peptide"
QLYFWYKRA

SEQ ID NO: 20596 - protein, 9 aa, Artificial Sequence
  source: /note="Description of Artificial Sequence: Synthetic peptide"
SYQLYFWYK

SEQ ID NO: 20597 - protein, 9 aa, Artificial Sequence
  source: /note="Description of Artificial Sequence: Synthetic peptide"
YQLYFWYKR

SEQ ID NO: 20598 - protein, 9 aa, Artificial Sequence
  source: /note="Description of Artificial Sequence: Synthetic peptide"
YFWYKRAPL

SEQ ID NO: 20599 - protein, 9 aa, Artificial Sequence
  source: /note="Description of Artificial Sequence: Synthetic peptide"
RSQTGWAPG

SEQ ID NO: 20600 - protein, 9 aa, Artificial Sequence
  source: /note="Description of Artificial Sequence: Synthetic peptide"
SVRQQVHPA

SEQ ID NO: 20601 - protein, 9 aa, Artificial Sequence
  source: /note="Description of Artificial Sequence: Synthetic peptide"
FWYKRAPLR

SEQ ID NO: 20602 - protein, 9 aa, Artificial Sequence
  source: /note="Description of Artificial Sequence: Synthetic peptide"
AHHQPVPSY

SEQ ID NO: 20603 - protein, 9 aa, Artificial Sequence
  source: /note="Description of Artificial Sequence: Synthetic peptide"
PSYQLYFWY

SEQ ID NO: 20604 - protein, 9 aa, Artificial Sequence
  source: /note="Description of Artificial Sequence: Synthetic peptide"
HPGAHHQPV

SEQ ID NO: 20605 - protein, 9 aa, Artificial Sequence
  source: /note="Description of Artificial Sequence: Synthetic peptide"
QPVPSYQLY

SEQ ID NO: 20606 - protein, 9 aa, Artificial Sequence
  source: /note="Description of Artificial Sequence: Synthetic peptide"
HQPVPSYQL

SEQ ID NO: 20607 - protein, 9 aa, Artificial Sequence
  source: /note="Description of Artificial Sequence: Synthetic peptide"
DEAPHPGAH

SEQ ID NO: 20608 - protein, 9 aa, Artificial Sequence
  source: /note="Description of Artificial Sequence: Synthetic peptide"
VPSYQLYFW

SEQ ID NO: 20609 - protein, 10 aa, Artificial Sequence
  source: /note="Description of Artificial Sequence: Synthetic peptide"
YQLYFWYKRA

SEQ ID NO: 20610 - protein, 10 aa, Artificial Sequence
  source: /note="Description of Artificial Sequence: Synthetic peptide"
PSYQLYFWYK

SEQ ID NO: 20611 - protein, 10 aa, Artificial Sequence
  source: /note="Description of Artificial Sequence: Synthetic peptide"
SYQLYFWYKR

SEQ ID NO: 20612 - protein, 10 aa, Artificial Sequence
  source: /note="Description of Artificial Sequence: Synthetic peptide"
LYFWYKRAPL

SEQ ID NO: 20613 - protein, 10 aa, Artificial Sequence
  source: /note="Description of Artificial Sequence: Synthetic peptide"
GAHHQPVPSY

SEQ ID NO: 20614 - protein, 10 aa, Artificial Sequence
  source: /note="Description of Artificial Sequence: Synthetic peptide"
HQPVPSYQLY

SEQ ID NO: 20615 - protein, 10 aa, Artificial Sequence
  source: /note="Description of Artificial Sequence: Synthetic peptide"
YFWYKRAPLR

SEQ ID NO: 20616 - protein, 10 aa, Artificial Sequence
  source: /note="Description of Artificial Sequence: Synthetic peptide"
VPSYQLYFWY

SEQ ID NO: 20617 - protein, 10 aa, Artificial Sequence
  source: /note="Description of Artificial Sequence: Synthetic peptide"
RQQVHPADEA

SEQ ID NO: 20618 - protein, 10 aa, Artificial Sequence
  source: /note="Description of Artificial Sequence: Synthetic peptide"
HHQPVPSYQL

SEQ ID NO: 20619 - protein, 10 aa, Artificial Sequence
  source: /note="Description of Artificial Sequence: Synthetic peptide"
QPVPSYQLYF

SEQ ID NO: 20620 - protein, 10 aa, Artificial Sequence
  source: /note="Description of Artificial Sequence: Synthetic peptide"
REGQLCCSQI

SEQ ID NO: 20621 - protein, 10 aa, Artificial Sequence
  source: /note="Description of Artificial Sequence: Synthetic peptide"
GQLCCSQISA

SEQ ID NO: 20622 - protein, 10 aa, Artificial Sequence
  source: /note="Description of Artificial Sequence: Synthetic peptide"
SQISAHEGRI

SEQ ID NO: 20623 - protein, 10 aa, Artificial Sequence
  source: /note="Description of Artificial Sequence: Synthetic peptide"
DEAPHPGAHH

SEQ ID NO: 20624 - protein, 9 aa, Artificial Sequence
  source: /note="Description of Artificial Sequence: Synthetic peptide"
NLFKRLMIV

SEQ ID NO: 20625 - protein, 9 aa, Artificial Sequence
  source: /note="Description of Artificial Sequence: Synthetic peptide"
KTEENLFKR

SEQ ID NO: 20626 - protein, 9 aa, Artificial Sequence
  source: /note="Description of Artificial Sequence: Synthetic peptide"
LFKRLMIVK

SEQ ID NO: 20627 - protein, 9 aa, Artificial Sequence
  source: /note="Description of Artificial Sequence: Synthetic peptide"
KKLKTEENL

SEQ ID NO: 20628 - protein, 9 aa, Artificial Sequence
  source: /note="Description of Artificial Sequence: Synthetic peptide"
KLKTEENLF

SEQ ID NO: 20629 - protein, 9 aa, Artificial Sequence
  source: /note="Description of Artificial Sequence: Synthetic peptide"
EENLFKRLM

SEQ ID NO: 20630 - protein, 9 aa, Artificial Sequence
  source: /note="Description of Artificial Sequence: Synthetic peptide"
TEENLFKRL

SEQ ID NO: 20631 - protein, 10 aa, Artificial Sequence
  source: /note="Description of Artificial Sequence: Synthetic peptide"
KLKTEENLFK

SEQ ID NO: 20632 - protein, 10 aa, Artificial Sequence
  source: /note="Description of Artificial Sequence: Synthetic peptide"
NLFKRLMIVK

SEQ ID NO: 20633 - protein, 10 aa, Artificial Sequence
  source: /note="Description of Artificial Sequence: Synthetic peptide"
LFKRLMIVKK

SEQ ID NO: 20634 - protein, 10 aa, Artificial Sequence
  source: /note="Description of Artificial Sequence: Synthetic peptide"
KKLKTEENLF

SEQ ID NO: 20635 - protein, 10 aa, Artificial Sequence
  source: /note="Description of Artificial Sequence: Synthetic peptide"
TEENLFKRLM

SEQ ID NO: 20636 - protein, 10 aa, Artificial Sequence
  source: /note="Description of Artificial Sequence: Synthetic peptide"
EENLFKRLMI

SEQ ID NO: 20637 - protein, 9 aa, Artificial Sequence
  source: /note="Description of Artificial Sequence: Synthetic peptide"
KLGAIVPRV

SEQ ID NO: 20638 - protein, 9 aa, Artificial Sequence
  source: /note="Description of Artificial Sequence: Synthetic peptide"
GAIVPRVVK

SEQ ID NO: 20639 - protein, 9 aa, Artificial Sequence
  source: /note="Description of Artificial Sequence: Synthetic peptide"
VPRVVKTLI

SEQ ID NO: 20640 - protein, 9 aa, Artificial Sequence
  source: /note="Description of Artificial Sequence: Synthetic peptide"
KKGKLGAIV

SEQ ID NO: 20641 - protein, 10 aa, Artificial Sequence
  source: /note="Description of Artificial Sequence: Synthetic peptide"
KLGAIVPRVV

SEQ ID NO: 20642 - protein, 10 aa, Artificial Sequence
  source: /note="Description of Artificial Sequence: Synthetic peptide"
AIVPRVVKTL

SEQ ID NO: 20643 - protein, 10 aa, Artificial Sequence
  source: /note="Description of Artificial Sequence: Synthetic peptide"
SGYTTPKKGK

SEQ ID NO: 20644 - protein, 10 aa, Artificial Sequence
  source: /note="Description of Artificial Sequence: Synthetic peptide"
KGKLGAIVPR

SEQ ID NO: 20645 - protein, 10 aa, Artificial Sequence
  source: /note="Description of Artificial Sequence: Synthetic peptide"
LGAIVPRVVK

SEQ ID NO: 20646 - protein, 10 aa, Artificial Sequence
  source: /note="Description of Artificial Sequence: Synthetic peptide"
TPKKGKLGAI

SEQ ID NO: 20647 - protein, 9 aa, Artificial Sequence
  source: /note="Description of Artificial Sequence: Synthetic peptide"
HPQQQQQPH

SEQ ID NO: 20648 - protein, 9 aa, Artificial Sequence
  source: /note="Description of Artificial Sequence: Synthetic peptide"
ELYLEDSPW

SEQ ID NO: 20649 - protein, 10 aa, Artificial Sequence
  source: /note="Description of Artificial Sequence: Synthetic peptide"
RELYLEDSPW

SEQ ID NO: 20650 - protein, 9 aa, Artificial Sequence
  source: /note="Description of Artificial Sequence: Synthetic peptide"
PVAEDNYGY

SEQ ID NO: 20651 - protein, 10 aa, Artificial Sequence
  source: /note="Description of Artificial Sequence: Synthetic peptide"
LLGPLPMHPV

SEQ ID NO: 20652 - protein, 10 aa, Artificial Sequence
  source: /note="Description of Artificial Sequence: Synthetic peptide"
PMHPVAEDNY

SEQ ID NO: 20653 - protein, 10 aa, Artificial Sequence
  source: /note="Description of Artificial Sequence: Synthetic peptide"
HPVAEDNYGY

SEQ ID NO: 20654 - protein, 9 aa, Artificial Sequence
  source: /note="Description of Artificial Sequence: Synthetic peptide"
LQQAKQLAA

SEQ ID NO: 20655 - protein, 9 aa, Artificial Sequence
  source: /note="Description of Artificial Sequence: Synthetic peptide"
KQLAAETEG

SEQ ID NO: 20656 - protein, 10 aa, Artificial Sequence
  source: /note="Description of Artificial Sequence: Synthetic peptide"
KQLAAETEGI

SEQ ID NO: 20657 - protein, 10 aa, Artificial Sequence
  source: /note="Description of Artificial Sequence: Synthetic peptide"
LLQQAKQLAA

SEQ ID NO: 20658 - protein, 10 aa, Artificial Sequence
  source: /note="Description of Artificial Sequence: Synthetic peptide"
GELLQQAKQL

SEQ ID NO: 20659 - protein, 9 aa, Artificial Sequence
  source: /note="Description of Artificial Sequence: Synthetic peptide"
SVLPAGPSL

SEQ ID NO: 20660 - protein, 9 aa, Artificial Sequence
  source: /note="Description of Artificial Sequence: Synthetic peptide"
LPAGPSLGA

SEQ ID NO: 20661 - protein, 10 aa, Artificial Sequence
  source: /note="Description of Artificial Sequence: Synthetic peptide"
VLPAGPSLGA

SEQ ID NO: 20662 - protein, 10 aa, Artificial Sequence
  source: /note="Description of Artificial Sequence: Synthetic peptide"
HSVLPAGPSL

SEQ ID NO: 20663 - protein, 9 aa, Artificial Sequence
  source: /note="Description of Artificial Sequence: Synthetic peptide"
SLSPVSMGR

SEQ ID NO: 20664 - protein, 9 aa, Artificial Sequence
  source: /note="Description of Artificial Sequence: Synthetic peptide"
KSHSTSLSP

SEQ ID NO: 20665 - protein, 9 aa, Artificial Sequence
  source: /note="Description of Artificial Sequence: Synthetic peptide"
YPKSHSTSL

SEQ ID NO: 20666 - protein, 9 aa, Artificial Sequence
  source: /note="Description of Artificial Sequence: Synthetic peptide"
SHSTSLSPV

SEQ ID NO: 20667 - protein, 9 aa, Artificial Sequence
  source: /note="Description of Artificial Sequence: Synthetic peptide"
STSLSPVSM

SEQ ID NO: 20668 - protein, 10 aa, Artificial Sequence
  source: /note="Description of Artificial Sequence: Synthetic peptide"
TSLSPVSMGR

SEQ ID NO: 20669 - protein, 10 aa, Artificial Sequence
  source: /note="Description of Artificial Sequence: Synthetic peptide"
KSHSTSLSPV

SEQ ID NO: 20670 - protein, 10 aa, Artificial Sequence
  source: /note="Description of Artificial Sequence: Synthetic peptide"
HSTSLSPVSM

SEQ ID NO: 20671 - protein, 9 aa, Artificial Sequence
  source: /note="Description of Artificial Sequence: Synthetic peptide"
KQNPNTQLS

SEQ ID NO: 20672 - protein, 10 aa, Artificial Sequence
  source: /note="Description of Artificial Sequence: Synthetic peptide"
KPKQNPNTQL

SEQ ID NO: 20673 - protein, 10 aa, Artificial Sequence
  source: /note="Description of Artificial Sequence: Synthetic peptide"
KQNPNTQLST

SEQ ID NO: 20674 - protein, 9 aa, Artificial Sequence
  source: /note="Description of Artificial Sequence: Synthetic peptide"
LAYLVPGPL

SEQ ID NO: 20675 - protein, 10 aa, Artificial Sequence
  source: /note="Description of Artificial Sequence: Synthetic peptide"
TLAYLVPGPL

SEQ ID NO: 20676 - protein, 9 aa, Artificial Sequence
  source: /note="Description of Artificial Sequence: Synthetic peptide"
AVASAWLTV

SEQ ID NO: 20677 - protein, 9 aa, Artificial Sequence
  source: /note="Description of Artificial Sequence: Synthetic peptide"
VASAWLTVL

SEQ ID NO: 20678 - protein, 9 aa, Artificial Sequence
  source: /note="Description of Artificial Sequence: Synthetic peptide"
SAWLTVLGL

SEQ ID NO: 20679 - protein, 10 aa, Artificial Sequence
  source: /note="Description of Artificial Sequence: Synthetic peptide"
AVASAWLTVL

SEQ ID NO: 20680 - protein, 10 aa, Artificial Sequence
  source: /note="Description of Artificial Sequence: Synthetic peptide"
DAVASAWLTV

SEQ ID NO: 20681 - protein, 10 aa, Artificial Sequence
  source: /note="Description of Artificial Sequence: Synthetic peptide"
ACRDAVASAW

SEQ ID NO: 20682 - protein, 10 aa, Artificial Sequence
  source: /note="Description of Artificial Sequence: Synthetic peptide"
ASAWLTVLGL

SEQ ID NO: 20683 - protein, 9 aa, Artificial Sequence
  source: /note="Description of Artificial Sequence: Synthetic peptide"
LQAEAGAST

SEQ ID NO: 20684 - protein, 9 aa, Artificial Sequence
  source: /note="Description of Artificial Sequence: Synthetic peptide"
AEAGASTTL

SEQ ID NO: 20685 - protein, 10 aa, Artificial Sequence
  source: /note="Description of Artificial Sequence: Synthetic peptide"
LQAEAGASTT

SEQ ID NO: 20686 - protein, 10 aa, Artificial Sequence
  source: /note="Description of Artificial Sequence: Synthetic peptide"
QAEAGASTTL

SEQ ID NO: 20687 - protein, 10 aa, Artificial Sequence
  source: /note="Description of Artificial Sequence: Synthetic peptide"
AEAGASTTLS

SEQ ID NO: 20688 - protein, 9 aa, Artificial Sequence
  source: /note="Description of Artificial Sequence: Synthetic peptide"
LLPPAHHRA

SEQ ID NO: 20689 - protein, 9 aa, Artificial Sequence
  source: /note="Description of Artificial Sequence: Synthetic peptide"
AEAGGQCHA

SEQ ID NO: 20690 - protein, 9 aa, Artificial Sequence
  source: /note="Description of Artificial Sequence: Synthetic peptide"
VQRWEEAEL

SEQ ID NO: 20691 - protein, 9 aa, Artificial Sequence
  source: /note="Description of Artificial Sequence: Synthetic peptide"
LQTEAGGAA

SEQ ID NO: 20692 - protein, 9 aa, Artificial Sequence
  source: /note="Description of Artificial Sequence: Synthetic peptide"
EEAELQLES

SEQ ID NO: 20693 - protein, 9 aa, Artificial Sequence
  source: /note="Description of Artificial Sequence: Synthetic peptide"
AELRGGPGP

SEQ ID NO: 20694 - protein, 9 aa, Artificial Sequence
  source: /note="Description of Artificial Sequence: Synthetic peptide"
AELQLESAC

SEQ ID NO: 20695 - protein, 10 aa, Artificial Sequence
  source: /note="Description of Artificial Sequence: Synthetic peptide"
GLLPPAHHRA

SEQ ID NO: 20696 - protein, 10 aa, Artificial Sequence
  source: /note="Description of Artificial Sequence: Synthetic peptide"
VQAEAGGQCH

SEQ ID NO: 20697 - protein, 10 aa, Artificial Sequence
  source: /note="Description of Artificial Sequence: Synthetic peptide"
QRWEEAELQL

SEQ ID NO: 20698 - protein, 10 aa, Artificial Sequence
  source: /note="Description of Artificial Sequence: Synthetic peptide"
LESACRGQGL

SEQ ID NO: 20699 - protein, 10 aa, Artificial Sequence
  source: /note="Description of Artificial Sequence: Synthetic peptide"
LQTEAGGAAG

SEQ ID NO: 20700 - protein, 10 aa, Artificial Sequence
  source: /note="Description of Artificial Sequence: Synthetic peptide"
RQDRCRGLQL

SEQ ID NO: 20701 - protein, 10 aa, Artificial Sequence
  source: /note="Description of Artificial Sequence: Synthetic peptide"
LQLRGQGPEG

SEQ ID NO: 20702 - protein, 10 aa, Artificial Sequence
  source: /note="Description of Artificial Sequence: Synthetic peptide"
EEAELQLESA

SEQ ID NO: 20703 - protein, 9 aa, Artificial Sequence
  source: /note="Description of Artificial Sequence: Synthetic peptide"
VTKGDTATF

SEQ ID NO: 20704 - protein, 9 aa, Artificial Sequence
  source: /note="Description of Artificial Sequence: Synthetic peptide"
LEVTKGDTA

SEQ ID NO: 20705 - protein, 10 aa, Artificial Sequence
  source: /note="Description of Artificial Sequence: Synthetic peptide"
EVTKGDTATF

SEQ ID NO: 20706 - protein, 9 aa, Artificial Sequence
  source: /note="Description of Artificial Sequence: Synthetic peptide"
KLRYKSCKK

SEQ ID NO: 20707 - protein, 9 aa, Artificial Sequence
  source: /note="Description of Artificial Sequence: Synthetic peptide"
RYKSCKKQL

SEQ ID NO: 20708 - protein, 9 aa, Artificial Sequence
  source: /note="Description of Artificial Sequence: Synthetic peptide"
LLKCIKLRY

SEQ ID NO: 20709 - protein, 9 aa, Artificial Sequence
  source: /note="Description of Artificial Sequence: Synthetic peptide"
ELQEVEKNR

SEQ ID NO: 20710 - protein, 9 aa, Artificial Sequence
  source: /note="Description of Artificial Sequence: Synthetic peptide"
KPLLKCIKL

SEQ ID NO: 20711 - protein, 9 aa, Artificial Sequence
  source: /note="Description of Artificial Sequence: Synthetic peptide"
CIKLRYKSC

SEQ ID NO: 20712 - protein, 9 aa, Artificial Sequence
  source: /note="Description of Artificial Sequence: Synthetic peptide"
VEKNRKPLL

SEQ ID NO: 20713 - protein, 10 aa, Artificial Sequence
  source: /note="Description of Artificial Sequence: Synthetic peptide"
LLKCIKLRYK

SEQ ID NO: 20714 - protein, 10 aa, Artificial Sequence
  source: /note="Description of Artificial Sequence: Synthetic peptide"
VEKNRKPLLK

SEQ ID NO: 20715 - protein, 10 aa, Artificial Sequence
  source: /note="Description of Artificial Sequence: Synthetic peptide"
KNRKPLLKCI

SEQ ID NO: 20716 - protein, 10 aa, Artificial Sequence
  source: /note="Description of Artificial Sequence: Synthetic peptide"
CIKLRYKSCK

SEQ ID NO: 20717 - protein, 10 aa, Artificial Sequence
  source: /note="Description of Artificial Sequence: Synthetic peptide"
RYKSCKKQLK

SEQ ID NO: 20718 - protein, 10 aa, Artificial Sequence
  source: /note="Description of Artificial Sequence: Synthetic peptide"
QEVEKNRKPL

SEQ ID NO: 20719 - protein, 10 aa, Artificial Sequence
  source: /note="Description of Artificial Sequence: Synthetic peptide"
LRYKSCKKQL

SEQ ID NO: 20720 - protein, 9 aa, Artificial Sequence
  source: /note="Description of Artificial Sequence: Synthetic peptide"
KKTELEVQI

SEQ ID NO: 20721 - protein, 9 aa, Artificial Sequence
  source: /note="Description of Artificial Sequence: Synthetic peptide"
YEKIVIKKT

SEQ ID NO: 20722 - protein, 10 aa, Artificial Sequence
  source: /note="Description of Artificial Sequence: Synthetic peptide"
IVIKKTELEV

SEQ ID NO: 20723 - protein, 10 aa, Artificial Sequence
  source: /note="Description of Artificial Sequence: Synthetic peptide"
KSHYEKIVIK

SEQ ID NO: 20724 - protein, 9 aa, Artificial Sequence
  source: /note="Description of Artificial Sequence: Synthetic peptide"
QCQNSPLPF

SEQ ID NO: 20725 - protein, 10 aa, Artificial Sequence
  source: /note="Description of Artificial Sequence: Synthetic peptide"
SLGQCQNSPL

SEQ ID NO: 20726 - protein, 10 aa, Artificial Sequence
  source: /note="Description of Artificial Sequence: Synthetic peptide"
GQCQNSPLPF

SEQ ID NO: 20727 - protein, 10 aa, Artificial Sequence
  source: /note="Description of Artificial Sequence: Synthetic peptide"
CQNSPLPFQW

SEQ ID NO: 20728 - protein, 9 aa, Artificial Sequence
  source: /note="Description of Artificial Sequence: Synthetic peptide"
KGNMGTESM

SEQ ID NO: 20729 - protein, 10 aa, Artificial Sequence
  source: /note="Description of Artificial Sequence: Synthetic peptide"
MGTESMDTTY

SEQ ID NO: 20730 - protein, 10 aa, Artificial Sequence
  source: /note="Description of Artificial Sequence: Synthetic peptide"
YANGVSKGNM

SEQ ID NO: 20731 - protein, 10 aa, Artificial Sequence
  source: /note="Description of Artificial Sequence: Synthetic peptide"
SKGNMGTESM

SEQ ID NO: 20732 - protein, 9 aa, Artificial Sequence
  source: /note="Description of Artificial Sequence: Synthetic peptide"
WLAAILNNA

SEQ ID NO: 20733 - protein, 9 aa, Artificial Sequence
  source: /note="Description of Artificial Sequence: Synthetic peptide"
NEDSRWLAA

SEQ ID NO: 20734 - protein, 10 aa, Artificial Sequence
  source: /note="Description of Artificial Sequence: Synthetic peptide"
RWLAAILNNA

SEQ ID NO: 20735 - protein, 10 aa, Artificial Sequence
  source: /note="Description of Artificial Sequence: Synthetic peptide"
WLAAILNNAH

SEQ ID NO: 20736 - protein, 10 aa, Artificial Sequence
  source: /note="Description of Artificial Sequence: Synthetic peptide"
NEDSRWLAAI

SEQ ID NO: 20737 - protein, 9 aa, Artificial Sequence
  source: /note="Description of Artificial Sequence: Synthetic peptide"
SFLRGPRLL

SEQ ID NO: 20738 - protein, 9 aa, Artificial Sequence
  source: /note="Description of Artificial Sequence: Synthetic peptide"
RVRRAHESV

SEQ ID NO: 20739 - protein, 9 aa, Artificial Sequence
  source: /note="Description of Artificial Sequence: Synthetic peptide"
SVHRSFLRG

SEQ ID NO: 20740 - protein, 9 aa, Artificial Sequence
  source: /note="Description of Artificial Sequence: Synthetic peptide"
RSFLRGPRL

SEQ ID NO: 20741 - protein, 9 aa, Artificial Sequence
  source: /note="Description of Artificial Sequence: Synthetic peptide"
CYSGWERCR

SEQ ID NO: 20742 - protein, 9 aa, Artificial Sequence
  source: /note="Description of Artificial Sequence: Synthetic peptide"
SGWERCRVR

SEQ ID NO: 20743 - protein, 9 aa, Artificial Sequence
  source: /note="Description of Artificial Sequence: Synthetic peptide"
ESVHRSFLR

SEQ ID NO: 20744 - protein, 9 aa, Artificial Sequence
  source: /note="Description of Artificial Sequence: Synthetic peptide"
AHESVHRSF

SEQ ID NO: 20745 - protein, 9 aa, Artificial Sequence
  source: /note="Description of Artificial Sequence: Synthetic peptide"
HESVHRSFL

SEQ ID NO: 20746 - protein, 9 aa, Artificial Sequence
  source: /note="Description of Artificial Sequence: Synthetic peptide"
WERCRVRRA

SEQ ID NO: 20747 - protein, 10 aa, Artificial Sequence
  source: /note="Description of Artificial Sequence: Synthetic peptide"
RVRRAHESVH

SEQ ID NO: 20748 - protein, 10 aa, Artificial Sequence
  source: /note="Description of Artificial Sequence: Synthetic peptide"
RAHESVHRSF

SEQ ID NO: 20749 - protein, 10 aa, Artificial Sequence
  source: /note="Description of Artificial Sequence: Synthetic peptide"
VHRSFLRGPR

SEQ ID NO: 20750 - protein, 10 aa, Artificial Sequence
  source: /note="Description of Artificial Sequence: Synthetic peptide"
RSFLRGPRLL

SEQ ID NO: 20751 - protein, 10 aa, Artificial Sequence
  source: /note="Description of Artificial Sequence: Synthetic peptide"
SGWERCRVRR

SEQ ID NO: 20752 - protein, 10 aa, Artificial Sequence
  source: /note="Description of Artificial Sequence: Synthetic peptide"
WERCRVRRAH

SEQ ID NO: 20753 - protein, 9 aa, Artificial Sequence
  source: /note="Description of Artificial Sequence: Synthetic peptide"
QPAALPAEL

SEQ ID NO: 20754 - protein, 9 aa, Artificial Sequence
  source: /note="Description of Artificial Sequence: Synthetic peptide"
NQSPAQPAA

SEQ ID NO: 20755 - protein, 10 aa, Artificial Sequence
  source: /note="Description of Artificial Sequence: Synthetic peptide"
SPAQPAALPA

SEQ ID NO: 20756 - protein, 10 aa, Artificial Sequence
  source: /note="Description of Artificial Sequence: Synthetic peptide"
RRNQSPAQPA

SEQ ID NO: 20757 - protein, 10 aa, Artificial Sequence
  source: /note="Description of Artificial Sequence: Synthetic peptide"
NQSPAQPAAL

SEQ ID NO: 20758 - protein, 10 aa, Artificial Sequence
  source: /note="Description of Artificial Sequence: Synthetic peptide"
AQPAALPAEL

SEQ ID NO: 20759 - protein, 9 aa, Artificial Sequence
  source: /note="Description of Artificial Sequence: Synthetic peptide"
RMPEPHRAL

SEQ ID NO: 20760 - protein, 9 aa, Artificial Sequence
  source: /note="Description of Artificial Sequence: Synthetic peptide"
RALPTRVPF

SEQ ID NO: 20761 - protein, 9 aa, Artificial Sequence
  source: /note="Description of Artificial Sequence: Synthetic peptide"
ATRMPEPHR

SEQ ID NO: 20762 - protein, 9 aa, Artificial Sequence
  source: /note="Description of Artificial Sequence: Synthetic peptide"
SWDIFFATR

SEQ ID NO: 20763 - protein, 9 aa, Artificial Sequence
  source: /note="Description of Artificial Sequence: Synthetic peptide"
WDIFFATRM

SEQ ID NO: 20764 - protein, 9 aa, Artificial Sequence
  source: /note="Description of Artificial Sequence: Synthetic peptide"
FATRMPEPH

SEQ ID NO: 20765 - protein, 10 aa, Artificial Sequence
  source: /note="Description of Artificial Sequence: Synthetic peptide"
KSWDIFFATR

SEQ ID NO: 20766 - protein, 10 aa, Artificial Sequence
  source: /note="Description of Artificial Sequence: Synthetic peptide"
ATRMPEPHRA

SEQ ID NO: 20767 - protein, 10 aa, Artificial Sequence
  source: /note="Description of Artificial Sequence: Synthetic peptide"
RALPTRVPFP

SEQ ID NO: 20768 - protein, 10 aa, Artificial Sequence
  source: /note="Description of Artificial Sequence: Synthetic peptide"
FATRMPEPHR

SEQ ID NO: 20769 - protein, 10 aa, Artificial Sequence
  source: /note="Description of Artificial Sequence: Synthetic peptide"
MPEPHRALPT

SEQ ID NO: 20770 - protein, 10 aa, Artificial Sequence
  source: /note="Description of Artificial Sequence: Synthetic peptide"
TRMPEPHRAL

SEQ ID NO: 20771 - protein, 10 aa, Artificial Sequence
  source: /note="Description of Artificial Sequence: Synthetic peptide"
HRALPTRVPF

SEQ ID NO: 20772 - protein, 10 aa, Artificial Sequence
  source: /note="Description of Artificial Sequence: Synthetic peptide"
EPHRALPTRV

SEQ ID NO: 20773 - protein, 9 aa, Artificial Sequence
  source: /note="Description of Artificial Sequence: Synthetic peptide"
KEVQKYPQC

SEQ ID NO: 20774 - protein, 9 aa, Artificial Sequence
  source: /note="Description of Artificial Sequence: Synthetic peptide"
LVHGDATFA

SEQ ID NO: 20775 - protein, 9 aa, Artificial Sequence
  source: /note="Description of Artificial Sequence: Synthetic peptide"
ATFAGQGVV

SEQ ID NO: 20776 - protein, 9 aa, Artificial Sequence
  source: /note="Description of Artificial Sequence: Synthetic peptide"
TFAGQGVVY

SEQ ID NO: 20777 - protein, 9 aa, Artificial Sequence
  source: /note="Description of Artificial Sequence: Synthetic peptide"
DATFAGQGV

SEQ ID NO: 20778 - protein, 9 aa, Artificial Sequence
  source: /note="Description of Artificial Sequence: Synthetic peptide"
ILVHGDATF

SEQ ID NO: 20779 - protein, 10 aa, Artificial Sequence
  source: /note="Description of Artificial Sequence: Synthetic peptide"
ATFAGQGVVY

SEQ ID NO: 20780 - protein, 10 aa, Artificial Sequence
  source: /note="Description of Artificial Sequence: Synthetic peptide"
ILVHGDATFA

SEQ ID NO: 20781 - protein, 10 aa, Artificial Sequence
  source: /note="Description of Artificial Sequence: Synthetic peptide"
SILVHGDATF

SEQ ID NO: 20782 - protein, 9 aa, Artificial Sequence
  source: /note="Description of Artificial Sequence: Synthetic peptide"
CSRSSGPPA

SEQ ID NO: 20783 - protein, 9 aa, Artificial Sequence
  source: /note="Description of Artificial Sequence: Synthetic peptide"
VPVFGWCSR

SEQ ID NO: 20784 - protein, 10 aa, Artificial Sequence
  source: /note="Description of Artificial Sequence: Synthetic peptide"
CSRSSGPPAT

SEQ ID NO: 20785 - protein, 10 aa, Artificial Sequence
  source: /note="Description of Artificial Sequence: Synthetic peptide"
DVPVFGWCSR

SEQ ID NO: 20786 - protein, 9 aa, Artificial Sequence
  source: /note="Description of Artificial Sequence: Synthetic peptide"
FLLLTLPKV

SEQ ID NO: 20787 - protein, 9 aa, Artificial Sequence
  source: /note="Description of Artificial Sequence: Synthetic peptide"
FFLLLTLPK

SEQ ID NO: 20788 - protein, 9 aa, Artificial Sequence
  source: /note="Description of Artificial Sequence: Synthetic peptide"
LTLPKVKMK

SEQ ID NO: 20789 - protein, 9 aa, Artificial Sequence
  source: /note="Description of Artificial Sequence: Synthetic peptide"
EYGGFFFLL

SEQ ID NO: 20790 - protein, 9 aa, Artificial Sequence
  source: /note="Description of Artificial Sequence: Synthetic peptide"
YGGFFFLLL

SEQ ID NO: 20791 - protein, 9 aa, Artificial Sequence
  source: /note="Description of Artificial Sequence: Synthetic peptide"
GFFFLLLTL

SEQ ID NO: 20792 - protein, 9 aa, Artificial Sequence
  source: /note="Description of Artificial Sequence: Synthetic peptide"
LPKVKMKSC

SEQ ID NO: 20793 - protein, 9 aa, Artificial Sequence
  source: /note="Description of Artificial Sequence: Synthetic peptide"
WEPEYGGFF

SEQ ID NO: 20794 - protein, 9 aa, Artificial Sequence
  source: /note="Description of Artificial Sequence: Synthetic peptide"
PEYGGFFFL

SEQ ID NO: 20795 - protein, 9 aa, Artificial Sequence
  source: /note="Description of Artificial Sequence: Synthetic peptide"
EPEYGGFFF

SEQ ID NO: 20796 - protein, 10 aa, Artificial Sequence
  source: /note="Description of Artificial Sequence: Synthetic peptide"
FFFLLLTLPK

SEQ ID NO: 20797 - protein, 10 aa, Artificial Sequence
  source: /note="Description of Artificial Sequence: Synthetic peptide"
GWEPEYGGFF

SEQ ID NO: 20798 - protein, 10 aa, Artificial Sequence
  source: /note="Description of Artificial Sequence: Synthetic peptide"
EYGGFFFLLL

SEQ ID NO: 20799 - protein, 10 aa, Artificial Sequence
  source: /note="Description of Artificial Sequence: Synthetic peptide"
WEPEYGGFFF

SEQ ID NO: 20800 - protein, 10 aa, Artificial Sequence
  source: /note="Description of Artificial Sequence: Synthetic peptide"
GGFFFLLLTL

SEQ ID NO: 20801 - protein, 10 aa, Artificial Sequence
  source: /note="Description of Artificial Sequence: Synthetic peptide"
LLLTLPKVKM

SEQ ID NO: 20802 - protein, 10 aa, Artificial Sequence
  source: /note="Description of Artificial Sequence: Synthetic peptide"
PEYGGFFFLL

SEQ ID NO: 20803 - protein, 10 aa, Artificial Sequence
  source: /note="Description of Artificial Sequence: Synthetic peptide"
EPEYGGFFFL

SEQ ID NO: 20804 - protein, 10 aa, Artificial Sequence
  source: /note="Description of Artificial Sequence: Synthetic peptide"
ETPSETPGPR

SEQ ID NO: 20805 - protein, 9 aa, Artificial Sequence
  source: /note="Description of Artificial Sequence: Synthetic peptide"
VLDERSSCA

SEQ ID NO: 20806 - protein, 10 aa, Artificial Sequence
  source: /note="Description of Artificial Sequence: Synthetic peptide"
RSSCAQGCHR

SEQ ID NO: 20807 - protein, 9 aa, Artificial Sequence
  source: /note="Description of Artificial Sequence: Synthetic peptide"
QLISVYENK

SEQ ID NO: 20808 - protein, 9 aa, Artificial Sequence
  source: /note="Description of Artificial Sequence: Synthetic peptide"
VYENKLLNL

SEQ ID NO: 20809 - protein, 9 aa, Artificial Sequence
  source: /note="Description of Artificial Sequence: Synthetic peptide"
YENKLLNLT

SEQ ID NO: 20810 - protein, 10 aa, Artificial Sequence
  source: /note="Description of Artificial Sequence: Synthetic peptide"
QLISVYENKL

SEQ ID NO: 20811 - protein, 10 aa, Artificial Sequence
  source: /note="Description of Artificial Sequence: Synthetic peptide"
SVYENKLLNL

SEQ ID NO: 20812 - protein, 10 aa, Artificial Sequence
  source: /note="Description of Artificial Sequence: Synthetic peptide"
VQLISVYENK

SEQ ID NO: 20813 - protein, 10 aa, Artificial Sequence
  source: /note="Description of Artificial Sequence: Synthetic peptide"
YENKLLNLTV

SEQ ID NO: 20814 - protein, 9 aa, Artificial Sequence
  source: /note="Description of Artificial Sequence: Synthetic peptide"
NQVEYLDRL

SEQ ID NO: 20815 - protein, 9 aa, Artificial Sequence
  source: /note="Description of Artificial Sequence: Synthetic peptide"
PSHGNQVEY

SEQ ID NO: 20816 - protein, 10 aa, Artificial Sequence
  source: /note="Description of Artificial Sequence: Synthetic peptide"
STHPSHGNQV

SEQ ID NO: 20817 - protein, 10 aa, Artificial Sequence
  source: /note="Description of Artificial Sequence: Synthetic peptide"
HPSHGNQVEY

SEQ ID NO: 20818 - protein, 10 aa, Artificial Sequence
  source: /note="Description of Artificial Sequence: Synthetic peptide"
NQVEYLDRLI

SEQ ID NO: 20819 - protein, 9 aa, Artificial Sequence
  source: /note="Description of Artificial Sequence: Synthetic peptide"
QLGMELSTV

SEQ ID NO: 20820 - protein, 9 aa, Artificial Sequence
  source: /note="Description of Artificial Sequence: Synthetic peptide"
ITISQQLGM

SEQ ID NO: 20821 - protein, 9 aa, Artificial Sequence
  source: /note="Description of Artificial Sequence: Synthetic peptide"
MELSTVSNF

SEQ ID NO: 20822 - protein, 9 aa, Artificial Sequence
  source: /note="Description of Artificial Sequence: Synthetic peptide"
ISQQLGMEL

SEQ ID NO: 20823 - protein, 9 aa, Artificial Sequence
  source: /note="Description of Artificial Sequence: Synthetic peptide"
QQLGMELST

SEQ ID NO: 20824 - protein, 10 aa, Artificial Sequence
  source: /note="Description of Artificial Sequence: Synthetic peptide"
QQLGMELSTV

SEQ ID NO: 20825 - protein, 10 aa, Artificial Sequence
  source: /note="Description of Artificial Sequence: Synthetic peptide"
GMELSTVSNF

SEQ ID NO: 20826 - protein, 10 aa, Artificial Sequence
  source: /note="Description of Artificial Sequence: Synthetic peptide"
MELSTVSNFF

SEQ ID NO: 20827 - protein, 10 aa, Artificial Sequence
  source: /note="Description of Artificial Sequence: Synthetic peptide"
SQQLGMELST

SEQ ID NO: 20828 - protein, 9 aa, Artificial Sequence
  source: /note="Description of Artificial Sequence: Synthetic peptide"
ITVFGRPCV

SEQ ID NO: 20829 - protein, 9 aa, Artificial Sequence
  source: /note="Description of Artificial Sequence: Synthetic peptide"
CVQNRVKSM

SEQ ID NO: 20830 - protein, 10 aa, Artificial Sequence
  source: /note="Description of Artificial Sequence: Synthetic peptide"
EITVFGRPCV

SEQ ID NO: 20831 - protein, 10 aa, Artificial Sequence
  source: /note="Description of Artificial Sequence: Synthetic peptide"
VEITVFGRPC

SEQ ID NO: 20832 - protein, 9 aa, Artificial Sequence
  source: /note="Description of Artificial Sequence: Synthetic peptide"
QEEAVTEDL

SEQ ID NO: 20833 - protein, 10 aa, Artificial Sequence
  source: /note="Description of Artificial Sequence: Synthetic peptide"
VTEDLRAPGK

SEQ ID NO: 20834 - protein, 10 aa, Artificial Sequence
  source: /note="Description of Artificial Sequence: Synthetic peptide"
FQEEAVTEDL

SEQ ID NO: 20835 - protein, 10 aa, Artificial Sequence
  source: /note="Description of Artificial Sequence: Synthetic peptide"
EEAVTEDLRA

SEQ ID NO: 20836 - protein, 9 aa, Artificial Sequence
  source: /note="Description of Artificial Sequence: Synthetic peptide"
CVCWGHYTF

SEQ ID NO: 20837 - protein, 9 aa, Artificial Sequence
  source: /note="Description of Artificial Sequence: Synthetic peptide"
VCWGHYTFF

SEQ ID NO: 20838 - protein, 9 aa, Artificial Sequence
  source: /note="Description of Artificial Sequence: Synthetic peptide"
AYCVCWGHY

SEQ ID NO: 20839 - protein, 9 aa, Artificial Sequence
  source: /note="Description of Artificial Sequence: Synthetic peptide"
GHYTFFACF

SEQ ID NO: 20840 - protein, 10 aa, Artificial Sequence
  source: /note="Description of Artificial Sequence: Synthetic peptide"
YCVCWGHYTF

SEQ ID NO: 20841 - protein, 10 aa, Artificial Sequence
  source: /note="Description of Artificial Sequence: Synthetic peptide"
CVCWGHYTFF

SEQ ID NO: 20842 - protein, 10 aa, Artificial Sequence
  source: /note="Description of Artificial Sequence: Synthetic peptide"
FAYCVCWGHY

SEQ ID NO: 20843 - protein, 10 aa, Artificial Sequence
  source: /note="Description of Artificial Sequence: Synthetic peptide"
WGHYTFFACF

SEQ ID NO: 20844 - protein, 9 aa, Artificial Sequence
  source: /note="Description of Artificial Sequence: Synthetic peptide"
CFCWGPYTF

SEQ ID NO: 20845 - protein, 9 aa, Artificial Sequence
  source: /note="Description of Artificial Sequence: Synthetic peptide"
FCWGPYTFF

SEQ ID NO: 20846 - protein, 10 aa, Artificial Sequence
  source: /note="Description of Artificial Sequence: Synthetic peptide"
FCWGPYTFFA

SEQ ID NO: 20847 - protein, 10 aa, Artificial Sequence
  source: /note="Description of Artificial Sequence: Synthetic peptide"
FCFCWGPYTF

SEQ ID NO: 20848 - protein, 10 aa, Artificial Sequence
  source: /note="Description of Artificial Sequence: Synthetic peptide"
CFCWGPYTFF

SEQ ID NO: 20849 - protein, 9 aa, Artificial Sequence
  source: /note="Description of Artificial Sequence: Synthetic peptide"
ASDAYPSAF

SEQ ID NO: 20850 - protein, 9 aa, Artificial Sequence
  source: /note="Description of Artificial Sequence: Synthetic peptide"
AYPSAFPSA

SEQ ID NO: 20851 - protein, 9 aa, Artificial Sequence
  source: /note="Description of Artificial Sequence: Synthetic peptide"
FPSAGANAS

SEQ ID NO: 20852 - protein, 9 aa, Artificial Sequence
  source: /note="Description of Artificial Sequence: Synthetic peptide"
YPSAFPSAG

SEQ ID NO: 20853 - protein, 10 aa, Artificial Sequence
  source: /note="Description of Artificial Sequence: Synthetic peptide"
DAYPSAFPSA

SEQ ID NO: 20854 - protein, 10 aa, Artificial Sequence
  source: /note="Description of Artificial Sequence: Synthetic peptide"
YPSAFPSAGA

SEQ ID NO: 20855 - protein, 10 aa, Artificial Sequence
  source: /note="Description of Artificial Sequence: Synthetic peptide"
NASDAYPSAF

SEQ ID NO: 20856 - protein, 10 aa, Artificial Sequence
  source: /note="Description of Artificial Sequence: Synthetic peptide"
SAFPSAGANA

SEQ ID NO: 20857 - protein, 10 aa, Artificial Sequence
  source: /note="Description of Artificial Sequence: Synthetic peptide"
FPSAGANASG

SEQ ID NO: 20858 - protein, 9 aa, Artificial Sequence
  source: /note="Description of Artificial Sequence: Synthetic peptide"
LMILHLKSV

SEQ ID NO: 20859 - protein, 9 aa, Artificial Sequence
  source: /note="Description of Artificial Sequence: Synthetic peptide"
YGLMILHLK

SEQ ID NO: 20860 - protein, 9 aa, Artificial Sequence
  source: /note="Description of Artificial Sequence: Synthetic peptide"
CYGLMILHL

SEQ ID NO: 20861 - protein, 9 aa, Artificial Sequence
  source: /note="Description of Artificial Sequence: Synthetic peptide"
HLKSVRMLS

SEQ ID NO: 20862 - protein, 9 aa, Artificial Sequence
  source: /note="Description of Artificial Sequence: Synthetic peptide"
MILHLKSVR

SEQ ID NO: 20863 - protein, 9 aa, Artificial Sequence
  source: /note="Description of Artificial Sequence: Synthetic peptide"
ILHLKSVRM

SEQ ID NO: 20864 - protein, 9 aa, Artificial Sequence
  source: /note="Description of Artificial Sequence: Synthetic peptide"
LHLKSVRML

SEQ ID NO: 20865 - protein, 10 aa, Artificial Sequence
  source: /note="Description of Artificial Sequence: Synthetic peptide"
GLMILHLKSV

SEQ ID NO: 20866 - protein, 10 aa, Artificial Sequence
  source: /note="Description of Artificial Sequence: Synthetic peptide"
ILHLKSVRML

SEQ ID NO: 20867 - protein, 10 aa, Artificial Sequence
  source: /note="Description of Artificial Sequence: Synthetic peptide"
HLKSVRMLSG

SEQ ID NO: 20868 - protein, 10 aa, Artificial Sequence
  source: /note="Description of Artificial Sequence: Synthetic peptide"
LMILHLKSVR

SEQ ID NO: 20869 - protein, 10 aa, Artificial Sequence
  source: /note="Description of Artificial Sequence: Synthetic peptide"
MILHLKSVRM

SEQ ID NO: 20870 - protein, 9 aa, Artificial Sequence
  source: /note="Description of Artificial Sequence: Synthetic peptide"
STRICQNTR

SEQ ID NO: 20871 - protein, 10 aa, Artificial Sequence
  source: /note="Description of Artificial Sequence: Synthetic peptide"
NSTRICQNTR

SEQ ID NO: 20872 - protein, 9 aa, Artificial Sequence
  source: /note="Description of Artificial Sequence: Synthetic peptide"
TQTWTRLPR

SEQ ID NO: 20873 - protein, 9 aa, Artificial Sequence
  source: /note="Description of Artificial Sequence: Synthetic peptide"
QTWTRLPRR

SEQ ID NO: 20874 - protein, 9 aa, Artificial Sequence
  source: /note="Description of Artificial Sequence: Synthetic peptide"
TWPTQTWTR

SEQ ID NO: 20875 - protein, 9 aa, Artificial Sequence
  source: /note="Description of Artificial Sequence: Synthetic peptide"
WPTQTWTRL

SEQ ID NO: 20876 - protein, 9 aa, Artificial Sequence
  source: /note="Description of Artificial Sequence: Synthetic peptide"
PPTWPTQTW

SEQ ID NO: 20877 - protein, 10 aa, Artificial Sequence
  source: /note="Description of Artificial Sequence: Synthetic peptide"
TWPTQTWTRL

SEQ ID NO: 20878 - protein, 10 aa, Artificial Sequence
  source: /note="Description of Artificial Sequence: Synthetic peptide"
RLPRRSCCSR

SEQ ID NO: 20879 - protein, 10 aa, Artificial Sequence
  source: /note="Description of Artificial Sequence: Synthetic peptide"
PTWPTQTWTR

SEQ ID NO: 20880 - protein, 10 aa, Artificial Sequence
  source: /note="Description of Artificial Sequence: Synthetic peptide"
PTQTWTRLPR

SEQ ID NO: 20881 - protein, 10 aa, Artificial Sequence
  source: /note="Description of Artificial Sequence: Synthetic peptide"
TQTWTRLPRR

SEQ ID NO: 20882 - protein, 10 aa, Artificial Sequence
  source: /note="Description of Artificial Sequence: Synthetic peptide"
SESTGNGPPT

SEQ ID NO: 20883 - protein, 10 aa, Artificial Sequence
  source: /note="Description of Artificial Sequence: Synthetic peptide"
ESTGNGPPTW

SEQ ID NO: 20884 - protein, 9 aa, Artificial Sequence
  source: /note="Description of Artificial Sequence: Synthetic peptide"
NLSVVEVSV

SEQ ID NO: 20885 - protein, 9 aa, Artificial Sequence
  source: /note="Description of Artificial Sequence: Synthetic peptide"
SVVEVSVSA

SEQ ID NO: 20886 - protein, 9 aa, Artificial Sequence
  source: /note="Description of Artificial Sequence: Synthetic peptide"
VEVSVSAVI

SEQ ID NO: 20887 - protein, 9 aa, Artificial Sequence
  source: /note="Description of Artificial Sequence: Synthetic peptide"
VSAVITPEM

SEQ ID NO: 20888 - protein, 10 aa, Artificial Sequence
  source: /note="Description of Artificial Sequence: Synthetic peptide"
SVVEVSVSAV

SEQ ID NO: 20889 - protein, 10 aa, Artificial Sequence
  source: /note="Description of Artificial Sequence: Synthetic peptide"
SVSAVITPEM

SEQ ID NO: 20890 - protein, 10 aa, Artificial Sequence
  source: /note="Description of Artificial Sequence: Synthetic peptide"
VEVSVSAVIT

SEQ ID NO: 20891 - protein, 9 aa, Artificial Sequence
  source: /note="Description of Artificial Sequence: Synthetic peptide"
LSTEKTMIY

SEQ ID NO: 20892 - protein, 9 aa, Artificial Sequence
  source: /note="Description of Artificial Sequence: Synthetic peptide"
STEKTMIYF

SEQ ID NO: 20893 - protein, 9 aa, Artificial Sequence
  source: /note="Description of Artificial Sequence: Synthetic peptide"
MIYFVGCFA

SEQ ID NO: 20894 - protein, 9 aa, Artificial Sequence
  source: /note="Description of Artificial Sequence: Synthetic peptide"
YFVGCFAQM

SEQ ID NO: 20895 - protein, 9 aa, Artificial Sequence
  source: /note="Description of Artificial Sequence: Synthetic peptide"
KTMIYFVGC

SEQ ID NO: 20896 - protein, 9 aa, Artificial Sequence
  source: /note="Description of Artificial Sequence: Synthetic peptide"
TMIYFVGCF

SEQ ID NO: 20897 - protein, 9 aa, Artificial Sequence
  source: /note="Description of Artificial Sequence: Synthetic peptide"
TEKTMIYFV

SEQ ID NO: 20898 - protein, 10 aa, Artificial Sequence
  source: /note="Description of Artificial Sequence: Synthetic peptide"
TMIYFVGCFA

SEQ ID NO: 20899 - protein, 10 aa, Artificial Sequence
  source: /note="Description of Artificial Sequence: Synthetic peptide"
KTMIYFVGCF

SEQ ID NO: 20900 - protein, 10 aa, Artificial Sequence
  source: /note="Description of Artificial Sequence: Synthetic peptide"
IYFVGCFAQM

SEQ ID NO: 20901 - protein, 10 aa, Artificial Sequence
  source: /note="Description of Artificial Sequence: Synthetic peptide"
VLSTEKTMIY

SEQ ID NO: 20902 - protein, 10 aa, Artificial Sequence
  source: /note="Description of Artificial Sequence: Synthetic peptide"
YFVGCFAQMY

SEQ ID NO: 20903 - protein, 10 aa, Artificial Sequence
  source: /note="Description of Artificial Sequence: Synthetic peptide"
STEKTMIYFV

SEQ ID NO: 20904 - protein, 10 aa, Artificial Sequence
  source: /note="Description of Artificial Sequence: Synthetic peptide"
LSTEKTMIYF

SEQ ID NO: 20905 - protein, 9 aa, Artificial Sequence
  source: /note="Description of Artificial Sequence: Synthetic peptide"
KTSSVIIGV

SEQ ID NO: 20906 - protein, 9 aa, Artificial Sequence
  source: /note="Description of Artificial Sequence: Synthetic peptide"
SVIIGVMLV

SEQ ID NO: 20907 - protein, 9 aa, Artificial Sequence
  source: /note="Description of Artificial Sequence: Synthetic peptide"
IIGVMLVCV

SEQ ID NO: 20908 - protein, 9 aa, Artificial Sequence
  source: /note="Description of Artificial Sequence: Synthetic peptide"
TSSVIIGVM

SEQ ID NO: 20909 - protein, 10 aa, Artificial Sequence
  source: /note="Description of Artificial Sequence: Synthetic peptide"
VIIGVMLVCV

SEQ ID NO: 20910 - protein, 10 aa, Artificial Sequence
  source: /note="Description of Artificial Sequence: Synthetic peptide"
KTSSVIIGVM

SEQ ID NO: 20911 - protein, 10 aa, Artificial Sequence
  source: /note="Description of Artificial Sequence: Synthetic peptide"
SSVIIGVMLV

SEQ ID NO: 20912 - protein, 10 aa, Artificial Sequence
  source: /note="Description of Artificial Sequence: Synthetic peptide"
CENKTSSVII

SEQ ID NO: 20913 - protein, 9 aa, Artificial Sequence
  source: /note="Description of Artificial Sequence: Synthetic peptide"
QLVQGACSI

SEQ ID NO: 20914 - protein, 9 aa, Artificial Sequence
  source: /note="Description of Artificial Sequence: Synthetic peptide"
RLRIQLVQG

SEQ ID NO: 20915 - protein, 9 aa, Artificial Sequence
  source: /note="Description of Artificial Sequence: Synthetic peptide"
VQGACSIGL

SEQ ID NO: 20916 - protein, 10 aa, Artificial Sequence
  source: /note="Description of Artificial Sequence: Synthetic peptide"
RLRIQLVQGA

SEQ ID NO: 20917 - protein, 10 aa, Artificial Sequence
  source: /note="Description of Artificial Sequence: Synthetic peptide"
IQLVQGACSI

SEQ ID NO: 20918 - protein, 10 aa, Artificial Sequence
  source: /note="Description of Artificial Sequence: Synthetic peptide"
VQGACSIGLI

SEQ ID NO: 20919 - protein, 9 aa, Artificial Sequence
  source: /note="Description of Artificial Sequence: Synthetic peptide"
KIASVEGQK

SEQ ID NO: 20920 - protein, 10 aa, Artificial Sequence
  source: /note="Description of Artificial Sequence: Synthetic peptide"
KIASVEGQKK

SEQ ID NO: 20921 - protein, 10 aa, Artificial Sequence
  source: /note="Description of Artificial Sequence: Synthetic peptide"
ASVEGQKKAF

SEQ ID NO: 20922 - protein, 9 aa, Artificial Sequence
  source: /note="Description of Artificial Sequence: Synthetic peptide"
VITPFISPI

SEQ ID NO: 20923 - protein, 9 aa, Artificial Sequence
  source: /note="Description of Artificial Sequence: Synthetic peptide"
FISPIIFSL

SEQ ID NO: 20924 - protein, 9 aa, Artificial Sequence
  source: /note="Description of Artificial Sequence: Synthetic peptide"
ISPIIFSLR

SEQ ID NO: 20925 - protein, 9 aa, Artificial Sequence
  source: /note="Description of Artificial Sequence: Synthetic peptide"
PYTVITPFI

SEQ ID NO: 20926 - protein, 9 aa, Artificial Sequence
  source: /note="Description of Artificial Sequence: Synthetic peptide"
ITPFISPII

SEQ ID NO: 20927 - protein, 9 aa, Artificial Sequence
  source: /note="Description of Artificial Sequence: Synthetic peptide"
TPFISPIIF

SEQ ID NO: 20928 - protein, 10 aa, Artificial Sequence
  source: /note="Description of Artificial Sequence: Synthetic peptide"
TVITPFISPI

SEQ ID NO: 20929 - protein, 10 aa, Artificial Sequence
  source: /note="Description of Artificial Sequence: Synthetic peptide"
VITPFISPII

SEQ ID NO: 20930 - protein, 10 aa, Artificial Sequence
  source: /note="Description of Artificial Sequence: Synthetic peptide"
FISPIIFSLR

SEQ ID NO: 20931 - protein, 10 aa, Artificial Sequence
  source: /note="Description of Artificial Sequence: Synthetic peptide"
ITPFISPIIF

SEQ ID NO: 20932 - protein, 10 aa, Artificial Sequence
  source: /note="Description of Artificial Sequence: Synthetic peptide"
PFISPIIFSL

SEQ ID NO: 20933 - protein, 10 aa, Artificial Sequence
  source: /note="Description of Artificial Sequence: Synthetic peptide"
VPYTVITPFI

SEQ ID NO: 20934 - protein, 9 aa, Artificial Sequence
  source: /note="Description of Artificial Sequence: Synthetic peptide"
RIFILSLFV

SEQ ID NO: 20935 - protein, 9 aa, Artificial Sequence
  source: /note="Description of Artificial Sequence: Synthetic peptide"
FILSLFVLL

SEQ ID NO: 20936 - protein, 9 aa, Artificial Sequence
  source: /note="Description of Artificial Sequence: Synthetic peptide"
ILSLFVLLV

SEQ ID NO: 20937 - protein, 9 aa, Artificial Sequence
  source: /note="Description of Artificial Sequence: Synthetic peptide"
LRIFILSLF

SEQ ID NO: 20938 - protein, 9 aa, Artificial Sequence
  source: /note="Description of Artificial Sequence: Synthetic peptide"
IFILSLFVL

SEQ ID NO: 20939 - protein, 9 aa, Artificial Sequence
  source: /note="Description of Artificial Sequence: Synthetic peptide"
SLFVLLVSF

SEQ ID NO: 20940 - protein, 9 aa, Artificial Sequence
  source: /note="Description of Artificial Sequence: Synthetic peptide"
LFVLLVSFF

SEQ ID NO: 20941 - protein, 9 aa, Artificial Sequence
  source: /note="Description of Artificial Sequence: Synthetic peptide"
FVLLVSFFF

SEQ ID NO: 20942 - protein, 10 aa, Artificial Sequence
  source: /note="Description of Artificial Sequence: Synthetic peptide"
RIFILSLFVL

SEQ ID NO: 20943 - protein, 10 aa, Artificial Sequence
  source: /note="Description of Artificial Sequence: Synthetic peptide"
FILSLFVLLV

SEQ ID NO: 20944 - protein, 10 aa, Artificial Sequence
  source: /note="Description of Artificial Sequence: Synthetic peptide"
FVLLVSFFFI

SEQ ID NO: 20945 - protein, 10 aa, Artificial Sequence
  source: /note="Description of Artificial Sequence: Synthetic peptide"
IFILSLFVLL

SEQ ID NO: 20946 - protein, 10 aa, Artificial Sequence
  source: /note="Description of Artificial Sequence: Synthetic peptide"
LSLFVLLVSF

SEQ ID NO: 20947 - protein, 10 aa, Artificial Sequence
  source: /note="Description of Artificial Sequence: Synthetic peptide"
SLFVLLVSFF

SEQ ID NO: 20948 - protein, 10 aa, Artificial Sequence
  source: /note="Description of Artificial Sequence: Synthetic peptide"
LFVLLVSFFF

SEQ ID NO: 20949 - protein, 10 aa, Artificial Sequence
  source: /note="Description of Artificial Sequence: Synthetic peptide"
ELRIFILSLF

SEQ ID NO: 20950 - protein, 9 aa, Artificial Sequence
  source: /note="Description of Artificial Sequence: Synthetic peptide"
IMTGPLCAK

SEQ ID NO: 20951 - protein, 9 aa, Artificial Sequence
  source: /note="Description of Artificial Sequence: Synthetic peptide"
MTGPLCAKL

SEQ ID NO: 20952 - protein, 9 aa, Artificial Sequence
  source: /note="Description of Artificial Sequence: Synthetic peptide"
YPNIMTGPL

SEQ ID NO: 20953 - protein, 9 aa, Artificial Sequence
  source: /note="Description of Artificial Sequence: Synthetic peptide"
GPLCAKLVI

SEQ ID NO: 20954 - protein, 10 aa, Artificial Sequence
  source: /note="Description of Artificial Sequence: Synthetic peptide"
IMTGPLCAKL

SEQ ID NO: 20955 - protein, 10 aa, Artificial Sequence
  source: /note="Description of Artificial Sequence: Synthetic peptide"
LLYPNIMTGP

SEQ ID NO: 20956 - protein, 10 aa, Artificial Sequence
  source: /note="Description of Artificial Sequence: Synthetic peptide"
NIMTGPLCAK

SEQ ID NO: 20957 - protein, 10 aa, Artificial Sequence
  source: /note="Description of Artificial Sequence: Synthetic peptide"
LYPNIMTGPL

SEQ ID NO: 20958 - protein, 10 aa, Artificial Sequence
  source: /note="Description of Artificial Sequence: Synthetic peptide"
MTGPLCAKLV

SEQ ID NO: 20959 - protein, 10 aa, Artificial Sequence
  source: /note="Description of Artificial Sequence: Synthetic peptide"
GPLCAKLVIL

SEQ ID NO: 20960 - protein, 10 aa, Artificial Sequence
  source: /note="Description of Artificial Sequence: Synthetic peptide"
YPNIMTGPLC

SEQ ID NO: 20961 - protein, 9 aa, Artificial Sequence
  source: /note="Description of Artificial Sequence: Synthetic peptide"
TIVVEFFLK

SEQ ID NO: 20962 - protein, 9 aa, Artificial Sequence
  source: /note="Description of Artificial Sequence: Synthetic peptide"
HTIVVEFFL

SEQ ID NO: 20963 - protein, 9 aa, Artificial Sequence
  source: /note="Description of Artificial Sequence: Synthetic peptide"
MEWENHTIV

SEQ ID NO: 20964 - protein, 10 aa, Artificial Sequence
  source: /note="Description of Artificial Sequence: Synthetic peptide"
IVVEFFLKGL

SEQ ID NO: 20965 - protein, 10 aa, Artificial Sequence
  source: /note="Description of Artificial Sequence: Synthetic peptide"
HTIVVEFFLK

SEQ ID NO: 20966 - protein, 10 aa, Artificial Sequence
  source: /note="Description of Artificial Sequence: Synthetic peptide"
MEWENHTIVV

SEQ ID NO: 20967 - protein, 10 aa, Artificial Sequence
  source: /note="Description of Artificial Sequence: Synthetic peptide"
WENHTIVVEF

SEQ ID NO: 20968 - protein, 9 aa, Artificial Sequence
  source: /note="Description of Artificial Sequence: Synthetic peptide"
VIYTYIHPA

SEQ ID NO: 20969 - protein, 9 aa, Artificial Sequence
  source: /note="Description of Artificial Sequence: Synthetic peptide"
YIHPASSYT

SEQ ID NO: 20970 - protein, 9 aa, Artificial Sequence
  source: /note="Description of Artificial Sequence: Synthetic peptide"
IHPASSYTF

SEQ ID NO: 20971 - protein, 9 aa, Artificial Sequence
  source: /note="Description of Artificial Sequence: Synthetic peptide"
TYIHPASSY

SEQ ID NO: 20972 - protein, 9 aa, Artificial Sequence
  source: /note="Description of Artificial Sequence: Synthetic peptide"
YTYIHPASS

SEQ ID NO: 20973 - protein, 9 aa, Artificial Sequence
  source: /note="Description of Artificial Sequence: Synthetic peptide"
SPVIYTYIH

SEQ ID NO: 20974 - protein, 10 aa, Artificial Sequence
  source: /note="Description of Artificial Sequence: Synthetic peptide"
YTYIHPASSY

SEQ ID NO: 20975 - protein, 10 aa, Artificial Sequence
  source: /note="Description of Artificial Sequence: Synthetic peptide"
YIHPASSYTF

SEQ ID NO: 20976 - protein, 10 aa, Artificial Sequence
  source: /note="Description of Artificial Sequence: Synthetic peptide"
HPASSYTFER

SEQ ID NO: 20977 - protein, 9 aa, Artificial Sequence
  source: /note="Description of Artificial Sequence: Synthetic peptide"
TACTFSLSY

SEQ ID NO: 20978 - protein, 9 aa, Artificial Sequence
  source: /note="Description of Artificial Sequence: Synthetic peptide"
HTACTFSLS

SEQ ID NO: 20979 - protein, 9 aa, Artificial Sequence
  source: /note="Description of Artificial Sequence: Synthetic peptide"
AVMHTACTF

SEQ ID NO: 20980 - protein, 9 aa, Artificial Sequence
  source: /note="Description of Artificial Sequence: Synthetic peptide"
MHTACTFSL

SEQ ID NO: 20981 - protein, 10 aa, Artificial Sequence
  source: /note="Description of Artificial Sequence: Synthetic peptide"
HTACTFSLSY

SEQ ID NO: 20982 - protein, 10 aa, Artificial Sequence
  source: /note="Description of Artificial Sequence: Synthetic peptide"
VMHTACTFSL

SEQ ID NO: 20983 - protein, 10 aa, Artificial Sequence
  source: /note="Description of Artificial Sequence: Synthetic peptide"
GLIAVMHTAC

SEQ ID NO: 20984 - protein, 10 aa, Artificial Sequence
  source: /note="Description of Artificial Sequence: Synthetic peptide"
IAVMHTACTF

SEQ ID NO: 20985 - protein, 9 aa, Artificial Sequence
  source: /note="Description of Artificial Sequence: Synthetic peptide"
NLSLIDFCL

SEQ ID NO: 20986 - protein, 9 aa, Artificial Sequence
  source: /note="Description of Artificial Sequence: Synthetic peptide"
SLIDFCLAT

SEQ ID NO: 20987 - protein, 9 aa, Artificial Sequence
  source: /note="Description of Artificial Sequence: Synthetic peptide"
FFLANLSLI

SEQ ID NO: 20988 - protein, 9 aa, Artificial Sequence
  source: /note="Description of Artificial Sequence: Synthetic peptide"
LANLSLIDF

SEQ ID NO: 20989 - protein, 10 aa, Artificial Sequence
  source: /note="Description of Artificial Sequence: Synthetic peptide"
NLSLIDFCLA

SEQ ID NO: 20990 - protein, 10 aa, Artificial Sequence
  source: /note="Description of Artificial Sequence: Synthetic peptide"
FLANLSLIDF

SEQ ID NO: 20991 - protein, 10 aa, Artificial Sequence
  source: /note="Description of Artificial Sequence: Synthetic peptide"
YFFLANLSLI

SEQ ID NO: 20992 - protein, 10 aa, Artificial Sequence
  source: /note="Description of Artificial Sequence: Synthetic peptide"
IDFCLATNTI

SEQ ID NO: 20993 - protein, 9 aa, Artificial Sequence
  source: /note="Description of Artificial Sequence: Synthetic peptide"
ILVNLLHPA

SEQ ID NO: 20994 - protein, 9 aa, Artificial Sequence
  source: /note="Description of Artificial Sequence: Synthetic peptide"
CSTVPQILV

SEQ ID NO: 20995 - protein, 9 aa, Artificial Sequence
  source: /note="Description of Artificial Sequence: Synthetic peptide"
TVPQILVNL

SEQ ID NO: 20996 - protein, 9 aa, Artificial Sequence
  source: /note="Description of Artificial Sequence: Synthetic peptide"
VPQILVNLL

SEQ ID NO: 20997 - protein, 10 aa, Artificial Sequence
  source: /note="Description of Artificial Sequence: Synthetic peptide"
ILVNLLHPAK

SEQ ID NO: 20998 - protein, 10 aa, Artificial Sequence
  source: /note="Description of Artificial Sequence: Synthetic peptide"
STVPQILVNL

SEQ ID NO: 20999 - protein, 10 aa, Artificial Sequence
  source: /note="Description of Artificial Sequence: Synthetic peptide"
TVPQILVNLL

SEQ ID NO: 21000 - protein, 9 aa, Artificial Sequence
  source: /note="Description of Artificial Sequence: Synthetic peptide"
QMFLFLCFA

SEQ ID NO: 21001 - protein, 9 aa, Artificial Sequence
  source: /note="Description of Artificial Sequence: Synthetic peptide"
FLFLCFAHT

SEQ ID NO: 21002 - protein, 9 aa, Artificial Sequence
  source: /note="Description of Artificial Sequence: Synthetic peptide"
FLCFAHTEC

SEQ ID NO: 21003 - protein, 9 aa, Artificial Sequence
  source: /note="Description of Artificial Sequence: Synthetic peptide"
TQMFLFLCF

SEQ ID NO: 21004 - protein, 9 aa, Artificial Sequence
  source: /note="Description of Artificial Sequence: Synthetic peptide"
LCFAHTECL

SEQ ID NO: 21005 - protein, 10 aa, Artificial Sequence
  source: /note="Description of Artificial Sequence: Synthetic peptide"
MTQMFLFLCF

SEQ ID NO: 21006 - protein, 10 aa, Artificial Sequence
  source: /note="Description of Artificial Sequence: Synthetic peptide"
TQMFLFLCFA

SEQ ID NO: 21007 - protein, 10 aa, Artificial Sequence
  source: /note="Description of Artificial Sequence: Synthetic peptide"
FLCFAHTECL

SEQ ID NO: 21008 - protein, 10 aa, Artificial Sequence
  source: /note="Description of Artificial Sequence: Synthetic peptide"
CFAHTECLLL

SEQ ID NO: 21009 - protein, 10 aa, Artificial Sequence
  source: /note="Description of Artificial Sequence: Synthetic peptide"
QMFLFLCFAH

SEQ ID NO: 21010 - protein, 9 aa, Artificial Sequence
  source: /note="Description of Artificial Sequence: Synthetic peptide"
HLAIIDILY

SEQ ID NO: 21011 - protein, 9 aa, Artificial Sequence
  source: /note="Description of Artificial Sequence: Synthetic peptide"
AIIDILYAS

SEQ ID NO: 21012 - protein, 9 aa, Artificial Sequence
  source: /note="Description of Artificial Sequence: Synthetic peptide"
LYASNNVPK

SEQ ID NO: 21013 - protein, 9 aa, Artificial Sequence
  source: /note="Description of Artificial Sequence: Synthetic peptide"
DILYASNNV

SEQ ID NO: 21014 - protein, 9 aa, Artificial Sequence
  source: /note="Description of Artificial Sequence: Synthetic peptide"
ILYASNNVP

SEQ ID NO: 21015 - protein, 10 aa, Artificial Sequence
  source: /note="Description of Artificial Sequence: Synthetic peptide"
HLAIIDILYA

SEQ ID NO: 21016 - protein, 10 aa, Artificial Sequence
  source: /note="Description of Artificial Sequence: Synthetic peptide"
ILYASNNVPK

SEQ ID NO: 21017 - protein, 10 aa, Artificial Sequence
  source: /note="Description of Artificial Sequence: Synthetic peptide"
LYASNNVPKM

SEQ ID NO: 21018 - protein, 10 aa, Artificial Sequence
  source: /note="Description of Artificial Sequence: Synthetic peptide"
SHLAIIDILY

SEQ ID NO: 21019 - protein, 10 aa, Artificial Sequence
  source: /note="Description of Artificial Sequence: Synthetic peptide"
LSHLAIIDIL

SEQ ID NO: 21020 - protein, 10 aa, Artificial Sequence
  source: /note="Description of Artificial Sequence: Synthetic peptide"
IDILYASNNV

SEQ ID NO: 21021 - protein, 9 aa, Artificial Sequence
  source: /note="Description of Artificial Sequence: Synthetic peptide"
IVVWMFYGA

SEQ ID NO: 21022 - protein, 9 aa, Artificial Sequence
  source: /note="Description of Artificial Sequence: Synthetic peptide"
WMFYGAATF

SEQ ID NO: 21023 - protein, 9 aa, Artificial Sequence
  source: /note="Description of Artificial Sequence: Synthetic peptide"
HLIVVWMFY

SEQ ID NO: 21024 - protein, 9 aa, Artificial Sequence
  source: /note="Description of Artificial Sequence: Synthetic peptide"
SHLIVVWMF

SEQ ID NO: 21025 - protein, 9 aa, Artificial Sequence
  source: /note="Description of Artificial Sequence: Synthetic peptide"
SSHLIVVWM

SEQ ID NO: 21026 - protein, 9 aa, Artificial Sequence
  source: /note="Description of Artificial Sequence: Synthetic peptide"
CSSHLIVVW

SEQ ID NO: 21027 - protein, 10 aa, Artificial Sequence
  source: /note="Description of Artificial Sequence: Synthetic peptide"
LIVVWMFYGA

SEQ ID NO: 21028 - protein, 10 aa, Artificial Sequence
  source: /note="Description of Artificial Sequence: Synthetic peptide"
WMFYGAATFM

SEQ ID NO: 21029 - protein, 10 aa, Artificial Sequence
  source: /note="Description of Artificial Sequence: Synthetic peptide"
SSHLIVVWMF

SEQ ID NO: 21030 - protein, 10 aa, Artificial Sequence
  source: /note="Description of Artificial Sequence: Synthetic peptide"
VWMFYGAATF

SEQ ID NO: 21031 - protein, 10 aa, Artificial Sequence
  source: /note="Description of Artificial Sequence: Synthetic peptide"
SHLIVVWMFY

SEQ ID NO: 21032 - protein, 10 aa, Artificial Sequence
  source: /note="Description of Artificial Sequence: Synthetic peptide"
IVVWMFYGAA

SEQ ID NO: 21033 - protein, 9 aa, Artificial Sequence
  source: /note="Description of Artificial Sequence: Synthetic peptide"
FQYGCINSL

SEQ ID NO: 21034 - protein, 9 aa, Artificial Sequence
  source: /note="Description of Artificial Sequence: Synthetic peptide"
CINSLLFVV

SEQ ID NO: 21035 - protein, 9 aa, Artificial Sequence
  source: /note="Description of Artificial Sequence: Synthetic peptide"
QYGCINSLL

SEQ ID NO: 21036 - protein, 9 aa, Artificial Sequence
  source: /note="Description of Artificial Sequence: Synthetic peptide"
YGCINSLLF

SEQ ID NO: 21037 - protein, 10 aa, Artificial Sequence
  source: /note="Description of Artificial Sequence: Synthetic peptide"
FQYGCINSLL

SEQ ID NO: 21038 - protein, 10 aa, Artificial Sequence
  source: /note="Description of Artificial Sequence: Synthetic peptide"
CINSLLFVVI

SEQ ID NO: 21039 - protein, 10 aa, Artificial Sequence
  source: /note="Description of Artificial Sequence: Synthetic peptide"
QYGCINSLLF

SEQ ID NO: 21040 - protein, 9 aa, Artificial Sequence
  source: /note="Description of Artificial Sequence: Synthetic peptide"
WINSLLFVI

SEQ ID NO: 21041 - protein, 9 aa, Artificial Sequence
  source: /note="Description of Artificial Sequence: Synthetic peptide"
SLLFVIIAT

SEQ ID NO: 21042 - protein, 9 aa, Artificial Sequence
  source: /note="Description of Artificial Sequence: Synthetic peptide"
LLFVIIATL

SEQ ID NO: 21043 - protein, 9 aa, Artificial Sequence
  source: /note="Description of Artificial Sequence: Synthetic peptide"
VIIATLFTV

SEQ ID NO: 21044 - protein, 9 aa, Artificial Sequence
  source: /note="Description of Artificial Sequence: Synthetic peptide"
IIATLFTVA

SEQ ID NO: 21045 - protein, 9 aa, Artificial Sequence
  source: /note="Description of Artificial Sequence: Synthetic peptide"
LFVIIATLF

SEQ ID NO: 21046 - protein, 10 aa, Artificial Sequence
  source: /note="Description of Artificial Sequence: Synthetic peptide"
WINSLLFVII

SEQ ID NO: 21047 - protein, 10 aa, Artificial Sequence
  source: /note="Description of Artificial Sequence: Synthetic peptide"
SLLFVIIATL

SEQ ID NO: 21048 - protein, 10 aa, Artificial Sequence
  source: /note="Description of Artificial Sequence: Synthetic peptide"
FVIIATLFTV

SEQ ID NO: 21049 - protein, 10 aa, Artificial Sequence
  source: /note="Description of Artificial Sequence: Synthetic peptide"
VIIATLFTVA

SEQ ID NO: 21050 - protein, 10 aa, Artificial Sequence
  source: /note="Description of Artificial Sequence: Synthetic peptide"
IIATLFTVAL

SEQ ID NO: 21051 - protein, 10 aa, Artificial Sequence
  source: /note="Description of Artificial Sequence: Synthetic peptide"
GWINSLLFVI

SEQ ID NO: 21052 - protein, 10 aa, Artificial Sequence
  source: /note="Description of Artificial Sequence: Synthetic peptide"
LLFVIIATLF

SEQ ID NO: 21053 - protein, 9 aa, Artificial Sequence
  source: /note="Description of Artificial Sequence: Synthetic peptide"
KSDNHSFLV

SEQ ID NO: 21054 - protein, 9 aa, Artificial Sequence
  source: /note="Description of Artificial Sequence: Synthetic peptide"
FLVDSPKAF

SEQ ID NO: 21055 - protein, 9 aa, Artificial Sequence
  source: /note="Description of Artificial Sequence: Synthetic peptide"
HSFLVDSPK

SEQ ID NO: 21056 - protein, 10 aa, Artificial Sequence
  source: /note="Description of Artificial Sequence: Synthetic peptide"
FLVDSPKAFI

SEQ ID NO: 21057 - protein, 10 aa, Artificial Sequence
  source: /note="Description of Artificial Sequence: Synthetic peptide"
SFLVDSPKAF

SEQ ID NO: 21058 - protein, 10 aa, Artificial Sequence
  source: /note="Description of Artificial Sequence: Synthetic peptide"
MKSDNHSFLV

SEQ ID NO: 21059 - protein, 9 aa, Artificial Sequence
  source: /note="Description of Artificial Sequence: Synthetic peptide"
IYTLRNKEI

SEQ ID NO: 21060 - protein, 9 aa, Artificial Sequence
  source: /note="Description of Artificial Sequence: Synthetic peptide"
AVASVFIFV

SEQ ID NO: 21061 - protein, 9 aa, Artificial Sequence
  source: /note="Description of Artificial Sequence: Synthetic peptide"
SVFIFVVPL

SEQ ID NO: 21062 - protein, 9 aa, Artificial Sequence
  source: /note="Description of Artificial Sequence: Synthetic peptide"
FIFVVPLSL

SEQ ID NO: 21063 - protein, 9 aa, Artificial Sequence
  source: /note="Description of Artificial Sequence: Synthetic peptide"
FVVPLSLIL

SEQ ID NO: 21064 - protein, 9 aa, Artificial Sequence
  source: /note="Description of Artificial Sequence: Synthetic peptide"
VAVASVFIF

SEQ ID NO: 21065 - protein, 9 aa, Artificial Sequence
  source: /note="Description of Artificial Sequence: Synthetic peptide"
IFVVPLSLI

SEQ ID NO: 21066 - protein, 9 aa, Artificial Sequence
  source: /note="Description of Artificial Sequence: Synthetic peptide"
VASVFIFVV

SEQ ID NO: 21067 - protein, 10 aa, Artificial Sequence
  source: /note="Description of Artificial Sequence: Synthetic peptide"
VAVASVFIFV

SEQ ID NO: 21068 - protein, 10 aa, Artificial Sequence
  source: /note="Description of Artificial Sequence: Synthetic peptide"
AVASVFIFVV

SEQ ID NO: 21069 - protein, 10 aa, Artificial Sequence
  source: /note="Description of Artificial Sequence: Synthetic peptide"
FIFVVPLSLI

SEQ ID NO: 21070 - protein, 10 aa, Artificial Sequence
  source: /note="Description of Artificial Sequence: Synthetic peptide"
FVVPLSLILV

SEQ ID NO: 21071 - protein, 10 aa, Artificial Sequence
  source: /note="Description of Artificial Sequence: Synthetic peptide"
VFIFVVPLSL

SEQ ID NO: 21072 - protein, 10 aa, Artificial Sequence
  source: /note="Description of Artificial Sequence: Synthetic peptide"
IFVVPLSLIL

SEQ ID NO: 21073 - protein, 10 aa, Artificial Sequence
  source: /note="Description of Artificial Sequence: Synthetic peptide"
QVAVASVFIF

SEQ ID NO: 21074 - protein, 10 aa, Artificial Sequence
  source: /note="Description of Artificial Sequence: Synthetic peptide"
ASVFIFVVPL

SEQ ID NO: 21075 - protein, 9 aa, Artificial Sequence
  source: /note="Description of Artificial Sequence: Synthetic peptide"
MQSTTWLQK

SEQ ID NO: 21076 - protein, 9 aa, Artificial Sequence
  source: /note="Description of Artificial Sequence: Synthetic peptide"
TTWLQKVFR

SEQ ID NO: 21077 - protein, 9 aa, Artificial Sequence
  source: /note="Description of Artificial Sequence: Synthetic peptide"
QSTTWLQKV

SEQ ID NO: 21078 - protein, 9 aa, Artificial Sequence
  source: /note="Description of Artificial Sequence: Synthetic peptide"
VLSMQSTTW

SEQ ID NO: 21079 - protein, 9 aa, Artificial Sequence
  source: /note="Description of Artificial Sequence: Synthetic peptide"
LSMQSTTWL

SEQ ID NO: 21080 - protein, 9 aa, Artificial Sequence
  source: /note="Description of Artificial Sequence: Synthetic peptide"
STTWLQKVF

SEQ ID NO: 21081 - protein, 10 aa, Artificial Sequence
  source: /note="Description of Artificial Sequence: Synthetic peptide"
VLSMQSTTWL

SEQ ID NO: 21082 - protein, 10 aa, Artificial Sequence
  source: /note="Description of Artificial Sequence: Synthetic peptide"
MQSTTWLQKV

SEQ ID NO: 21083 - protein, 10 aa, Artificial Sequence
  source: /note="Description of Artificial Sequence: Synthetic peptide"
SMQSTTWLQK

SEQ ID NO: 21084 - protein, 10 aa, Artificial Sequence
  source: /note="Description of Artificial Sequence: Synthetic peptide"
STTWLQKVFR

SEQ ID NO: 21085 - protein, 10 aa, Artificial Sequence
  source: /note="Description of Artificial Sequence: Synthetic peptide"
AVLSMQSTTW

SEQ ID NO: 21086 - protein, 10 aa, Artificial Sequence
  source: /note="Description of Artificial Sequence: Synthetic peptide"
QSTTWLQKVF

SEQ ID NO: 21087 - protein, 9 aa, Artificial Sequence
  source: /note="Description of Artificial Sequence: Synthetic peptide"
VQSFFFLTI

SEQ ID NO: 21088 - protein, 9 aa, Artificial Sequence
  source: /note="Description of Artificial Sequence: Synthetic peptide"
QSFFFLTIA

SEQ ID NO: 21089 - protein, 9 aa, Artificial Sequence
  source: /note="Description of Artificial Sequence: Synthetic peptide"
LTIACSEGL

SEQ ID NO: 21090 - protein, 9 aa, Artificial Sequence
  source: /note="Description of Artificial Sequence: Synthetic peptide"
IACSEGLLL

SEQ ID NO: 21091 - protein, 10 aa, Artificial Sequence
  source: /note="Description of Artificial Sequence: Synthetic peptide"
FLTIACSEGL

SEQ ID NO: 21092 - protein, 10 aa, Artificial Sequence
  source: /note="Description of Artificial Sequence: Synthetic peptide"
GVQSFFFLTI

SEQ ID NO: 21093 - protein, 10 aa, Artificial Sequence
  source: /note="Description of Artificial Sequence: Synthetic peptide"
LTIACSEGLL

SEQ ID NO: 21094 - protein, 10 aa, Artificial Sequence
  source: /note="Description of Artificial Sequence: Synthetic peptide"
VQSFFFLTIA

SEQ ID NO: 21095 - protein, 9 aa, Artificial Sequence
  source: /note="Description of Artificial Sequence: Synthetic peptide"
TISAHLTVV

SEQ ID NO: 21096 - protein, 9 aa, Artificial Sequence
  source: /note="Description of Artificial Sequence: Synthetic peptide"
KAFTTISAH

SEQ ID NO: 21097 - protein, 9 aa, Artificial Sequence
  source: /note="Description of Artificial Sequence: Synthetic peptide"
AHLTVVIFY

SEQ ID NO: 21098 - protein, 9 aa, Artificial Sequence
  source: /note="Description of Artificial Sequence: Synthetic peptide"
FTTISAHLT

SEQ ID NO: 21099 - protein, 9 aa, Artificial Sequence
  source: /note="Description of Artificial Sequence: Synthetic peptide"
TTISAHLTV

SEQ ID NO: 21100 - protein, 9 aa, Artificial Sequence
  source: /note="Description of Artificial Sequence: Synthetic peptide"
SAHLTVVIF

SEQ ID NO: 21101 - protein, 9 aa, Artificial Sequence
  source: /note="Description of Artificial Sequence: Synthetic peptide"
KKAFTTISA

SEQ ID NO: 21102 - protein, 9 aa, Artificial Sequence
  source: /note="Description of Artificial Sequence: Synthetic peptide"
ISAHLTVVI

SEQ ID NO: 21103 - protein, 10 aa, Artificial Sequence
  source: /note="Description of Artificial Sequence: Synthetic peptide"
FTTISAHLTV

SEQ ID NO: 21104 - protein, 10 aa, Artificial Sequence
  source: /note="Description of Artificial Sequence: Synthetic peptide"
TTISAHLTVV

SEQ ID NO: 21105 - protein, 10 aa, Artificial Sequence
  source: /note="Description of Artificial Sequence: Synthetic peptide"
TISAHLTVVI

SEQ ID NO: 21106 - protein, 10 aa, Artificial Sequence
  source: /note="Description of Artificial Sequence: Synthetic peptide"
ISAHLTVVIF

SEQ ID NO: 21107 - protein, 10 aa, Artificial Sequence
  source: /note="Description of Artificial Sequence: Synthetic peptide"
RKKAFTTISA

SEQ ID NO: 21108 - protein, 10 aa, Artificial Sequence
  source: /note="Description of Artificial Sequence: Synthetic peptide"
KAFTTISAHL

SEQ ID NO: 21109 - protein, 10 aa, Artificial Sequence
  source: /note="Description of Artificial Sequence: Synthetic peptide"
SAHLTVVIFY

SEQ ID NO: 21110 - protein, 10 aa, Artificial Sequence
  source: /note="Description of Artificial Sequence: Synthetic peptide"
AHLTVVIFYY

SEQ ID NO: 21111 - protein, 10 aa, Artificial Sequence
  source: /note="Description of Artificial Sequence: Synthetic peptide"
KKAFTTISAH

SEQ ID NO: 21112 - protein, 9 aa, Artificial Sequence
  source: /note="Description of Artificial Sequence: Synthetic peptide"
QLSIIDLNY

SEQ ID NO: 21113 - protein, 9 aa, Artificial Sequence
  source: /note="Description of Artificial Sequence: Synthetic peptide"
FLLSQLSII

SEQ ID NO: 21114 - protein, 10 aa, Artificial Sequence
  source: /note="Description of Artificial Sequence: Synthetic peptide"
LLSQLSIIDL

SEQ ID NO: 21115 - protein, 10 aa, Artificial Sequence
  source: /note="Description of Artificial Sequence: Synthetic peptide"
QLSIIDLNYI

SEQ ID NO: 21116 - protein, 10 aa, Artificial Sequence
  source: /note="Description of Artificial Sequence: Synthetic peptide"
YFLLSQLSII

SEQ ID NO: 21117 - protein, 10 aa, Artificial Sequence
  source: /note="Description of Artificial Sequence: Synthetic peptide"
SQLSIIDLNY

SEQ ID NO: 21118 - protein, 9 aa, Artificial Sequence
  source: /note="Description of Artificial Sequence: Synthetic peptide"
IENYNQTST

SEQ ID NO: 21119 - protein, 10 aa, Artificial Sequence
  source: /note="Description of Artificial Sequence: Synthetic peptide"
IIYSLRNREV

SEQ ID NO: 21120 - protein, 10 aa, Artificial Sequence
  source: /note="Description of Artificial Sequence: Synthetic peptide"
RNREVMGALT

SEQ ID NO: 21121 - protein, 10 aa, Artificial Sequence
  source: /note="Description of Artificial Sequence: Synthetic peptide"
REVMGALTRV

SEQ ID NO: 21122 - protein, 9 aa, Artificial Sequence
  source: /note="Description of Artificial Sequence: Synthetic peptide"
ASMAYDCYI

SEQ ID NO: 21123 - protein, 9 aa, Artificial Sequence
  source: /note="Description of Artificial Sequence: Synthetic peptide"
SMAYDCYIA

SEQ ID NO: 21124 - protein, 9 aa, Artificial Sequence
  source: /note="Description of Artificial Sequence: Synthetic peptide"
MAYDCYIAI

SEQ ID NO: 21125 - protein, 9 aa, Artificial Sequence
  source: /note="Description of Artificial Sequence: Synthetic peptide"
CYIAICFPL

SEQ ID NO: 21126 - protein, 10 aa, Artificial Sequence
  source: /note="Description of Artificial Sequence: Synthetic peptide"
SMAYDCYIAI

SEQ ID NO: 21127 - protein, 10 aa, Artificial Sequence
  source: /note="Description of Artificial Sequence: Synthetic peptide"
AYDCYIAICF

SEQ ID NO: 21128 - protein, 10 aa, Artificial Sequence
  source: /note="Description of Artificial Sequence: Synthetic peptide"
CYIAICFPLH

SEQ ID NO: 21129 - protein, 9 aa, Artificial Sequence
  source: /note="Description of Artificial Sequence: Synthetic peptide"
RSSAINHFF

SEQ ID NO: 21130 - protein, 9 aa, Artificial Sequence
  source: /note="Description of Artificial Sequence: Synthetic peptide"
IPYCRSSAI

SEQ ID NO: 21131 - protein, 9 aa, Artificial Sequence
  source: /note="Description of Artificial Sequence: Synthetic peptide"
CRSSAINHF

SEQ ID NO: 21132 - protein, 10 aa, Artificial Sequence
  source: /note="Description of Artificial Sequence: Synthetic peptide"
HIPYCRSSAI

SEQ ID NO: 21133 - protein, 10 aa, Artificial Sequence
  source: /note="Description of Artificial Sequence: Synthetic peptide"
SAINHFFCDV

SEQ ID NO: 21134 - protein, 10 aa, Artificial Sequence
  source: /note="Description of Artificial Sequence: Synthetic peptide"
RSSAINHFFC

SEQ ID NO: 21135 - protein, 10 aa, Artificial Sequence
  source: /note="Description of Artificial Sequence: Synthetic peptide"
YCRSSAINHF

SEQ ID NO: 21136 - protein, 10 aa, Artificial Sequence
  source: /note="Description of Artificial Sequence: Synthetic peptide"
LHIPYCRSSA

SEQ ID NO: 21137 - protein, 10 aa, Artificial Sequence
  source: /note="Description of Artificial Sequence: Synthetic peptide"
CRSSAINHFF

SEQ ID NO: 21138 - protein, 9 aa, Artificial Sequence
  source: /note="Description of Artificial Sequence: Synthetic peptide"
FLSHHLSRV

SEQ ID NO: 21139 - protein, 9 aa, Artificial Sequence
  source: /note="Description of Artificial Sequence: Synthetic peptide"
SLHWYFMFL

SEQ ID NO: 21140 - protein, 9 aa, Artificial Sequence
  source: /note="Description of Artificial Sequence: Synthetic peptide"
FMFLWPGSL

SEQ ID NO: 21141 - protein, 9 aa, Artificial Sequence
  source: /note="Description of Artificial Sequence: Synthetic peptide"
FLWPGSLCC

SEQ ID NO: 21142 - protein, 9 aa, Artificial Sequence
  source: /note="Description of Artificial Sequence: Synthetic peptide"
SLCCLPHEI

SEQ ID NO: 21143 - protein, 9 aa, Artificial Sequence
  source: /note="Description of Artificial Sequence: Synthetic peptide"
LLCTFCLHL

SEQ ID NO: 21144 - protein, 9 aa, Artificial Sequence
  source: /note="Description of Artificial Sequence: Synthetic peptide"
SLFDLQHPP

SEQ ID NO: 21145 - protein, 9 aa, Artificial Sequence
  source: /note="Description of Artificial Sequence: Synthetic peptide"
CLHLSTSKI

SEQ ID NO: 21146 - protein, 9 aa, Artificial Sequence
  source: /note="Description of Artificial Sequence: Synthetic peptide"
HLSTSKIPA

SEQ ID NO: 21147 - protein, 9 aa, Artificial Sequence
  source: /note="Description of Artificial Sequence: Synthetic peptide"
LLHHPHPNA

SEQ ID NO: 21148 - protein, 9 aa, Artificial Sequence
  source: /note="Description of Artificial Sequence: Synthetic peptide"
SRVSLHWYF

SEQ ID NO: 21149 - protein, 9 aa, Artificial Sequence
  source: /note="Description of Artificial Sequence: Synthetic peptide"
VSLHWYFMF

SEQ ID NO: 21150 - protein, 9 aa, Artificial Sequence
  source: /note="Description of Artificial Sequence: Synthetic peptide"
WYFMFLWPG

SEQ ID NO: 21151 - protein, 9 aa, Artificial Sequence
  source: /note="Description of Artificial Sequence: Synthetic peptide"
CSNFLLCTF

SEQ ID NO: 21152 - protein, 9 aa, Artificial Sequence
  source: /note="Description of Artificial Sequence: Synthetic peptide"
NFLLCTFCL

SEQ ID NO: 21153 - protein, 9 aa, Artificial Sequence
  source: /note="Description of Artificial Sequence: Synthetic peptide"
VFLSHHLSR

SEQ ID NO: 21154 - protein, 9 aa, Artificial Sequence
  source: /note="Description of Artificial Sequence: Synthetic peptide"
RVSLHWYFM

SEQ ID NO: 21155 - protein, 9 aa, Artificial Sequence
  source: /note="Description of Artificial Sequence: Synthetic peptide"
LSRVSLHWY

SEQ ID NO: 21156 - protein, 9 aa, Artificial Sequence
  source: /note="Description of Artificial Sequence: Synthetic peptide"
HPPHCSNFL

SEQ ID NO: 21157 - protein, 9 aa, Artificial Sequence
  source: /note="Description of Artificial Sequence: Synthetic peptide"
HPHPNAQPH

SEQ ID NO: 21158 - protein, 9 aa, Artificial Sequence
  source: /note="Description of Artificial Sequence: Synthetic peptide"
HPNAQPHHL

SEQ ID NO: 21159 - protein, 9 aa, Artificial Sequence
  source: /note="Description of Artificial Sequence: Synthetic peptide"
YEGTVFLSH

SEQ ID NO: 21160 - protein, 9 aa, Artificial Sequence
  source: /note="Description of Artificial Sequence: Synthetic peptide"
SHHLSRVSL

SEQ ID NO: 21161 - protein, 9 aa, Artificial Sequence
  source: /note="Description of Artificial Sequence: Synthetic peptide"
HLSRVSLHW

SEQ ID NO: 21162 - protein, 9 aa, Artificial Sequence
  source: /note="Description of Artificial Sequence: Synthetic peptide"
CRREEESLF

SEQ ID NO: 21163 - protein, 9 aa, Artificial Sequence
  source: /note="Description of Artificial Sequence: Synthetic peptide"
REEESLFDL

SEQ ID NO: 21164 - protein, 9 aa, Artificial Sequence
  source: /note="Description of Artificial Sequence: Synthetic peptide"
LQHPPHCSN

SEQ ID NO: 21165 - protein, 9 aa, Artificial Sequence
  source: /note="Description of Artificial Sequence: Synthetic peptide"
RGQGSGCLL

SEQ ID NO: 21166 - protein, 9 aa, Artificial Sequence
  source: /note="Description of Artificial Sequence: Synthetic peptide"
GQGSGCLLH

SEQ ID NO: 21167 - protein, 9 aa, Artificial Sequence
  source: /note="Description of Artificial Sequence: Synthetic peptide"
EESLFDLQH

SEQ ID NO: 21168 - protein, 9 aa, Artificial Sequence
  source: /note="Description of Artificial Sequence: Synthetic peptide"
LHWYFMFLW

SEQ ID NO: 21169 - protein, 10 aa, Artificial Sequence
  source: /note="Description of Artificial Sequence: Synthetic peptide"
HLSRVSLHWY

SEQ ID NO: 21170 - protein, 10 aa, Artificial Sequence
  source: /note="Description of Artificial Sequence: Synthetic peptide"
VSLHWYFMFL

SEQ ID NO: 21171 - protein, 10 aa, Artificial Sequence
  source: /note="Description of Artificial Sequence: Synthetic peptide"
FMFLWPGSLC

SEQ ID NO: 21172 - protein, 10 aa, Artificial Sequence
  source: /note="Description of Artificial Sequence: Synthetic peptide"
FLWPGSLCCL

SEQ ID NO: 21173 - protein, 10 aa, Artificial Sequence
  source: /note="Description of Artificial Sequence: Synthetic peptide"
FLLCTFCLHL

SEQ ID NO: 21174 - protein, 10 aa, Artificial Sequence
  source: /note="Description of Artificial Sequence: Synthetic peptide"
HLSTSKIPAI

SEQ ID NO: 21175 - protein, 10 aa, Artificial Sequence
  source: /note="Description of Artificial Sequence: Synthetic peptide"
CLLHHPHPNA

SEQ ID NO: 21176 - protein, 10 aa, Artificial Sequence
  source: /note="Description of Artificial Sequence: Synthetic peptide"
FLSHHLSRVS

SEQ ID NO: 21177 - protein, 10 aa, Artificial Sequence
  source: /note="Description of Artificial Sequence: Synthetic peptide"
TVFLSHHLSR

SEQ ID NO: 21178 - protein, 10 aa, Artificial Sequence
  source: /note="Description of Artificial Sequence: Synthetic peptide"
TFCLHLSTSK

SEQ ID NO: 21179 - protein, 10 aa, Artificial Sequence
  source: /note="Description of Artificial Sequence: Synthetic peptide"
VFLSHHLSRV

SEQ ID NO: 21180 - protein, 10 aa, Artificial Sequence
  source: /note="Description of Artificial Sequence: Synthetic peptide"
RVSLHWYFMF

SEQ ID NO: 21181 - protein, 10 aa, Artificial Sequence
  source: /note="Description of Artificial Sequence: Synthetic peptide"
SLHWYFMFLW

SEQ ID NO: 21182 - protein, 10 aa, Artificial Sequence
  source: /note="Description of Artificial Sequence: Synthetic peptide"
YFMFLWPGSL

SEQ ID NO: 21183 - protein, 10 aa, Artificial Sequence
  source: /note="Description of Artificial Sequence: Synthetic peptide"
TSKIPAISNR

SEQ ID NO: 21184 - protein, 10 aa, Artificial Sequence
  source: /note="Description of Artificial Sequence: Synthetic peptide"
HPPHCSNFLL

SEQ ID NO: 21185 - protein, 10 aa, Artificial Sequence
  source: /note="Description of Artificial Sequence: Synthetic peptide"
LSRVSLHWYF

SEQ ID NO: 21186 - protein, 10 aa, Artificial Sequence
  source: /note="Description of Artificial Sequence: Synthetic peptide"
LQHPPHCSNF

SEQ ID NO: 21187 - protein, 10 aa, Artificial Sequence
  source: /note="Description of Artificial Sequence: Synthetic peptide"
SLFDLQHPPH

SEQ ID NO: 21188 - protein, 10 aa, Artificial Sequence
  source: /note="Description of Artificial Sequence: Synthetic peptide"
YEGTVFLSHH

SEQ ID NO: 21189 - protein, 10 aa, Artificial Sequence
  source: /note="Description of Artificial Sequence: Synthetic peptide"
LSHHLSRVSL

SEQ ID NO: 21190 - protein, 10 aa, Artificial Sequence
  source: /note="Description of Artificial Sequence: Synthetic peptide"
HHLSRVSLHW

SEQ ID NO: 21191 - protein, 10 aa, Artificial Sequence
  source: /note="Description of Artificial Sequence: Synthetic peptide"
SRVSLHWYFM

SEQ ID NO: 21192 - protein, 10 aa, Artificial Sequence
  source: /note="Description of Artificial Sequence: Synthetic peptide"
ICRREEESLF

SEQ ID NO: 21193 - protein, 10 aa, Artificial Sequence
  source: /note="Description of Artificial Sequence: Synthetic peptide"
HCSNFLLCTF

SEQ ID NO: 21194 - protein, 10 aa, Artificial Sequence
  source: /note="Description of Artificial Sequence: Synthetic peptide"
LHLSTSKIPA

SEQ ID NO: 21195 - protein, 10 aa, Artificial Sequence
  source: /note="Description of Artificial Sequence: Synthetic peptide"
GQGSGCLLHH

SEQ ID NO: 21196 - protein, 10 aa, Artificial Sequence
  source: /note="Description of Artificial Sequence: Synthetic peptide"
WPGSLCCLPH

SEQ ID NO: 21197 - protein, 9 aa, Artificial Sequence
  source: /note="Description of Artificial Sequence: Synthetic peptide"
VSHKFSSIY

SEQ ID NO: 21198 - protein, 9 aa, Artificial Sequence
  source: /note="Description of Artificial Sequence: Synthetic peptide"
LALNVFFWL

SEQ ID NO: 21199 - protein, 9 aa, Artificial Sequence
  source: /note="Description of Artificial Sequence: Synthetic peptide"
ALNVFFWLL

SEQ ID NO: 21200 - protein, 9 aa, Artificial Sequence
  source: /note="Description of Artificial Sequence: Synthetic peptide"
NVFFWLLWL

SEQ ID NO: 21201 - protein, 9 aa, Artificial Sequence
  source: /note="Description of Artificial Sequence: Synthetic peptide"
WLLWLMTAI

SEQ ID NO: 21202 - protein, 9 aa, Artificial Sequence
  source: /note="Description of Artificial Sequence: Synthetic peptide"
LLWLMTAIL

SEQ ID NO: 21203 - protein, 9 aa, Artificial Sequence
  source: /note="Description of Artificial Sequence: Synthetic peptide"
LMTAILLFA

SEQ ID NO: 21204 - protein, 9 aa, Artificial Sequence
  source: /note="Description of Artificial Sequence: Synthetic peptide"
VVSHKFSSI

SEQ ID NO: 21205 - protein, 9 aa, Artificial Sequence
  source: /note="Description of Artificial Sequence: Synthetic peptide"
ISMVVVSHK

SEQ ID NO: 21206 - protein, 9 aa, Artificial Sequence
  source: /note="Description of Artificial Sequence: Synthetic peptide"
SMVVVSHKF

SEQ ID NO: 21207 - protein, 9 aa, Artificial Sequence
  source: /note="Description of Artificial Sequence: Synthetic peptide"
KFSSIYHCL

SEQ ID NO: 21208 - protein, 9 aa, Artificial Sequence
  source: /note="Description of Artificial Sequence: Synthetic peptide"
IYHCLALNV

SEQ ID NO: 21209 - protein, 9 aa, Artificial Sequence
  source: /note="Description of Artificial Sequence: Synthetic peptide"
CLALNVFFW

SEQ ID NO: 21210 - protein, 9 aa, Artificial Sequence
  source: /note="Description of Artificial Sequence: Synthetic peptide"
VFFWLLWLM

SEQ ID NO: 21211 - protein, 9 aa, Artificial Sequence
  source: /note="Description of Artificial Sequence: Synthetic peptide"
LWLMTAILL

SEQ ID NO: 21212 - protein, 9 aa, Artificial Sequence
  source: /note="Description of Artificial Sequence: Synthetic peptide"
WLMTAILLF

SEQ ID NO: 21213 - protein, 9 aa, Artificial Sequence
  source: /note="Description of Artificial Sequence: Synthetic peptide"
GSKSISMVV

SEQ ID NO: 21214 - protein, 9 aa, Artificial Sequence
  source: /note="Description of Artificial Sequence: Synthetic peptide"
FSSIYHCLA

SEQ ID NO: 21215 - protein, 9 aa, Artificial Sequence
  source: /note="Description of Artificial Sequence: Synthetic peptide"
MTAILLFAT

SEQ ID NO: 21216 - protein, 9 aa, Artificial Sequence
  source: /note="Description of Artificial Sequence: Synthetic peptide"
TAILLFATL

SEQ ID NO: 21217 - protein, 9 aa, Artificial Sequence
  source: /note="Description of Artificial Sequence: Synthetic peptide"
SSIYHCLAL

SEQ ID NO: 21218 - protein, 9 aa, Artificial Sequence
  source: /note="Description of Artificial Sequence: Synthetic peptide"
SKSISMVVV

SEQ ID NO: 21219 - protein, 9 aa, Artificial Sequence
  source: /note="Description of Artificial Sequence: Synthetic peptide"
HKFSSIYHC

SEQ ID NO: 21220 - protein, 9 aa, Artificial Sequence
  source: /note="Description of Artificial Sequence: Synthetic peptide"
YHCLALNVF

SEQ ID NO: 21221 - protein, 9 aa, Artificial Sequence
  source: /note="Description of Artificial Sequence: Synthetic peptide"
HCLALNVFF

SEQ ID NO: 21222 - protein, 10 aa, Artificial Sequence
  source: /note="Description of Artificial Sequence: Synthetic peptide"
SIYHCLALNV

SEQ ID NO: 21223 - protein, 10 aa, Artificial Sequence
  source: /note="Description of Artificial Sequence: Synthetic peptide"
CLALNVFFWL

SEQ ID NO: 21224 - protein, 10 aa, Artificial Sequence
  source: /note="Description of Artificial Sequence: Synthetic peptide"
LALNVFFWLL

SEQ ID NO: 21225 - protein, 10 aa, Artificial Sequence
  source: /note="Description of Artificial Sequence: Synthetic peptide"
NVFFWLLWLM

SEQ ID NO: 21226 - protein, 10 aa, Artificial Sequence
  source: /note="Description of Artificial Sequence: Synthetic peptide"
WLLWLMTAIL

SEQ ID NO: 21227 - protein, 10 aa, Artificial Sequence
  source: /note="Description of Artificial Sequence: Synthetic peptide"
LLWLMTAILL

SEQ ID NO: 21228 - protein, 10 aa, Artificial Sequence
  source: /note="Description of Artificial Sequence: Synthetic peptide"
WLMTAILLFA

SEQ ID NO: 21229 - protein, 10 aa, Artificial Sequence
  source: /note="Description of Artificial Sequence: Synthetic peptide"
LMTAILLFAT

SEQ ID NO: 21230 - protein, 10 aa, Artificial Sequence
  source: /note="Description of Artificial Sequence: Synthetic peptide"
MTAILLFATL

SEQ ID NO: 21231 - protein, 10 aa, Artificial Sequence
  source: /note="Description of Artificial Sequence: Synthetic peptide"
VVVSHKFSSI

SEQ ID NO: 21232 - protein, 10 aa, Artificial Sequence
  source: /note="Description of Artificial Sequence: Synthetic peptide"
SISMVVVSHK

SEQ ID NO: 21233 - protein, 10 aa, Artificial Sequence
  source: /note="Description of Artificial Sequence: Synthetic peptide"
VSHKFSSIYH

SEQ ID NO: 21234 - protein, 10 aa, Artificial Sequence
  source: /note="Description of Artificial Sequence: Synthetic peptide"
ISMVVVSHKF

SEQ ID NO: 21235 - protein, 10 aa, Artificial Sequence
  source: /note="Description of Artificial Sequence: Synthetic peptide"
IYHCLALNVF

SEQ ID NO: 21236 - protein, 10 aa, Artificial Sequence
  source: /note="Description of Artificial Sequence: Synthetic peptide"
YHCLALNVFF

SEQ ID NO: 21237 - protein, 10 aa, Artificial Sequence
  source: /note="Description of Artificial Sequence: Synthetic peptide"
FWLLWLMTAI

SEQ ID NO: 21238 - protein, 10 aa, Artificial Sequence
  source: /note="Description of Artificial Sequence: Synthetic peptide"
LWLMTAILLF

SEQ ID NO: 21239 - protein, 10 aa, Artificial Sequence
  source: /note="Description of Artificial Sequence: Synthetic peptide"
GSKSISMVVV

SEQ ID NO: 21240 - protein, 10 aa, Artificial Sequence
  source: /note="Description of Artificial Sequence: Synthetic peptide"
KFSSIYHCLA

SEQ ID NO: 21241 - protein, 10 aa, Artificial Sequence
  source: /note="Description of Artificial Sequence: Synthetic peptide"
VVSHKFSSIY

SEQ ID NO: 21242 - protein, 10 aa, Artificial Sequence
  source: /note="Description of Artificial Sequence: Synthetic peptide"
KSISMVVVSH

SEQ ID NO: 21243 - protein, 10 aa, Artificial Sequence
  source: /note="Description of Artificial Sequence: Synthetic peptide"
HKFSSIYHCL

SEQ ID NO: 21244 - protein, 10 aa, Artificial Sequence
  source: /note="Description of Artificial Sequence: Synthetic peptide"
FSSIYHCLAL

SEQ ID NO: 21245 - protein, 9 aa, Artificial Sequence
  source: /note="Description of Artificial Sequence: Synthetic peptide"
HLFCEFPSL

SEQ ID NO: 21246 - protein, 9 aa, Artificial Sequence
  source: /note="Description of Artificial Sequence: Synthetic peptide"
GSREIAHLF

SEQ ID NO: 21247 - protein, 9 aa, Artificial Sequence
  source: /note="Description of Artificial Sequence: Synthetic peptide"
EIAHLFCEF

SEQ ID NO: 21248 - protein, 9 aa, Artificial Sequence
  source: /note="Description of Artificial Sequence: Synthetic peptide"
REIAHLFCE

SEQ ID NO: 21249 - protein, 10 aa, Artificial Sequence
  source: /note="Description of Artificial Sequence: Synthetic peptide"
HLFCEFPSLL

SEQ ID NO: 21250 - protein, 10 aa, Artificial Sequence
  source: /note="Description of Artificial Sequence: Synthetic peptide"
REIAHLFCEF

SEQ ID NO: 21251 - protein, 10 aa, Artificial Sequence
  source: /note="Description of Artificial Sequence: Synthetic peptide"
LFCEFPSLLI

SEQ ID NO: 21252 - protein, 10 aa, Artificial Sequence
  source: /note="Description of Artificial Sequence: Synthetic peptide"
GSREIAHLFC

SEQ ID NO: 21253 - protein, 10 aa, Artificial Sequence
  source: /note="Description of Artificial Sequence: Synthetic peptide"
CGSREIAHLF

SEQ ID NO: 21254 - protein, 10 aa, Artificial Sequence
  source: /note="Description of Artificial Sequence: Synthetic peptide"
AHLFCEFPSL

SEQ ID NO: 21255 - protein, 9 aa, Artificial Sequence
  source: /note="Description of Artificial Sequence: Synthetic peptide"
LLLAKFFFL

SEQ ID NO: 21256 - protein, 9 aa, Artificial Sequence
  source: /note="Description of Artificial Sequence: Synthetic peptide"
LLAKFFFLI

SEQ ID NO: 21257 - protein, 9 aa, Artificial Sequence
  source: /note="Description of Artificial Sequence: Synthetic peptide"
KLYVLLLAK

SEQ ID NO: 21258 - protein, 9 aa, Artificial Sequence
  source: /note="Description of Artificial Sequence: Synthetic peptide"
LYVLLLAKF

SEQ ID NO: 21259 - protein, 9 aa, Artificial Sequence
  source: /note="Description of Artificial Sequence: Synthetic peptide"
VLLLAKFFF

SEQ ID NO: 21260 - protein, 10 aa, Artificial Sequence
  source: /note="Description of Artificial Sequence: Synthetic peptide"
VLLLAKFFFL

SEQ ID NO: 21261 - protein, 10 aa, Artificial Sequence
  source: /note="Description of Artificial Sequence: Synthetic peptide"
LLLAKFFFLI

SEQ ID NO: 21262 - protein, 10 aa, Artificial Sequence
  source: /note="Description of Artificial Sequence: Synthetic peptide"
KLYVLLLAKF

SEQ ID NO: 21263 - protein, 10 aa, Artificial Sequence
  source: /note="Description of Artificial Sequence: Synthetic peptide"
LYVLLLAKFF

SEQ ID NO: 21264 - protein, 10 aa, Artificial Sequence
  source: /note="Description of Artificial Sequence: Synthetic peptide"
YVLLLAKFFF

SEQ ID NO: 21265 - protein, 10 aa, Artificial Sequence
  source: /note="Description of Artificial Sequence: Synthetic peptide"
LAKFFFLISI

SEQ ID NO: 21266 - protein, 10 aa, Artificial Sequence
  source: /note="Description of Artificial Sequence: Synthetic peptide"
LPHKLYVLLL

SEQ ID NO: 21267 - protein, 9 aa, Artificial Sequence
  source: /note="Description of Artificial Sequence: Synthetic peptide"
SGEGRHKAF

SEQ ID NO: 21268 - protein, 10 aa, Artificial Sequence
  source: /note="Description of Artificial Sequence: Synthetic peptide"
HMGSGEGRHK

SEQ ID NO: 21269 - protein, 10 aa, Artificial Sequence
  source: /note="Description of Artificial Sequence: Synthetic peptide"
GSGEGRHKAF

SEQ ID NO: 21270 - protein, 10 aa, Artificial Sequence
  source: /note="Description of Artificial Sequence: Synthetic peptide"
HKAFTTCSSH

SEQ ID NO: 21271 - protein, 10 aa, Artificial Sequence
  source: /note="Description of Artificial Sequence: Synthetic peptide"
GEGRHKAFTT

SEQ ID NO: 21272 - protein, 9 aa, Artificial Sequence
  source: /note="Description of Artificial Sequence: Synthetic peptide"
KIVSVFYTI

SEQ ID NO: 21273 - protein, 9 aa, Artificial Sequence
  source: /note="Description of Artificial Sequence: Synthetic peptide"
TQDKIVSVF

SEQ ID NO: 21274 - protein, 10 aa, Artificial Sequence
  source: /note="Description of Artificial Sequence: Synthetic peptide"
TQDKIVSVFY

SEQ ID NO: 21275 - protein, 10 aa, Artificial Sequence
  source: /note="Description of Artificial Sequence: Synthetic peptide"
KIVSVFYTIL

SEQ ID NO: 21276 - protein, 10 aa, Artificial Sequence
  source: /note="Description of Artificial Sequence: Synthetic peptide"
SPTQDKIVSV

SEQ ID NO: 21277 - protein, 9 aa, Artificial Sequence
  source: /note="Description of Artificial Sequence: Synthetic peptide"
FICCILMIV

SEQ ID NO: 21278 - protein, 9 aa, Artificial Sequence
  source: /note="Description of Artificial Sequence: Synthetic peptide"
CILMIVFPV

SEQ ID NO: 21279 - protein, 9 aa, Artificial Sequence
  source: /note="Description of Artificial Sequence: Synthetic peptide"
ILMIVFPVA

SEQ ID NO: 21280 - protein, 9 aa, Artificial Sequence
  source: /note="Description of Artificial Sequence: Synthetic peptide"
LMIVFPVAI

SEQ ID NO: 21281 - protein, 9 aa, Artificial Sequence
  source: /note="Description of Artificial Sequence: Synthetic peptide"
LFICCILMI

SEQ ID NO: 21282 - protein, 9 aa, Artificial Sequence
  source: /note="Description of Artificial Sequence: Synthetic peptide"
KVLFICCIL

SEQ ID NO: 21283 - protein, 9 aa, Artificial Sequence
  source: /note="Description of Artificial Sequence: Synthetic peptide"
VLFICCILM

SEQ ID NO: 21284 - protein, 10 aa, Artificial Sequence
  source: /note="Description of Artificial Sequence: Synthetic peptide"
VLFICCILMI

SEQ ID NO: 21285 - protein, 10 aa, Artificial Sequence
  source: /note="Description of Artificial Sequence: Synthetic peptide"
ILMIVFPVAI

SEQ ID NO: 21286 - protein, 10 aa, Artificial Sequence
  source: /note="Description of Artificial Sequence: Synthetic peptide"
LMIVFPVAII

SEQ ID NO: 21287 - protein, 10 aa, Artificial Sequence
  source: /note="Description of Artificial Sequence: Synthetic peptide"
KVLFICCILM

SEQ ID NO: 21288 - protein, 10 aa, Artificial Sequence
  source: /note="Description of Artificial Sequence: Synthetic peptide"
FICCILMIVF

SEQ ID NO: 21289 - protein, 9 aa, Artificial Sequence
  source: /note="Description of Artificial Sequence: Synthetic peptide"
HLACADTSV

SEQ ID NO: 21290 - protein, 9 aa, Artificial Sequence
  source: /note="Description of Artificial Sequence: Synthetic peptide"
EAPVLVHLA

SEQ ID NO: 21291 - protein, 9 aa, Artificial Sequence
  source: /note="Description of Artificial Sequence: Synthetic peptide"
CEAPVLVHL

SEQ ID NO: 21292 - protein, 10 aa, Artificial Sequence
  source: /note="Description of Artificial Sequence: Synthetic peptide"
HLACADTSVF

SEQ ID NO: 21293 - protein, 10 aa, Artificial Sequence
  source: /note="Description of Artificial Sequence: Synthetic peptide"
CEAPVLVHLA

SEQ ID NO: 21294 - protein, 9 aa, Artificial Sequence
  source: /note="Description of Artificial Sequence: Synthetic peptide"
YGAGIFTYL

SEQ ID NO: 21295 - protein, 9 aa, Artificial Sequence
  source: /note="Description of Artificial Sequence: Synthetic peptide"
GIFTYLRPK

SEQ ID NO: 21296 - protein, 9 aa, Artificial Sequence
  source: /note="Description of Artificial Sequence: Synthetic peptide"
GAGIFTYLR

SEQ ID NO: 21297 - protein, 9 aa, Artificial Sequence
  source: /note="Description of Artificial Sequence: Synthetic peptide"
TYLRPKSHR

SEQ ID NO: 21298 - protein, 9 aa, Artificial Sequence
  source: /note="Description of Artificial Sequence: Synthetic peptide"
YLRPKSHRS

SEQ ID NO: 21299 - protein, 10 aa, Artificial Sequence
  source: /note="Description of Artificial Sequence: Synthetic peptide"
AGIFTYLRPK

SEQ ID NO: 21300 - protein, 10 aa, Artificial Sequence
  source: /note="Description of Artificial Sequence: Synthetic peptide"
FTYLRPKSHR

SEQ ID NO: 21301 - protein, 10 aa, Artificial Sequence
  source: /note="Description of Artificial Sequence: Synthetic peptide"
FYGAGIFTYL

SEQ ID NO: 21302 - protein, 10 aa, Artificial Sequence
  source: /note="Description of Artificial Sequence: Synthetic peptide"
YGAGIFTYLR

SEQ ID NO: 21303 - protein, 10 aa, Artificial Sequence
  source: /note="Description of Artificial Sequence: Synthetic peptide"
YLRPKSHRST

SEQ ID NO: 21304 - protein, 9 aa, Artificial Sequence
  source: /note="Description of Artificial Sequence: Synthetic peptide"
GLLQNSTNV

SEQ ID NO: 21305 - protein, 9 aa, Artificial Sequence
  source: /note="Description of Artificial Sequence: Synthetic peptide"
LLQNSTNVV

SEQ ID NO: 21306 - protein, 9 aa, Artificial Sequence
  source: /note="Description of Artificial Sequence: Synthetic peptide"
STNVVLTGL

SEQ ID NO: 21307 - protein, 9 aa, Artificial Sequence
  source: /note="Description of Artificial Sequence: Synthetic peptide"
LQNSTNVVL

SEQ ID NO: 21308 - protein, 10 aa, Artificial Sequence
  source: /note="Description of Artificial Sequence: Synthetic peptide"
GLLQNSTNVV

SEQ ID NO: 21309 - protein, 10 aa, Artificial Sequence
  source: /note="Description of Artificial Sequence: Synthetic peptide"
LLQNSTNVVL

SEQ ID NO: 21310 - protein, 10 aa, Artificial Sequence
  source: /note="Description of Artificial Sequence: Synthetic peptide"
NSTNVVLTGL

SEQ ID NO: 21311 - protein, 10 aa, Artificial Sequence
  source: /note="Description of Artificial Sequence: Synthetic peptide"
STNVVLTGLI

SEQ ID NO: 21312 - protein, 10 aa, Artificial Sequence
  source: /note="Description of Artificial Sequence: Synthetic peptide"
LQNSTNVVLT

SEQ ID NO: 21313 - protein, 9 aa, Artificial Sequence
  source: /note="Description of Artificial Sequence: Synthetic peptide"
QSNYSVYAY

SEQ ID NO: 21314 - protein, 9 aa, Artificial Sequence
  source: /note="Description of Artificial Sequence: Synthetic peptide"
SVYAYFILL

SEQ ID NO: 21315 - protein, 9 aa, Artificial Sequence
  source: /note="Description of Artificial Sequence: Synthetic peptide"
YAYFILLGL

SEQ ID NO: 21316 - protein, 9 aa, Artificial Sequence
  source: /note="Description of Artificial Sequence: Synthetic peptide"
SNYSVYAYF

SEQ ID NO: 21317 - protein, 9 aa, Artificial Sequence
  source: /note="Description of Artificial Sequence: Synthetic peptide"
NYSVYAYFI

SEQ ID NO: 21318 - protein, 9 aa, Artificial Sequence
  source: /note="Description of Artificial Sequence: Synthetic peptide"
YSVYAYFIL

SEQ ID NO: 21319 - protein, 9 aa, Artificial Sequence
  source: /note="Description of Artificial Sequence: Synthetic peptide"
VYAYFILLG

SEQ ID NO: 21320 - protein, 9 aa, Artificial Sequence
  source: /note="Description of Artificial Sequence: Synthetic peptide"
AYFILLGLF

SEQ ID NO: 21321 - protein, 10 aa, Artificial Sequence
  source: /note="Description of Artificial Sequence: Synthetic peptide"
YSVYAYFILL

SEQ ID NO: 21322 - protein, 10 aa, Artificial Sequence
  source: /note="Description of Artificial Sequence: Synthetic peptide"
NYSVYAYFIL

SEQ ID NO: 21323 - protein, 10 aa, Artificial Sequence
  source: /note="Description of Artificial Sequence: Synthetic peptide"
VYAYFILLGL

SEQ ID NO: 21324 - protein, 10 aa, Artificial Sequence
  source: /note="Description of Artificial Sequence: Synthetic peptide"
YAYFILLGLF

SEQ ID NO: 21325 - protein, 10 aa, Artificial Sequence
  source: /note="Description of Artificial Sequence: Synthetic peptide"
EQSNYSVYAY

SEQ ID NO: 21326 - protein, 10 aa, Artificial Sequence
  source: /note="Description of Artificial Sequence: Synthetic peptide"
QSNYSVYAYF

SEQ ID NO: 21327 - protein, 10 aa, Artificial Sequence
  source: /note="Description of Artificial Sequence: Synthetic peptide"
SNYSVYAYFI

SEQ ID NO: 21328 - protein, 9 aa, Artificial Sequence
  source: /note="Description of Artificial Sequence: Synthetic peptide"
AMAYDSYAA

SEQ ID NO: 21329 - protein, 9 aa, Artificial Sequence
  source: /note="Description of Artificial Sequence: Synthetic peptide"
MAYDSYAAV

SEQ ID NO: 21330 - protein, 9 aa, Artificial Sequence
  source: /note="Description of Artificial Sequence: Synthetic peptide"
AAMAYDSYA

SEQ ID NO: 21331 - protein, 9 aa, Artificial Sequence
  source: /note="Description of Artificial Sequence: Synthetic peptide"
SYAAVCHPL

SEQ ID NO: 21332 - protein, 9 aa, Artificial Sequence
  source: /note="Description of Artificial Sequence: Synthetic peptide"
LAAMAYDSY

SEQ ID NO: 21333 - protein, 10 aa, Artificial Sequence
  source: /note="Description of Artificial Sequence: Synthetic peptide"
FLLAAMAYDS

SEQ ID NO: 21334 - protein, 10 aa, Artificial Sequence
  source: /note="Description of Artificial Sequence: Synthetic peptide"
AMAYDSYAAV

SEQ ID NO: 21335 - protein, 10 aa, Artificial Sequence
  source: /note="Description of Artificial Sequence: Synthetic peptide"
AAMAYDSYAA

SEQ ID NO: 21336 - protein, 10 aa, Artificial Sequence
  source: /note="Description of Artificial Sequence: Synthetic peptide"
LLAAMAYDSY

SEQ ID NO: 21337 - protein, 10 aa, Artificial Sequence
  source: /note="Description of Artificial Sequence: Synthetic peptide"
SYAAVCHPLR

SEQ ID NO: 21338 - protein, 10 aa, Artificial Sequence
  source: /note="Description of Artificial Sequence: Synthetic peptide"
LAAMAYDSYA

SEQ ID NO: 21339 - protein, 10 aa, Artificial Sequence
  source: /note="Description of Artificial Sequence: Synthetic peptide"
DSYAAVCHPL

SEQ ID NO: 21340 - protein, 10 aa, Artificial Sequence
  source: /note="Description of Artificial Sequence: Synthetic peptide"
MAYDSYAAVC

SEQ ID NO: 21341 - protein, 9 aa, Artificial Sequence
  source: /note="Description of Artificial Sequence: Synthetic peptide"
FQYCGAHEI

SEQ ID NO: 21342 - protein, 9 aa, Artificial Sequence
  source: /note="Description of Artificial Sequence: Synthetic peptide"
TLSFQYCGA

SEQ ID NO: 21343 - protein, 9 aa, Artificial Sequence
  source: /note="Description of Artificial Sequence: Synthetic peptide"
AVVTLSFQY

SEQ ID NO: 21344 - protein, 9 aa, Artificial Sequence
  source: /note="Description of Artificial Sequence: Synthetic peptide"
LSFQYCGAH

SEQ ID NO: 21345 - protein, 10 aa, Artificial Sequence
  source: /note="Description of Artificial Sequence: Synthetic peptide"
SFQYCGAHEI

SEQ ID NO: 21346 - protein, 10 aa, Artificial Sequence
  source: /note="Description of Artificial Sequence: Synthetic peptide"
QAVVTLSFQY

SEQ ID NO: 21347 - protein, 10 aa, Artificial Sequence
  source: /note="Description of Artificial Sequence: Synthetic peptide"
FQYCGAHEID

SEQ ID NO: 21348 - protein, 9 aa, Artificial Sequence
  source: /note="Description of Artificial Sequence: Synthetic peptide"
ALATFSSHM

SEQ ID NO: 21349 - protein, 9 aa, Artificial Sequence
  source: /note="Description of Artificial Sequence: Synthetic peptide"
KALATFSSH

SEQ ID NO: 21350 - protein, 9 aa, Artificial Sequence
  source: /note="Description of Artificial Sequence: Synthetic peptide"
ATFSSHMII

SEQ ID NO: 21351 - protein, 9 aa, Artificial Sequence
  source: /note="Description of Artificial Sequence: Synthetic peptide"
GRRKALATF

SEQ ID NO: 21352 - protein, 9 aa, Artificial Sequence
  source: /note="Description of Artificial Sequence: Synthetic peptide"
RKALATFSS

SEQ ID NO: 21353 - protein, 9 aa, Artificial Sequence
  source: /note="Description of Artificial Sequence: Synthetic peptide"
FSSHMIIVL

SEQ ID NO: 21354 - protein, 9 aa, Artificial Sequence
  source: /note="Description of Artificial Sequence: Synthetic peptide"
LATFSSHMI

SEQ ID NO: 21355 - protein, 10 aa, Artificial Sequence
  source: /note="Description of Artificial Sequence: Synthetic peptide"
ALATFSSHMI

SEQ ID NO: 21356 - protein, 10 aa, Artificial Sequence
  source: /note="Description of Artificial Sequence: Synthetic peptide"
ATFSSHMIIV

SEQ ID NO: 21357 - protein, 10 aa, Artificial Sequence
  source: /note="Description of Artificial Sequence: Synthetic peptide"
FSSHMIIVLL

SEQ ID NO: 21358 - protein, 10 aa, Artificial Sequence
  source: /note="Description of Artificial Sequence: Synthetic peptide"
TFSSHMIIVL

SEQ ID NO: 21359 - protein, 10 aa, Artificial Sequence
  source: /note="Description of Artificial Sequence: Synthetic peptide"
KALATFSSHM

SEQ ID NO: 21360 - protein, 10 aa, Artificial Sequence
  source: /note="Description of Artificial Sequence: Synthetic peptide"
AGRRKALATF

SEQ ID NO: 21361 - protein, 10 aa, Artificial Sequence
  source: /note="Description of Artificial Sequence: Synthetic peptide"
RKALATFSSH

SEQ ID NO: 21362 - protein, 10 aa, Artificial Sequence
  source: /note="Description of Artificial Sequence: Synthetic peptide"
LATFSSHMII

SEQ ID NO: 21363 - protein, 9 aa, Artificial Sequence
  source: /note="Description of Artificial Sequence: Synthetic peptide"
GMQMFFYLT

SEQ ID NO: 21364 - protein, 9 aa, Artificial Sequence
  source: /note="Description of Artificial Sequence: Synthetic peptide"
MQMFFYLTL

SEQ ID NO: 21365 - protein, 9 aa, Artificial Sequence
  source: /note="Description of Artificial Sequence: Synthetic peptide"
CGMQMFFYL

SEQ ID NO: 21366 - protein, 10 aa, Artificial Sequence
  source: /note="Description of Artificial Sequence: Synthetic peptide"
GMQMFFYLTL

SEQ ID NO: 21367 - protein, 10 aa, Artificial Sequence
  source: /note="Description of Artificial Sequence: Synthetic peptide"
MQMFFYLTLA

SEQ ID NO: 21368 - protein, 10 aa, Artificial Sequence
  source: /note="Description of Artificial Sequence: Synthetic peptide"
FYLTLAGSEF

SEQ ID NO: 21369 - protein, 9 aa, Artificial Sequence
  source: /note="Description of Artificial Sequence: Synthetic peptide"
AMLLIPFSL

SEQ ID NO: 21370 - protein, 9 aa, Artificial Sequence
  source: /note="Description of Artificial Sequence: Synthetic peptide"
MLLIPFSLV

SEQ ID NO: 21371 - protein, 9 aa, Artificial Sequence
  source: /note="Description of Artificial Sequence: Synthetic peptide"
LLIPFSLVT

SEQ ID NO: 21372 - protein, 9 aa, Artificial Sequence
  source: /note="Description of Artificial Sequence: Synthetic peptide"
LIPFSLVTA

SEQ ID NO: 21373 - protein, 9 aa, Artificial Sequence
  source: /note="Description of Artificial Sequence: Synthetic peptide"
LVTASYTRI

SEQ ID NO: 21374 - protein, 9 aa, Artificial Sequence
  source: /note="Description of Artificial Sequence: Synthetic peptide"
SLVTASYTR

SEQ ID NO: 21375 - protein, 9 aa, Artificial Sequence
  source: /note="Description of Artificial Sequence: Synthetic peptide"
PFSLVTASY

SEQ ID NO: 21376 - protein, 9 aa, Artificial Sequence
  source: /note="Description of Artificial Sequence: Synthetic peptide"
IPFSLVTAS

SEQ ID NO: 21377 - protein, 10 aa, Artificial Sequence
  source: /note="Description of Artificial Sequence: Synthetic peptide"
AMLLIPFSLV

SEQ ID NO: 21378 - protein, 10 aa, Artificial Sequence
  source: /note="Description of Artificial Sequence: Synthetic peptide"
LLIPFSLVTA

SEQ ID NO: 21379 - protein, 10 aa, Artificial Sequence
  source: /note="Description of Artificial Sequence: Synthetic peptide"
SLVTASYTRI

SEQ ID NO: 21380 - protein, 10 aa, Artificial Sequence
  source: /note="Description of Artificial Sequence: Synthetic peptide"
FSLVTASYTR

SEQ ID NO: 21381 - protein, 10 aa, Artificial Sequence
  source: /note="Description of Artificial Sequence: Synthetic peptide"
IPFSLVTASY

SEQ ID NO: 21382 - protein, 10 aa, Artificial Sequence
  source: /note="Description of Artificial Sequence: Synthetic peptide"
VAMLLIPFSL

SEQ ID NO: 21383 - protein, 9 aa, Artificial Sequence
  source: /note="Description of Artificial Sequence: Synthetic peptide"
IIVVVLLFV

SEQ ID NO: 21384 - protein, 9 aa, Artificial Sequence
  source: /note="Description of Artificial Sequence: Synthetic peptide"
LLFVPCIFV

SEQ ID NO: 21385 - protein, 9 aa, Artificial Sequence
  source: /note="Description of Artificial Sequence: Synthetic peptide"
HIIVVVLLF

SEQ ID NO: 21386 - protein, 9 aa, Artificial Sequence
  source: /note="Description of Artificial Sequence: Synthetic peptide"
VLLFVPCIF

SEQ ID NO: 21387 - protein, 9 aa, Artificial Sequence
  source: /note="Description of Artificial Sequence: Synthetic peptide"
LFVPCIFVY

SEQ ID NO: 21388 - protein, 10 aa, Artificial Sequence
  source: /note="Description of Artificial Sequence: Synthetic peptide"
HIIVVVLLFV

SEQ ID NO: 21389 - protein, 10 aa, Artificial Sequence
  source: /note="Description of Artificial Sequence: Synthetic peptide"
VLLFVPCIFV

SEQ ID NO: 21390 - protein, 10 aa, Artificial Sequence
  source: /note="Description of Artificial Sequence: Synthetic peptide"
LLFVPCIFVY

SEQ ID NO: 21391 - protein, 10 aa, Artificial Sequence
  source: /note="Description of Artificial Sequence: Synthetic peptide"
SHIIVVVLLF

SEQ ID NO: 21392 - protein, 10 aa, Artificial Sequence
  source: /note="Description of Artificial Sequence: Synthetic peptide"
VVLLFVPCIF

SEQ ID NO: 21393 - protein, 10 aa, Artificial Sequence
  source: /note="Description of Artificial Sequence: Synthetic peptide"
LFVPCIFVYL

SEQ ID NO: 21394 - protein, 10 aa, Artificial Sequence
  source: /note="Description of Artificial Sequence: Synthetic peptide"
ISHIIVVVLL

SEQ ID NO: 21395 - protein, 9 aa, Artificial Sequence
  source: /note="Description of Artificial Sequence: Synthetic peptide"
MVVPILNPV

SEQ ID NO: 21396 - protein, 9 aa, Artificial Sequence
  source: /note="Description of Artificial Sequence: Synthetic peptide"
ILNPVVYTL

SEQ ID NO: 21397 - protein, 9 aa, Artificial Sequence
  source: /note="Description of Artificial Sequence: Synthetic peptide"
VFYTMVVPI

SEQ ID NO: 21398 - protein, 9 aa, Artificial Sequence
  source: /note="Description of Artificial Sequence: Synthetic peptide"
FYTMVVPIL

SEQ ID NO: 21399 - protein, 9 aa, Artificial Sequence
  source: /note="Description of Artificial Sequence: Synthetic peptide"
VPILNPVVY

SEQ ID NO: 21400 - protein, 10 aa, Artificial Sequence
  source: /note="Description of Artificial Sequence: Synthetic peptide"
AVFYTMVVPI

SEQ ID NO: 21401 - protein, 10 aa, Artificial Sequence
  source: /note="Description of Artificial Sequence: Synthetic peptide"
TMVVPILNPV

SEQ ID NO: 21402 - protein, 10 aa, Artificial Sequence
  source: /note="Description of Artificial Sequence: Synthetic peptide"
MVVPILNPVV

SEQ ID NO: 21403 - protein, 10 aa, Artificial Sequence
  source: /note="Description of Artificial Sequence: Synthetic peptide"
ILNPVVYTLR

SEQ ID NO: 21404 - protein, 10 aa, Artificial Sequence
  source: /note="Description of Artificial Sequence: Synthetic peptide"
VFYTMVVPIL

SEQ ID NO: 21405 - protein, 10 aa, Artificial Sequence
  source: /note="Description of Artificial Sequence: Synthetic peptide"
VVPILNPVVY

SEQ ID NO: 21406 - protein, 9 aa, Artificial Sequence
  source: /note="Description of Artificial Sequence: Synthetic peptide"
RKKVTSDNY

SEQ ID NO: 21407 - protein, 10 aa, Artificial Sequence
  source: /note="Description of Artificial Sequence: Synthetic peptide"
WRKKVTSDNY

SEQ ID NO: 21408 - protein, 9 aa, Artificial Sequence
  source: /note="Description of Artificial Sequence: Synthetic peptide"
PMFFFLFFL

SEQ ID NO: 21409 - protein, 9 aa, Artificial Sequence
  source: /note="Description of Artificial Sequence: Synthetic peptide"
FLSLSDTCL

SEQ ID NO: 21410 - protein, 9 aa, Artificial Sequence
  source: /note="Description of Artificial Sequence: Synthetic peptide"
FFFLFFLSL

SEQ ID NO: 21411 - protein, 9 aa, Artificial Sequence
  source: /note="Description of Artificial Sequence: Synthetic peptide"
NPMFFFLFF

SEQ ID NO: 21412 - protein, 10 aa, Artificial Sequence
  source: /note="Description of Artificial Sequence: Synthetic peptide"
FLFFLSLSDT

SEQ ID NO: 21413 - protein, 10 aa, Artificial Sequence
  source: /note="Description of Artificial Sequence: Synthetic peptide"
FLSLSDTCLS

SEQ ID NO: 21414 - protein, 10 aa, Artificial Sequence
  source: /note="Description of Artificial Sequence: Synthetic peptide"
KNPMFFFLFF

SEQ ID NO: 21415 - protein, 10 aa, Artificial Sequence
  source: /note="Description of Artificial Sequence: Synthetic peptide"
MFFFLFFLSL

SEQ ID NO: 21416 - protein, 10 aa, Artificial Sequence
  source: /note="Description of Artificial Sequence: Synthetic peptide"
NPMFFFLFFL

SEQ ID NO: 21417 - protein, 9 aa, Artificial Sequence
  source: /note="Description of Artificial Sequence: Synthetic peptide"
YMTIIRQWV

SEQ ID NO: 21418 - protein, 9 aa, Artificial Sequence
  source: /note="Description of Artificial Sequence: Synthetic peptide"
IIRQWVCGV

SEQ ID NO: 21419 - protein, 9 aa, Artificial Sequence
  source: /note="Description of Artificial Sequence: Synthetic peptide"
HYMTIIRQW

SEQ ID NO: 21420 - protein, 9 aa, Artificial Sequence
  source: /note="Description of Artificial Sequence: Synthetic peptide"
RQWVCGVLM

SEQ ID NO: 21421 - protein, 10 aa, Artificial Sequence
  source: /note="Description of Artificial Sequence: Synthetic peptide"
TIIRQWVCGV

SEQ ID NO: 21422 - protein, 10 aa, Artificial Sequence
  source: /note="Description of Artificial Sequence: Synthetic peptide"
RQWVCGVLMA

SEQ ID NO: 21423 - protein, 10 aa, Artificial Sequence
  source: /note="Description of Artificial Sequence: Synthetic peptide"
HYMTIIRQWV

SEQ ID NO: 21424 - protein, 10 aa, Artificial Sequence
  source: /note="Description of Artificial Sequence: Synthetic peptide"
LHYMTIIRQW

SEQ ID NO: 21425 - protein, 10 aa, Artificial Sequence
  source: /note="Description of Artificial Sequence: Synthetic peptide"
IRQWVCGVLM

SEQ ID NO: 21426 - protein, 9 aa, Artificial Sequence
  source: /note="Description of Artificial Sequence: Synthetic peptide"
SLVQIFLAM

SEQ ID NO: 21427 - protein, 9 aa, Artificial Sequence
  source: /note="Description of Artificial Sequence: Synthetic peptide"
VQIFLAMSL

SEQ ID NO: 21428 - protein, 9 aa, Artificial Sequence
  source: /note="Description of Artificial Sequence: Synthetic peptide"
FLAMSLPFC

SEQ ID NO: 21429 - protein, 9 aa, Artificial Sequence
  source: /note="Description of Artificial Sequence: Synthetic peptide"
IFLAMSLPF

SEQ ID NO: 21430 - protein, 10 aa, Artificial Sequence
  source: /note="Description of Artificial Sequence: Synthetic peptide"
MSLPFCGPNV

SEQ ID NO: 21431 - protein, 10 aa, Artificial Sequence
  source: /note="Description of Artificial Sequence: Synthetic peptide"
FLAMSLPFCG

SEQ ID NO: 21432 - protein, 10 aa, Artificial Sequence
  source: /note="Description of Artificial Sequence: Synthetic peptide"
QIFLAMSLPF

SEQ ID NO: 21433 - protein, 10 aa, Artificial Sequence
  source: /note="Description of Artificial Sequence: Synthetic peptide"
HSLVQIFLAM

SEQ ID NO: 21434 - protein, 10 aa, Artificial Sequence
  source: /note="Description of Artificial Sequence: Synthetic peptide"
VQIFLAMSLP

SEQ ID NO: 21435 - protein, 9 aa, Artificial Sequence
  source: /note="Description of Artificial Sequence: Synthetic peptide"
AQLFGAHFF

SEQ ID NO: 21436 - protein, 9 aa, Artificial Sequence
  source: /note="Description of Artificial Sequence: Synthetic peptide"
LFGAHFFGR

SEQ ID NO: 21437 - protein, 10 aa, Artificial Sequence
  source: /note="Description of Artificial Sequence: Synthetic peptide"
QLFGAHFFGR

SEQ ID NO: 21438 - protein, 10 aa, Artificial Sequence
  source: /note="Description of Artificial Sequence: Synthetic peptide"
MAQLFGAHFF

SEQ ID NO: 21439 - protein, 9 aa, Artificial Sequence
  source: /note="Description of Artificial Sequence: Synthetic peptide"
MVILVSLQK

SEQ ID NO: 21440 - protein, 10 aa, Artificial Sequence
  source: /note="Description of Artificial Sequence: Synthetic peptide"
ILVSLQKHSA

SEQ ID NO: 21441 - protein, 10 aa, Artificial Sequence
  source: /note="Description of Artificial Sequence: Synthetic peptide"
YMVILVSLQK

SEQ ID NO: 21442 - protein, 9 aa, Artificial Sequence
  source: /note="Description of Artificial Sequence: Synthetic peptide"
FLFFGPFIF

SEQ ID NO: 21443 - protein, 9 aa, Artificial Sequence
  source: /note="Description of Artificial Sequence: Synthetic peptide"
FIFIYMWPL

SEQ ID NO: 21444 - protein, 9 aa, Artificial Sequence
  source: /note="Description of Artificial Sequence: Synthetic peptide"
VFLFFGPFI

SEQ ID NO: 21445 - protein, 9 aa, Artificial Sequence
  source: /note="Description of Artificial Sequence: Synthetic peptide"
LFFGPFIFI

SEQ ID NO: 21446 - protein, 9 aa, Artificial Sequence
  source: /note="Description of Artificial Sequence: Synthetic peptide"
FFGPFIFIY

SEQ ID NO: 21447 - protein, 9 aa, Artificial Sequence
  source: /note="Description of Artificial Sequence: Synthetic peptide"
VVFLFFGPF

SEQ ID NO: 21448 - protein, 9 aa, Artificial Sequence
  source: /note="Description of Artificial Sequence: Synthetic peptide"
GPFIFIYMW

SEQ ID NO: 21449 - protein, 10 aa, Artificial Sequence
  source: /note="Description of Artificial Sequence: Synthetic peptide"
VVFLFFGPFI

SEQ ID NO: 21450 - protein, 10 aa, Artificial Sequence
  source: /note="Description of Artificial Sequence: Synthetic peptide"
FLFFGPFIFI

SEQ ID NO: 21451 - protein, 10 aa, Artificial Sequence
  source: /note="Description of Artificial Sequence: Synthetic peptide"
IVVFLFFGPF

SEQ ID NO: 21452 - protein, 10 aa, Artificial Sequence
  source: /note="Description of Artificial Sequence: Synthetic peptide"
VFLFFGPFIF

SEQ ID NO: 21453 - protein, 10 aa, Artificial Sequence
  source: /note="Description of Artificial Sequence: Synthetic peptide"
FFGPFIFIYM

SEQ ID NO: 21454 - protein, 10 aa, Artificial Sequence
  source: /note="Description of Artificial Sequence: Synthetic peptide"
FGPFIFIYMW

SEQ ID NO: 21455 - protein, 10 aa, Artificial Sequence
  source: /note="Description of Artificial Sequence: Synthetic peptide"
PFIFIYMWPL

SEQ ID NO: 21456 - protein, 10 aa, Artificial Sequence
  source: /note="Description of Artificial Sequence: Synthetic peptide"
LFFGPFIFIY

SEQ ID NO: 21457 - protein, 9 aa, Artificial Sequence
  source: /note="Description of Artificial Sequence: Synthetic peptide"
NVVDSFFVI

SEQ ID NO: 21458 - protein, 9 aa, Artificial Sequence
  source: /note="Description of Artificial Sequence: Synthetic peptide"
FLESPNLPA

SEQ ID NO: 21459 - protein, 9 aa, Artificial Sequence
  source: /note="Description of Artificial Sequence: Synthetic peptide"
PAWTLTSLK

SEQ ID NO: 21460 - protein, 9 aa, Artificial Sequence
  source: /note="Description of Artificial Sequence: Synthetic peptide"
AWTLTSLKY

SEQ ID NO: 21461 - protein, 9 aa, Artificial Sequence
  source: /note="Description of Artificial Sequence: Synthetic peptide"
SPNLPAWTL

SEQ ID NO: 21462 - protein, 9 aa, Artificial Sequence
  source: /note="Description of Artificial Sequence: Synthetic peptide"
LPAWTLTSL

SEQ ID NO: 21463 - protein, 9 aa, Artificial Sequence
  source: /note="Description of Artificial Sequence: Synthetic peptide"
VVDSFFVIF

SEQ ID NO: 21464 - protein, 9 aa, Artificial Sequence
  source: /note="Description of Artificial Sequence: Synthetic peptide"
LESPNLPAW

SEQ ID NO: 21465 - protein, 10 aa, Artificial Sequence
  source: /note="Description of Artificial Sequence: Synthetic peptide"
VVDSFFVIFL

SEQ ID NO: 21466 - protein, 10 aa, Artificial Sequence
  source: /note="Description of Artificial Sequence: Synthetic peptide"
FVIFLESPNL

SEQ ID NO: 21467 - protein, 10 aa, Artificial Sequence
  source: /note="Description of Artificial Sequence: Synthetic peptide"
NLPAWTLTSL

SEQ ID NO: 21468 - protein, 10 aa, Artificial Sequence
  source: /note="Description of Artificial Sequence: Synthetic peptide"
PAWTLTSLKY

SEQ ID NO: 21469 - protein, 10 aa, Artificial Sequence
  source: /note="Description of Artificial Sequence: Synthetic peptide"
ESPNLPAWTL

SEQ ID NO: 21470 - protein, 10 aa, Artificial Sequence
  source: /note="Description of Artificial Sequence: Synthetic peptide"
NVVDSFFVIF

SEQ ID NO: 21471 - protein, 10 aa, Artificial Sequence
  source: /note="Description of Artificial Sequence: Synthetic peptide"
FLESPNLPAW

SEQ ID NO: 21472 - protein, 10 aa, Artificial Sequence
  source: /note="Description of Artificial Sequence: Synthetic peptide"
LESPNLPAWT

SEQ ID NO: 21473 - protein, 9 aa, Artificial Sequence
  source: /note="Description of Artificial Sequence: Synthetic peptide"
YLFILPENI

SEQ ID NO: 21474 - protein, 9 aa, Artificial Sequence
  source: /note="Description of Artificial Sequence: Synthetic peptide"
FILPENILI

SEQ ID NO: 21475 - protein, 9 aa, Artificial Sequence
  source: /note="Description of Artificial Sequence: Synthetic peptide"
ILPENILII

SEQ ID NO: 21476 - protein, 10 aa, Artificial Sequence
  source: /note="Description of Artificial Sequence: Synthetic peptide"
YLFILPENIL

SEQ ID NO: 21477 - protein, 10 aa, Artificial Sequence
  source: /note="Description of Artificial Sequence: Synthetic peptide"
FILPENILII

SEQ ID NO: 21478 - protein, 10 aa, Artificial Sequence
  source: /note="Description of Artificial Sequence: Synthetic peptide"
FYLFILPENI

SEQ ID NO: 21479 - protein, 10 aa, Artificial Sequence
  source: /note="Description of Artificial Sequence: Synthetic peptide"
LFILPENILI

SEQ ID NO: 21480 - protein, 10 aa, Artificial Sequence
  source: /note="Description of Artificial Sequence: Synthetic peptide"
ENILIICTIR

SEQ ID NO: 21481 - protein, 9 aa, Artificial Sequence
  source: /note="Description of Artificial Sequence: Synthetic peptide"
LTVMSFDLY

SEQ ID NO: 21482 - protein, 9 aa, Artificial Sequence
  source: /note="Description of Artificial Sequence: Synthetic peptide"
LLTVMSFDL

SEQ ID NO: 21483 - protein, 9 aa, Artificial Sequence
  source: /note="Description of Artificial Sequence: Synthetic peptide"
VMSFDLYTA

SEQ ID NO: 21484 - protein, 9 aa, Artificial Sequence
  source: /note="Description of Artificial Sequence: Synthetic peptide"
MSFDLYTAI

SEQ ID NO: 21485 - protein, 9 aa, Artificial Sequence
  source: /note="Description of Artificial Sequence: Synthetic peptide"
MFLLTVMSF

SEQ ID NO: 21486 - protein, 9 aa, Artificial Sequence
  source: /note="Description of Artificial Sequence: Synthetic peptide"
TVMSFDLYT

SEQ ID NO: 21487 - protein, 10 aa, Artificial Sequence
  source: /note="Description of Artificial Sequence: Synthetic peptide"
LLTVMSFDLY

SEQ ID NO: 21488 - protein, 10 aa, Artificial Sequence
  source: /note="Description of Artificial Sequence: Synthetic peptide"
FLLTVMSFDL

SEQ ID NO: 21489 - protein, 10 aa, Artificial Sequence
  source: /note="Description of Artificial Sequence: Synthetic peptide"
TVMSFDLYTA

SEQ ID NO: 21490 - protein, 10 aa, Artificial Sequence
  source: /note="Description of Artificial Sequence: Synthetic peptide"
VMSFDLYTAI

SEQ ID NO: 21491 - protein, 10 aa, Artificial Sequence
  source: /note="Description of Artificial Sequence: Synthetic peptide"
EMFLLTVMSF

SEQ ID NO: 21492 - protein, 10 aa, Artificial Sequence
  source: /note="Description of Artificial Sequence: Synthetic peptide"
MSFDLYTAIC

SEQ ID NO: 21493 - protein, 10 aa, Artificial Sequence
  source: /note="Description of Artificial Sequence: Synthetic peptide"
SEMFLLTVMS

SEQ ID NO: 21494 - protein, 9 aa, Artificial Sequence
  source: /note="Description of Artificial Sequence: Synthetic peptide"
SIIQVSLIV

SEQ ID NO: 21495 - protein, 9 aa, Artificial Sequence
  source: /note="Description of Artificial Sequence: Synthetic peptide"
IQVSLIVRL

SEQ ID NO: 21496 - protein, 9 aa, Artificial Sequence
  source: /note="Description of Artificial Sequence: Synthetic peptide"
SLIVRLPFC

SEQ ID NO: 21497 - protein, 9 aa, Artificial Sequence
  source: /note="Description of Artificial Sequence: Synthetic peptide"
VSLIVRLPF

SEQ ID NO: 21498 - protein, 9 aa, Artificial Sequence
  source: /note="Description of Artificial Sequence: Synthetic peptide"
HSIIQVSLI

SEQ ID NO: 21499 - protein, 9 aa, Artificial Sequence
  source: /note="Description of Artificial Sequence: Synthetic peptide"
IHSIIQVSL

SEQ ID NO: 21500 - protein, 10 aa, Artificial Sequence
  source: /note="Description of Artificial Sequence: Synthetic peptide"
FIHSIIQVSL

SEQ ID NO: 21501 - protein, 10 aa, Artificial Sequence
  source: /note="Description of Artificial Sequence: Synthetic peptide"
SIIQVSLIVR

SEQ ID NO: 21502 - protein, 10 aa, Artificial Sequence
  source: /note="Description of Artificial Sequence: Synthetic peptide"
HSIIQVSLIV

SEQ ID NO: 21503 - protein, 10 aa, Artificial Sequence
  source: /note="Description of Artificial Sequence: Synthetic peptide"
QVSLIVRLPF

SEQ ID NO: 21504 - protein, 9 aa, Artificial Sequence
  source: /note="Description of Artificial Sequence: Synthetic peptide"
FFLDKVVSV

SEQ ID NO: 21505 - protein, 9 aa, Artificial Sequence
  source: /note="Description of Artificial Sequence: Synthetic peptide"
FLDKVVSVF

SEQ ID NO: 21506 - protein, 9 aa, Artificial Sequence
  source: /note="Description of Artificial Sequence: Synthetic peptide"
YARPFDSFF

SEQ ID NO: 21507 - protein, 10 aa, Artificial Sequence
  source: /note="Description of Artificial Sequence: Synthetic peptide"
IYARPFDSFF

SEQ ID NO: 21508 - protein, 10 aa, Artificial Sequence
  source: /note="Description of Artificial Sequence: Synthetic peptide"
FFLDKVVSVF

SEQ ID NO: 21509 - protein, 10 aa, Artificial Sequence
  source: /note="Description of Artificial Sequence: Synthetic peptide"
YARPFDSFFL

SEQ ID NO: 21510 - protein, 10 aa, Artificial Sequence
  source: /note="Description of Artificial Sequence: Synthetic peptide"
RPFDSFFLDK

SEQ ID NO: 21511 - protein, 9 aa, Artificial Sequence
  source: /note="Description of Artificial Sequence: Synthetic peptide"
FIILPENFL

SEQ ID NO: 21512 - protein, 9 aa, Artificial Sequence
  source: /note="Description of Artificial Sequence: Synthetic peptide"
IILPENFLI

SEQ ID NO: 21513 - protein, 9 aa, Artificial Sequence
  source: /note="Description of Artificial Sequence: Synthetic peptide"
ILPENFLII

SEQ ID NO: 21514 - protein, 9 aa, Artificial Sequence
  source: /note="Description of Artificial Sequence: Synthetic peptide"
YFIILPENF

SEQ ID NO: 21515 - protein, 9 aa, Artificial Sequence
  source: /note="Description of Artificial Sequence: Synthetic peptide"
ENFLIIFTI

SEQ ID NO: 21516 - protein, 9 aa, Artificial Sequence
  source: /note="Description of Artificial Sequence: Synthetic peptide"
LPENFLIIF

SEQ ID NO: 21517 - protein, 10 aa, Artificial Sequence
  source: /note="Description of Artificial Sequence: Synthetic peptide"
FIILPENFLI

SEQ ID NO: 21518 - protein, 10 aa, Artificial Sequence
  source: /note="Description of Artificial Sequence: Synthetic peptide"
IILPENFLII

SEQ ID NO: 21519 - protein, 10 aa, Artificial Sequence
  source: /note="Description of Artificial Sequence: Synthetic peptide"
FYFIILPENF

SEQ ID NO: 21520 - protein, 10 aa, Artificial Sequence
  source: /note="Description of Artificial Sequence: Synthetic peptide"
YFIILPENFL

SEQ ID NO: 21521 - protein, 10 aa, Artificial Sequence
  source: /note="Description of Artificial Sequence: Synthetic peptide"
ILPENFLIIF

SEQ ID NO: 21522 - protein, 10 aa, Artificial Sequence
  source: /note="Description of Artificial Sequence: Synthetic peptide"
PENFLIIFTI

SEQ ID NO: 21523 - protein, 9 aa, Artificial Sequence
  source: /note="Description of Artificial Sequence: Synthetic peptide"
MLALWLWGF

SEQ ID NO: 21524 - protein, 9 aa, Artificial Sequence
  source: /note="Description of Artificial Sequence: Synthetic peptide"
AMMLALWLW

SEQ ID NO: 21525 - protein, 9 aa, Artificial Sequence
  source: /note="Description of Artificial Sequence: Synthetic peptide"
LWLWGFCPL

SEQ ID NO: 21526 - protein, 9 aa, Artificial Sequence
  source: /note="Description of Artificial Sequence: Synthetic peptide"
LWGFCPLHY

SEQ ID NO: 21527 - protein, 9 aa, Artificial Sequence
  source: /note="Description of Artificial Sequence: Synthetic peptide"
YPGGPHPPL

SEQ ID NO: 21528 - protein, 9 aa, Artificial Sequence
  source: /note="Description of Artificial Sequence: Synthetic peptide"
GPHPPLAFL

SEQ ID NO: 21529 - protein, 9 aa, Artificial Sequence
  source: /note="Description of Artificial Sequence: Synthetic peptide"
WPKPAGQLL

SEQ ID NO: 21530 - protein, 9 aa, Artificial Sequence
  source: /note="Description of Artificial Sequence: Synthetic peptide"
LHYPGGPHP

SEQ ID NO: 21531 - protein, 9 aa, Artificial Sequence
  source: /note="Description of Artificial Sequence: Synthetic peptide"
LAFLWPKPA

SEQ ID NO: 21532 - protein, 10 aa, Artificial Sequence
  source: /note="Description of Artificial Sequence: Synthetic peptide"
MMLALWLWGF

SEQ ID NO: 21533 - protein, 10 aa, Artificial Sequence
  source: /note="Description of Artificial Sequence: Synthetic peptide"
MLALWLWGFC

SEQ ID NO: 21534 - protein, 10 aa, Artificial Sequence
  source: /note="Description of Artificial Sequence: Synthetic peptide"
ALWLWGFCPL

SEQ ID NO: 21535 - protein, 10 aa, Artificial Sequence
  source: /note="Description of Artificial Sequence: Synthetic peptide"
FLWPKPAGQL

SEQ ID NO: 21536 - protein, 10 aa, Artificial Sequence
  source: /note="Description of Artificial Sequence: Synthetic peptide"
YAMMLALWLW

SEQ ID NO: 21537 - protein, 10 aa, Artificial Sequence
  source: /note="Description of Artificial Sequence: Synthetic peptide"
HYPGGPHPPL

SEQ ID NO: 21538 - protein, 10 aa, Artificial Sequence
  source: /note="Description of Artificial Sequence: Synthetic peptide"
LWPKPAGQLL

SEQ ID NO: 21539 - protein, 10 aa, Artificial Sequence
  source: /note="Description of Artificial Sequence: Synthetic peptide"
WLWGFCPLHY

SEQ ID NO: 21540 - protein, 10 aa, Artificial Sequence
  source: /note="Description of Artificial Sequence: Synthetic peptide"
WPKPAGQLLL

SEQ ID NO: 21541 - protein, 10 aa, Artificial Sequence
  source: /note="Description of Artificial Sequence: Synthetic peptide"
LHYPGGPHPP

SEQ ID NO: 21542 - protein, 10 aa, Artificial Sequence
  source: /note="Description of Artificial Sequence: Synthetic peptide"
GPHPPLAFLW

SEQ ID NO: 21543 - protein, 9 aa, Artificial Sequence
  source: /note="Description of Artificial Sequence: Synthetic peptide"
MLALWLWGF

SEQ ID NO: 21544 - protein, 9 aa, Artificial Sequence
  source: /note="Description of Artificial Sequence: Synthetic peptide"
AMMLALWLW

SEQ ID NO: 21545 - protein, 9 aa, Artificial Sequence
  source: /note="Description of Artificial Sequence: Synthetic peptide"
LWLWGFCPL

SEQ ID NO: 21546 - protein, 9 aa, Artificial Sequence
  source: /note="Description of Artificial Sequence: Synthetic peptide"
LWGFCPLHY

SEQ ID NO: 21547 - protein, 9 aa, Artificial Sequence
  source: /note="Description of Artificial Sequence: Synthetic peptide"
YPGGPHPPL

SEQ ID NO: 21548 - protein, 9 aa, Artificial Sequence
  source: /note="Description of Artificial Sequence: Synthetic peptide"
GPHPPLAFL

SEQ ID NO: 21549 - protein, 9 aa, Artificial Sequence
  source: /note="Description of Artificial Sequence: Synthetic peptide"
WPKPAGQLL

SEQ ID NO: 21550 - protein, 9 aa, Artificial Sequence
  source: /note="Description of Artificial Sequence: Synthetic peptide"
LHYPGGPHP

SEQ ID NO: 21551 - protein, 9 aa, Artificial Sequence
  source: /note="Description of Artificial Sequence: Synthetic peptide"
LAFLWPKPA

SEQ ID NO: 21552 - protein, 10 aa, Artificial Sequence
  source: /note="Description of Artificial Sequence: Synthetic peptide"
MMLALWLWGF

SEQ ID NO: 21553 - protein, 10 aa, Artificial Sequence
  source: /note="Description of Artificial Sequence: Synthetic peptide"
MLALWLWGFC

SEQ ID NO: 21554 - protein, 10 aa, Artificial Sequence
  source: /note="Description of Artificial Sequence: Synthetic peptide"
ALWLWGFCPL

SEQ ID NO: 21555 - protein, 10 aa, Artificial Sequence
  source: /note="Description of Artificial Sequence: Synthetic peptide"
FLWPKPAGQL

SEQ ID NO: 21556 - protein, 10 aa, Artificial Sequence
  source: /note="Description of Artificial Sequence: Synthetic peptide"
YAMMLALWLW

SEQ ID NO: 21557 - protein, 10 aa, Artificial Sequence
  source: /note="Description of Artificial Sequence: Synthetic peptide"
HYPGGPHPPL

SEQ ID NO: 21558 - protein, 10 aa, Artificial Sequence
  source: /note="Description of Artificial Sequence: Synthetic peptide"
LWPKPAGQLL

SEQ ID NO: 21559 - protein, 10 aa, Artificial Sequence
  source: /note="Description of Artificial Sequence: Synthetic peptide"
WLWGFCPLHY

SEQ ID NO: 21560 - protein, 10 aa, Artificial Sequence
  source: /note="Description of Artificial Sequence: Synthetic peptide"
WPKPAGQLLL

SEQ ID NO: 21561 - protein, 10 aa, Artificial Sequence
  source: /note="Description of Artificial Sequence: Synthetic peptide"
LHYPGGPHPP

SEQ ID NO: 21562 - protein, 10 aa, Artificial Sequence
  source: /note="Description of Artificial Sequence: Synthetic peptide"
GPHPPLAFLW

SEQ ID NO: 21563 - protein, 9 aa, Artificial Sequence
  source: /note="Description of Artificial Sequence: Synthetic peptide"
IMSLDRFRA

SEQ ID NO: 21564 - protein, 9 aa, Artificial Sequence
  source: /note="Description of Artificial Sequence: Synthetic peptide"
LIMSLDRFR

SEQ ID NO: 21565 - protein, 9 aa, Artificial Sequence
  source: /note="Description of Artificial Sequence: Synthetic peptide"
RFRAIHNPL

SEQ ID NO: 21566 - protein, 9 aa, Artificial Sequence
  source: /note="Description of Artificial Sequence: Synthetic peptide"
MSLDRFRAI

SEQ ID NO: 21567 - protein, 9 aa, Artificial Sequence
  source: /note="Description of Artificial Sequence: Synthetic peptide"
RAIHNPLRY

SEQ ID NO: 21568 - protein, 10 aa, Artificial Sequence
  source: /note="Description of Artificial Sequence: Synthetic peptide"
IMSLDRFRAI

SEQ ID NO: 21569 - protein, 10 aa, Artificial Sequence
  source: /note="Description of Artificial Sequence: Synthetic peptide"
LIMSLDRFRA

SEQ ID NO: 21570 - protein, 10 aa, Artificial Sequence
  source: /note="Description of Artificial Sequence: Synthetic peptide"
MSLDRFRAIH

SEQ ID NO: 21571 - protein, 10 aa, Artificial Sequence
  source: /note="Description of Artificial Sequence: Synthetic peptide"
RFRAIHNPLR

SEQ ID NO: 21572 - protein, 10 aa, Artificial Sequence
  source: /note="Description of Artificial Sequence: Synthetic peptide"
FRAIHNPLRY

SEQ ID NO: 21573 - protein, 10 aa, Artificial Sequence
  source: /note="Description of Artificial Sequence: Synthetic peptide"
LLIMSLDRFR

SEQ ID NO: 21574 - protein, 9 aa, Artificial Sequence
  source: /note="Description of Artificial Sequence: Synthetic peptide"
RLFLFSYCK

SEQ ID NO: 21575 - protein, 9 aa, Artificial Sequence
  source: /note="Description of Artificial Sequence: Synthetic peptide"
PVILRLFLF

SEQ ID NO: 21576 - protein, 9 aa, Artificial Sequence
  source: /note="Description of Artificial Sequence: Synthetic peptide"
ILRLFLFSY

SEQ ID NO: 21577 - protein, 9 aa, Artificial Sequence
  source: /note="Description of Artificial Sequence: Synthetic peptide"
LPVILRLFL

SEQ ID NO: 21578 - protein, 9 aa, Artificial Sequence
  source: /note="Description of Artificial Sequence: Synthetic peptide"
FLFSYCKSH

SEQ ID NO: 21579 - protein, 10 aa, Artificial Sequence
  source: /note="Description of Artificial Sequence: Synthetic peptide"
FLFSYCKSHV

SEQ ID NO: 21580 - protein, 10 aa, Artificial Sequence
  source: /note="Description of Artificial Sequence: Synthetic peptide"
ILPVILRLFL

SEQ ID NO: 21581 - protein, 10 aa, Artificial Sequence
  source: /note="Description of Artificial Sequence: Synthetic peptide"
VILRLFLFSY

SEQ ID NO: 21582 - protein, 10 aa, Artificial Sequence
  source: /note="Description of Artificial Sequence: Synthetic peptide"
LPVILRLFLF

SEQ ID NO: 21583 - protein, 9 aa, Artificial Sequence
  source: /note="Description of Artificial Sequence: Synthetic peptide"
MLAGPDHNA

SEQ ID NO: 21584 - protein, 9 aa, Artificial Sequence
  source: /note="Description of Artificial Sequence: Synthetic peptide"
LLFPGLLYT

SEQ ID NO: 21585 - protein, 9 aa, Artificial Sequence
  source: /note="Description of Artificial Sequence: Synthetic peptide"
GLLYTLTFL

SEQ ID NO: 21586 - protein, 9 aa, Artificial Sequence
  source: /note="Description of Artificial Sequence: Synthetic peptide"
LLYTLTFLS

SEQ ID NO: 21587 - protein, 9 aa, Artificial Sequence
  source: /note="Description of Artificial Sequence: Synthetic peptide"
YTLTFLSRV

SEQ ID NO: 21588 - protein, 9 aa, Artificial Sequence
  source: /note="Description of Artificial Sequence: Synthetic peptide"
FLSRVWHSA

SEQ ID NO: 21589 - protein, 9 aa, Artificial Sequence
  source: /note="Description of Artificial Sequence: Synthetic peptide"
GLLFPGLLY

SEQ ID NO: 21590 - protein, 9 aa, Artificial Sequence
  source: /note="Description of Artificial Sequence: Synthetic peptide"
LFPGLLYTL

SEQ ID NO: 21591 - protein, 9 aa, Artificial Sequence
  source: /note="Description of Artificial Sequence: Synthetic peptide"
VWHSACHGL

SEQ ID NO: 21592 - protein, 9 aa, Artificial Sequence
  source: /note="Description of Artificial Sequence: Synthetic peptide"
LYTLTFLSR

SEQ ID NO: 21593 - protein, 9 aa, Artificial Sequence
  source: /note="Description of Artificial Sequence: Synthetic peptide"
NAHGAGSPL

SEQ ID NO: 21594 - protein, 9 aa, Artificial Sequence
  source: /note="Description of Artificial Sequence: Synthetic peptide"
SQGDWKCGL

SEQ ID NO: 21595 - protein, 9 aa, Artificial Sequence
  source: /note="Description of Artificial Sequence: Synthetic peptide"
GDWKCGLLF

SEQ ID NO: 21596 - protein, 9 aa, Artificial Sequence
  source: /note="Description of Artificial Sequence: Synthetic peptide"
FPGLLYTLT

SEQ ID NO: 21597 - protein, 10 aa, Artificial Sequence
  source: /note="Description of Artificial Sequence: Synthetic peptide"
AMLAGPDHNA

SEQ ID NO: 21598 - protein, 10 aa, Artificial Sequence
  source: /note="Description of Artificial Sequence: Synthetic peptide"
GLLFPGLLYT

SEQ ID NO: 21599 - protein, 10 aa, Artificial Sequence
  source: /note="Description of Artificial Sequence: Synthetic peptide"
LLFPGLLYTL

SEQ ID NO: 21600 - protein, 10 aa, Artificial Sequence
  source: /note="Description of Artificial Sequence: Synthetic peptide"
FLSRVWHSAC

SEQ ID NO: 21601 - protein, 10 aa, Artificial Sequence
  source: /note="Description of Artificial Sequence: Synthetic peptide"
RVWHSACHGL

SEQ ID NO: 21602 - protein, 10 aa, Artificial Sequence
  source: /note="Description of Artificial Sequence: Synthetic peptide"
LLYTLTFLSR

SEQ ID NO: 21603 - protein, 10 aa, Artificial Sequence
  source: /note="Description of Artificial Sequence: Synthetic peptide"
LYTLTFLSRV

SEQ ID NO: 21604 - protein, 10 aa, Artificial Sequence
  source: /note="Description of Artificial Sequence: Synthetic peptide"
YTLTFLSRVW

SEQ ID NO: 21605 - protein, 10 aa, Artificial Sequence
  source: /note="Description of Artificial Sequence: Synthetic peptide"
LSRVWHSACH

SEQ ID NO: 21606 - protein, 10 aa, Artificial Sequence
  source: /note="Description of Artificial Sequence: Synthetic peptide"
CGLLFPGLLY

SEQ ID NO: 21607 - protein, 10 aa, Artificial Sequence
  source: /note="Description of Artificial Sequence: Synthetic peptide"
HNAHGAGSPL

SEQ ID NO: 21608 - protein, 10 aa, Artificial Sequence
  source: /note="Description of Artificial Sequence: Synthetic peptide"
FPGLLYTLTF

SEQ ID NO: 21609 - protein, 10 aa, Artificial Sequence
  source: /note="Description of Artificial Sequence: Synthetic peptide"
MLAGPDHNAH

SEQ ID NO: 21610 - protein, 10 aa, Artificial Sequence
  source: /note="Description of Artificial Sequence: Synthetic peptide"
SQGDWKCGLL

SEQ ID NO: 21611 - protein, 10 aa, Artificial Sequence
  source: /note="Description of Artificial Sequence: Synthetic peptide"
WKCGLLFPGL

SEQ ID NO: 21612 - protein, 10 aa, Artificial Sequence
  source: /note="Description of Artificial Sequence: Synthetic peptide"
SPLAGSQGDW

SEQ ID NO: 21613 - protein, 9 aa, Artificial Sequence
  source: /note="Description of Artificial Sequence: Synthetic peptide"
VLCEPSLHK

SEQ ID NO: 21614 - protein, 9 aa, Artificial Sequence
  source: /note="Description of Artificial Sequence: Synthetic peptide"
PSLHKPMYY

SEQ ID NO: 21615 - protein, 9 aa, Artificial Sequence
  source: /note="Description of Artificial Sequence: Synthetic peptide"
CEPSLHKPM

SEQ ID NO: 21616 - protein, 10 aa, Artificial Sequence
  source: /note="Description of Artificial Sequence: Synthetic peptide"
VVLCEPSLHK

SEQ ID NO: 21617 - protein, 10 aa, Artificial Sequence
  source: /note="Description of Artificial Sequence: Synthetic peptide"
LCEPSLHKPM

SEQ ID NO: 21618 - protein, 10 aa, Artificial Sequence
  source: /note="Description of Artificial Sequence: Synthetic peptide"
EPSLHKPMYY

SEQ ID NO: 21619 - protein, 9 aa, Artificial Sequence
  source: /note="Description of Artificial Sequence: Synthetic peptide"
SLAISFQCL

SEQ ID NO: 21620 - protein, 9 aa, Artificial Sequence
  source: /note="Description of Artificial Sequence: Synthetic peptide"
SFQCLGLHL

SEQ ID NO: 21621 - protein, 9 aa, Artificial Sequence
  source: /note="Description of Artificial Sequence: Synthetic peptide"
ISFQCLGLH

SEQ ID NO: 21622 - protein, 10 aa, Artificial Sequence
  source: /note="Description of Artificial Sequence: Synthetic peptide"
FQCLGLHLPL

SEQ ID NO: 21623 - protein, 10 aa, Artificial Sequence
  source: /note="Description of Artificial Sequence: Synthetic peptide"
ISLAISFQCL

SEQ ID NO: 21624 - protein, 10 aa, Artificial Sequence
  source: /note="Description of Artificial Sequence: Synthetic peptide"
LAISFQCLGL

SEQ ID NO: 21625 - protein, 10 aa, Artificial Sequence
  source: /note="Description of Artificial Sequence: Synthetic peptide"
ISFQCLGLHL

SEQ ID NO: 21626 - protein, 9 aa, Artificial Sequence
  source: /note="Description of Artificial Sequence: Synthetic peptide"
ILFPPLMNT

SEQ ID NO: 21627 - protein, 9 aa, Artificial Sequence
  source: /note="Description of Artificial Sequence: Synthetic peptide"
LMNTIIYSV

SEQ ID NO: 21628 - protein, 9 aa, Artificial Sequence
  source: /note="Description of Artificial Sequence: Synthetic peptide"
LFPPLMNTI

SEQ ID NO: 21629 - protein, 9 aa, Artificial Sequence
  source: /note="Description of Artificial Sequence: Synthetic peptide"
MNTIIYSVK

SEQ ID NO: 21630 - protein, 9 aa, Artificial Sequence
  source: /note="Description of Artificial Sequence: Synthetic peptide"
NTIIYSVKT

SEQ ID NO: 21631 - protein, 9 aa, Artificial Sequence
  source: /note="Description of Artificial Sequence: Synthetic peptide"
PPLMNTIIY

SEQ ID NO: 21632 - protein, 9 aa, Artificial Sequence
  source: /note="Description of Artificial Sequence: Synthetic peptide"
FPPLMNTII

SEQ ID NO: 21633 - protein, 10 aa, Artificial Sequence
  source: /note="Description of Artificial Sequence: Synthetic peptide"
ILFPPLMNTI

SEQ ID NO: 21634 - protein, 10 aa, Artificial Sequence
  source: /note="Description of Artificial Sequence: Synthetic peptide"
PLMNTIIYSV

SEQ ID NO: 21635 - protein, 10 aa, Artificial Sequence
  source: /note="Description of Artificial Sequence: Synthetic peptide"
LMNTIIYSVK

SEQ ID NO: 21636 - protein, 10 aa, Artificial Sequence
  source: /note="Description of Artificial Sequence: Synthetic peptide"
LFPPLMNTII

SEQ ID NO: 21637 - protein, 10 aa, Artificial Sequence
  source: /note="Description of Artificial Sequence: Synthetic peptide"
FPPLMNTIIY

SEQ ID NO: 21638 - protein, 9 aa, Artificial Sequence
  source: /note="Description of Artificial Sequence: Synthetic peptide"
RAAAIGCPL

SEQ ID NO: 21639 - protein, 9 aa, Artificial Sequence
  source: /note="Description of Artificial Sequence: Synthetic peptide"
AAIGCPLHY

SEQ ID NO: 21640 - protein, 9 aa, Artificial Sequence
  source: /note="Description of Artificial Sequence: Synthetic peptide"
CPLHYPVLV

SEQ ID NO: 21641 - protein, 10 aa, Artificial Sequence
  source: /note="Description of Artificial Sequence: Synthetic peptide"
AIGCPLHYPV

SEQ ID NO: 21642 - protein, 10 aa, Artificial Sequence
  source: /note="Description of Artificial Sequence: Synthetic peptide"
RAAAIGCPLH

SEQ ID NO: 21643 - protein, 10 aa, Artificial Sequence
  source: /note="Description of Artificial Sequence: Synthetic peptide"
AAAIGCPLHY

SEQ ID NO: 21644 - protein, 10 aa, Artificial Sequence
  source: /note="Description of Artificial Sequence: Synthetic peptide"
IGCPLHYPVL

SEQ ID NO: 21645 - protein, 9 aa, Artificial Sequence
  source: /note="Description of Artificial Sequence: Synthetic peptide"
FTEENNLML

SEQ ID NO: 21646 - protein, 9 aa, Artificial Sequence
  source: /note="Description of Artificial Sequence: Synthetic peptide"
TEENNLMLF

SEQ ID NO: 21647 - protein, 10 aa, Artificial Sequence
  source: /note="Description of Artificial Sequence: Synthetic peptide"
FTEENNLMLF

SEQ ID NO: 21648 - protein, 10 aa, Artificial Sequence
  source: /note="Description of Artificial Sequence: Synthetic peptide"
LQSFTEENNL

SEQ ID NO: 21649 - protein, 10 aa, Artificial Sequence
  source: /note="Description of Artificial Sequence: Synthetic peptide"
QSFTEENNLM

SEQ ID NO: 21650 - protein, 9 aa, Artificial Sequence
  source: /note="Description of Artificial Sequence: Synthetic peptide"
FLLVYTLTI

SEQ ID NO: 21651 - protein, 9 aa, Artificial Sequence
  source: /note="Description of Artificial Sequence: Synthetic peptide"
LLVYTLTIV

SEQ ID NO: 21652 - protein, 9 aa, Artificial Sequence
  source: /note="Description of Artificial Sequence: Synthetic peptide"
YTLTIVGNI

SEQ ID NO: 21653 - protein, 9 aa, Artificial Sequence
  source: /note="Description of Artificial Sequence: Synthetic peptide"
TIVGNILLI

SEQ ID NO: 21654 - protein, 9 aa, Artificial Sequence
  source: /note="Description of Artificial Sequence: Synthetic peptide"
LTIVGNILL

SEQ ID NO: 21655 - protein, 10 aa, Artificial Sequence
  source: /note="Description of Artificial Sequence: Synthetic peptide"
FLLVYTLTIV

SEQ ID NO: 21656 - protein, 10 aa, Artificial Sequence
  source: /note="Description of Artificial Sequence: Synthetic peptide"
VFLLVYTLTI

SEQ ID NO: 21657 - protein, 10 aa, Artificial Sequence
  source: /note="Description of Artificial Sequence: Synthetic peptide"
VYTLTIVGNI

SEQ ID NO: 21658 - protein, 10 aa, Artificial Sequence
  source: /note="Description of Artificial Sequence: Synthetic peptide"
YTLTIVGNIL

SEQ ID NO: 21659 - protein, 10 aa, Artificial Sequence
  source: /note="Description of Artificial Sequence: Synthetic peptide"
LTIVGNILLI

SEQ ID NO: 21660 - protein, 9 aa, Artificial Sequence
  source: /note="Description of Artificial Sequence: Synthetic peptide"
FMYLHPRSS

SEQ ID NO: 21661 - protein, 9 aa, Artificial Sequence
  source: /note="Description of Artificial Sequence: Synthetic peptide"
YLHPRSSYS

SEQ ID NO: 21662 - protein, 9 aa, Artificial Sequence
  source: /note="Description of Artificial Sequence: Synthetic peptide"
TLFMYLHPR

SEQ ID NO: 21663 - protein, 9 aa, Artificial Sequence
  source: /note="Description of Artificial Sequence: Synthetic peptide"
GTTLFMYLH

SEQ ID NO: 21664 - protein, 9 aa, Artificial Sequence
  source: /note="Description of Artificial Sequence: Synthetic peptide"
MYLHPRSSY

SEQ ID NO: 21665 - protein, 9 aa, Artificial Sequence
  source: /note="Description of Artificial Sequence: Synthetic peptide"
HPRSSYSLT

SEQ ID NO: 21666 - protein, 9 aa, Artificial Sequence
  source: /note="Description of Artificial Sequence: Synthetic peptide"
LHPRSSYSL

SEQ ID NO: 21667 - protein, 10 aa, Artificial Sequence
  source: /note="Description of Artificial Sequence: Synthetic peptide"
YLHPRSSYSL

SEQ ID NO: 21668 - protein, 10 aa, Artificial Sequence
  source: /note="Description of Artificial Sequence: Synthetic peptide"
FMYLHPRSSY

SEQ ID NO: 21669 - protein, 10 aa, Artificial Sequence
  source: /note="Description of Artificial Sequence: Synthetic peptide"
TTLFMYLHPR

SEQ ID NO: 21670 - protein, 9 aa, Artificial Sequence
  source: /note="Description of Artificial Sequence: Synthetic peptide"
MLNPLVYCL

SEQ ID NO: 21671 - protein, 10 aa, Artificial Sequence
  source: /note="Description of Artificial Sequence: Synthetic peptide"
LVYCLRNKEV

SEQ ID NO: 21672 - protein, 10 aa, Artificial Sequence
  source: /note="Description of Artificial Sequence: Synthetic peptide"
MLNPLVYCLR

SEQ ID NO: 21673 - protein, 10 aa, Artificial Sequence
  source: /note="Description of Artificial Sequence: Synthetic peptide"
CLRNKEVKSA

SEQ ID NO: 21674 - protein, 9 aa, Artificial Sequence
  source: /note="Description of Artificial Sequence: Synthetic peptide"
IQIGDTFHL

SEQ ID NO: 21675 - protein, 9 aa, Artificial Sequence
  source: /note="Description of Artificial Sequence: Synthetic peptide"
HLSFCMSNV

SEQ ID NO: 21676 - protein, 9 aa, Artificial Sequence
  source: /note="Description of Artificial Sequence: Synthetic peptide"
DTFHLSFCM

SEQ ID NO: 21677 - protein, 9 aa, Artificial Sequence
  source: /note="Description of Artificial Sequence: Synthetic peptide"
IGDTFHLSF

SEQ ID NO: 21678 - protein, 10 aa, Artificial Sequence
  source: /note="Description of Artificial Sequence: Synthetic peptide"
HLSFCMSNVI

SEQ ID NO: 21679 - protein, 10 aa, Artificial Sequence
  source: /note="Description of Artificial Sequence: Synthetic peptide"
DTFHLSFCMS

SEQ ID NO: 21680 - protein, 10 aa, Artificial Sequence
  source: /note="Description of Artificial Sequence: Synthetic peptide"
QIGDTFHLSF

SEQ ID NO: 21681 - protein, 9 aa, Artificial Sequence
  source: /note="Description of Artificial Sequence: Synthetic peptide"
SSHSIDTDK

SEQ ID NO: 21682 - protein, 10 aa, Artificial Sequence
  source: /note="Description of Artificial Sequence: Synthetic peptide"
SIDTDKIASV

SEQ ID NO: 21683 - protein, 10 aa, Artificial Sequence
  source: /note="Description of Artificial Sequence: Synthetic peptide"
YIRPSSSHSI

SEQ ID NO: 21684 - protein, 10 aa, Artificial Sequence
  source: /note="Description of Artificial Sequence: Synthetic peptide"
SSSHSIDTDK

SEQ ID NO: 21685 - protein, 10 aa, Artificial Sequence
  source: /note="Description of Artificial Sequence: Synthetic peptide"
RPSSSHSIDT

SEQ ID NO: 21686 - protein, 10 aa, Artificial Sequence
  source: /note="Description of Artificial Sequence: Synthetic peptide"
IDTDKIASVF

SEQ ID NO: 21687 - protein, 9 aa, Artificial Sequence
  source: /note="Description of Artificial Sequence: Synthetic peptide"
KMRSASGCQ

SEQ ID NO: 21688 - protein, 9 aa, Artificial Sequence
  source: /note="Description of Artificial Sequence: Synthetic peptide"
SASGCQKTF

SEQ ID NO: 21689 - protein, 9 aa, Artificial Sequence
  source: /note="Description of Artificial Sequence: Synthetic peptide"
CQKTFSTCA

SEQ ID NO: 21690 - protein, 10 aa, Artificial Sequence
  source: /note="Description of Artificial Sequence: Synthetic peptide"
KMRSASGCQK

SEQ ID NO: 21691 - protein, 10 aa, Artificial Sequence
  source: /note="Description of Artificial Sequence: Synthetic peptide"
RSASGCQKTF

SEQ ID NO: 21692 - protein, 10 aa, Artificial Sequence
  source: /note="Description of Artificial Sequence: Synthetic peptide"
CQKTFSTCAS

SEQ ID NO: 21693 - protein, 9 aa, Artificial Sequence
  source: /note="Description of Artificial Sequence: Synthetic peptide"
TWASNLTSI

SEQ ID NO: 21694 - protein, 9 aa, Artificial Sequence
  source: /note="Description of Artificial Sequence: Synthetic peptide"
KAFSTWASN

SEQ ID NO: 21695 - protein, 9 aa, Artificial Sequence
  source: /note="Description of Artificial Sequence: Synthetic peptide"
ASNLTSITI

SEQ ID NO: 21696 - protein, 9 aa, Artificial Sequence
  source: /note="Description of Artificial Sequence: Synthetic peptide"
SNLTSITIF

SEQ ID NO: 21697 - protein, 10 aa, Artificial Sequence
  source: /note="Description of Artificial Sequence: Synthetic peptide"
STWASNLTSI

SEQ ID NO: 21698 - protein, 10 aa, Artificial Sequence
  source: /note="Description of Artificial Sequence: Synthetic peptide"
KAFSTWASNL

SEQ ID NO: 21699 - protein, 10 aa, Artificial Sequence
  source: /note="Description of Artificial Sequence: Synthetic peptide"
WASNLTSITI

SEQ ID NO: 21700 - protein, 10 aa, Artificial Sequence
  source: /note="Description of Artificial Sequence: Synthetic peptide"
ASNLTSITIF

SEQ ID NO: 21701 - protein, 9 aa, Artificial Sequence
  source: /note="Description of Artificial Sequence: Synthetic peptide"
FLYCVTNSK

SEQ ID NO: 21702 - protein, 9 aa, Artificial Sequence
  source: /note="Description of Artificial Sequence: Synthetic peptide"
CVTNSKNSR

SEQ ID NO: 21703 - protein, 10 aa, Artificial Sequence
  source: /note="Description of Artificial Sequence: Synthetic peptide"
LFLYCVTNSK

SEQ ID NO: 21704 - protein, 9 aa, Artificial Sequence
  source: /note="Description of Artificial Sequence: Synthetic peptide"
KVKVASVFY

SEQ ID NO: 21705 - protein, 9 aa, Artificial Sequence
  source: /note="Description of Artificial Sequence: Synthetic peptide"
RHKVKVASV

SEQ ID NO: 21706 - protein, 9 aa, Artificial Sequence
  source: /note="Description of Artificial Sequence: Synthetic peptide"
HKVKVASVF

SEQ ID NO: 21707 - protein, 10 aa, Artificial Sequence
  source: /note="Description of Artificial Sequence: Synthetic peptide"
NSKNSRHKVK

SEQ ID NO: 21708 - protein, 10 aa, Artificial Sequence
  source: /note="Description of Artificial Sequence: Synthetic peptide"
KVKVASVFYT

SEQ ID NO: 21709 - protein, 10 aa, Artificial Sequence
  source: /note="Description of Artificial Sequence: Synthetic peptide"
RHKVKVASVF

SEQ ID NO: 21710 - protein, 10 aa, Artificial Sequence
  source: /note="Description of Artificial Sequence: Synthetic peptide"
HKVKVASVFY

SEQ ID NO: 21711 - protein, 9 aa, Artificial Sequence
  source: /note="Description of Artificial Sequence: Synthetic peptide"
VLGNLVMIL

SEQ ID NO: 21712 - protein, 9 aa, Artificial Sequence
  source: /note="Description of Artificial Sequence: Synthetic peptide"
TLTVLGNLV

SEQ ID NO: 21713 - protein, 9 aa, Artificial Sequence
  source: /note="Description of Artificial Sequence: Synthetic peptide"
TVLGNLVMI

SEQ ID NO: 21714 - protein, 9 aa, Artificial Sequence
  source: /note="Description of Artificial Sequence: Synthetic peptide"
LTVLGNLVM

SEQ ID NO: 21715 - protein, 10 aa, Artificial Sequence
  source: /note="Description of Artificial Sequence: Synthetic peptide"
YTLTVLGNLV

SEQ ID NO: 21716 - protein, 10 aa, Artificial Sequence
  source: /note="Description of Artificial Sequence: Synthetic peptide"
VLGNLVMILL

SEQ ID NO: 21717 - protein, 10 aa, Artificial Sequence
  source: /note="Description of Artificial Sequence: Synthetic peptide"
NLVMILLIRI

SEQ ID NO: 21718 - protein, 10 aa, Artificial Sequence
  source: /note="Description of Artificial Sequence: Synthetic peptide"
TLTVLGNLVM

SEQ ID NO: 21719 - protein, 9 aa, Artificial Sequence
  source: /note="Description of Artificial Sequence: Synthetic peptide"
VVFLVIYSI

SEQ ID NO: 21720 - protein, 9 aa, Artificial Sequence
  source: /note="Description of Artificial Sequence: Synthetic peptide"
FLVIYSITL

SEQ ID NO: 21721 - protein, 9 aa, Artificial Sequence
  source: /note="Description of Artificial Sequence: Synthetic peptide"
LVIYSITLL

SEQ ID NO: 21722 - protein, 9 aa, Artificial Sequence
  source: /note="Description of Artificial Sequence: Synthetic peptide"
VIYSITLLR

SEQ ID NO: 21723 - protein, 9 aa, Artificial Sequence
  source: /note="Description of Artificial Sequence: Synthetic peptide"
YSITLLRNL

SEQ ID NO: 21724 - protein, 10 aa, Artificial Sequence
  source: /note="Description of Artificial Sequence: Synthetic peptide"
FVVFLVIYSI

SEQ ID NO: 21725 - protein, 10 aa, Artificial Sequence
  source: /note="Description of Artificial Sequence: Synthetic peptide"
FLVIYSITLL

SEQ ID NO: 21726 - protein, 10 aa, Artificial Sequence
  source: /note="Description of Artificial Sequence: Synthetic peptide"
LVIYSITLLR

SEQ ID NO: 21727 - protein, 10 aa, Artificial Sequence
  source: /note="Description of Artificial Sequence: Synthetic peptide"
VFLVIYSITL

SEQ ID NO: 21728 - protein, 10 aa, Artificial Sequence
  source: /note="Description of Artificial Sequence: Synthetic peptide"
IYSITLLRNL

SEQ ID NO: 21729 - protein, 9 aa, Artificial Sequence
  source: /note="Description of Artificial Sequence: Synthetic peptide"
KVANVFYTV

SEQ ID NO: 21730 - protein, 9 aa, Artificial Sequence
  source: /note="Description of Artificial Sequence: Synthetic peptide"
ANVFYTVVI

SEQ ID NO: 21731 - protein, 9 aa, Artificial Sequence
  source: /note="Description of Artificial Sequence: Synthetic peptide"
DADKVANVF

SEQ ID NO: 21732 - protein, 10 aa, Artificial Sequence
  source: /note="Description of Artificial Sequence: Synthetic peptide"
DADKVANVFY

SEQ ID NO: 21733 - protein, 10 aa, Artificial Sequence
  source: /note="Description of Artificial Sequence: Synthetic peptide"
KVANVFYTVV

SEQ ID NO: 21734 - protein, 10 aa, Artificial Sequence
  source: /note="Description of Artificial Sequence: Synthetic peptide"
NVFYTVVIPM

SEQ ID NO: 21735 - protein, 10 aa, Artificial Sequence
  source: /note="Description of Artificial Sequence: Synthetic peptide"
GDADKVANVF

SEQ ID NO: 21736 - protein, 10 aa, Artificial Sequence
  source: /note="Description of Artificial Sequence: Synthetic peptide"
VANVFYTVVI

SEQ ID NO: 21737 - protein, 9 aa, Artificial Sequence
  source: /note="Description of Artificial Sequence: Synthetic peptide"
LSDKKQLLM

SEQ ID NO: 21738 - protein, 9 aa, Artificial Sequence
  source: /note="Description of Artificial Sequence: Synthetic peptide"
LLSDKKQLL

SEQ ID NO: 21739 - protein, 9 aa, Artificial Sequence
  source: /note="Description of Artificial Sequence: Synthetic peptide"
KKQLLMLVV

SEQ ID NO: 21740 - protein, 10 aa, Artificial Sequence
  source: /note="Description of Artificial Sequence: Synthetic peptide"
LSDKKQLLML

SEQ ID NO: 21741 - protein, 10 aa, Artificial Sequence
  source: /note="Description of Artificial Sequence: Synthetic peptide"
LLSDKKQLLM

SEQ ID NO: 21742 - protein, 9 aa, Artificial Sequence
  source: /note="Description of Artificial Sequence: Synthetic peptide"
QLGSVAFFA

SEQ ID NO: 21743 - protein, 9 aa, Artificial Sequence
  source: /note="Description of Artificial Sequence: Synthetic peptide"
GSVAFFATV

SEQ ID NO: 21744 - protein, 9 aa, Artificial Sequence
  source: /note="Description of Artificial Sequence: Synthetic peptide"
IQLGSVAFF

SEQ ID NO: 21745 - protein, 9 aa, Artificial Sequence
  source: /note="Description of Artificial Sequence: Synthetic peptide"
AIQLGSVAF

SEQ ID NO: 21746 - protein, 9 aa, Artificial Sequence
  source: /note="Description of Artificial Sequence: Synthetic peptide"
CAIQLGSVA

SEQ ID NO: 21747 - protein, 10 aa, Artificial Sequence
  source: /note="Description of Artificial Sequence: Synthetic peptide"
IQLGSVAFFA

SEQ ID NO: 21748 - protein, 10 aa, Artificial Sequence
  source: /note="Description of Artificial Sequence: Synthetic peptide"
VAFFATVECV

SEQ ID NO: 21749 - protein, 10 aa, Artificial Sequence
  source: /note="Description of Artificial Sequence: Synthetic peptide"
CAIQLGSVAF

SEQ ID NO: 21750 - protein, 10 aa, Artificial Sequence
  source: /note="Description of Artificial Sequence: Synthetic peptide"
AIQLGSVAFF

SEQ ID NO: 21751 - protein, 9 aa, Artificial Sequence
  source: /note="Description of Artificial Sequence: Synthetic peptide"
DYGPPTGFL

SEQ ID NO: 21752 - protein, 9 aa, Artificial Sequence
  source: /note="Description of Artificial Sequence: Synthetic peptide"
GFLIIFSPR

SEQ ID NO: 21753 - protein, 9 aa, Artificial Sequence
  source: /note="Description of Artificial Sequence: Synthetic peptide"
LIIFSPRDY

SEQ ID NO: 21754 - protein, 9 aa, Artificial Sequence
  source: /note="Description of Artificial Sequence: Synthetic peptide"
SPRDYGPPT

SEQ ID NO: 21755 - protein, 9 aa, Artificial Sequence
  source: /note="Description of Artificial Sequence: Synthetic peptide"
RDYGPPTGF

SEQ ID NO: 21756 - protein, 10 aa, Artificial Sequence
  source: /note="Description of Artificial Sequence: Synthetic peptide"
WLAGFLIIFS

SEQ ID NO: 21757 - protein, 10 aa, Artificial Sequence
  source: /note="Description of Artificial Sequence: Synthetic peptide"
AGFLIIFSPR

SEQ ID NO: 21758 - protein, 10 aa, Artificial Sequence
  source: /note="Description of Artificial Sequence: Synthetic peptide"
FLIIFSPRDY

SEQ ID NO: 21759 - protein, 10 aa, Artificial Sequence
  source: /note="Description of Artificial Sequence: Synthetic peptide"
RDYGPPTGFL

SEQ ID NO: 21760 - protein, 9 aa, Artificial Sequence
  source: /note="Description of Artificial Sequence: Synthetic peptide"
RTISYNWCV

SEQ ID NO: 21761 - protein, 9 aa, Artificial Sequence
  source: /note="Description of Artificial Sequence: Synthetic peptide"
SYNWCVAQL

SEQ ID NO: 21762 - protein, 9 aa, Artificial Sequence
  source: /note="Description of Artificial Sequence: Synthetic peptide"
YNWCVAQLF

SEQ ID NO: 21763 - protein, 9 aa, Artificial Sequence
  source: /note="Description of Artificial Sequence: Synthetic peptide"
NWCVAQLFF

SEQ ID NO: 21764 - protein, 10 aa, Artificial Sequence
  source: /note="Description of Artificial Sequence: Synthetic peptide"
SYNWCVAQLF

SEQ ID NO: 21765 - protein, 10 aa, Artificial Sequence
  source: /note="Description of Artificial Sequence: Synthetic peptide"
YNWCVAQLFF

SEQ ID NO: 21766 - protein, 10 aa, Artificial Sequence
  source: /note="Description of Artificial Sequence: Synthetic peptide"
NWCVAQLFFF

SEQ ID NO: 21767 - protein, 10 aa, Artificial Sequence
  source: /note="Description of Artificial Sequence: Synthetic peptide"
RTISYNWCVA

SEQ ID NO: 21768 - protein, 10 aa, Artificial Sequence
  source: /note="Description of Artificial Sequence: Synthetic peptide"
ISYNWCVAQL

SEQ ID NO: 21769 - protein, 9 aa, Artificial Sequence
  source: /note="Description of Artificial Sequence: Synthetic peptide"
TIQKMLSSL

SEQ ID NO: 21770 - protein, 9 aa, Artificial Sequence
  source: /note="Description of Artificial Sequence: Synthetic peptide"
IQKMLSSLL

SEQ ID NO: 21771 - protein, 9 aa, Artificial Sequence
  source: /note="Description of Artificial Sequence: Synthetic peptide"
YTTATIQKM

SEQ ID NO: 21772 - protein, 9 aa, Artificial Sequence
  source: /note="Description of Artificial Sequence: Synthetic peptide"
TTATIQKML

SEQ ID NO: 21773 - protein, 10 aa, Artificial Sequence
  source: /note="Description of Artificial Sequence: Synthetic peptide"
ATIQKMLSSL

SEQ ID NO: 21774 - protein, 10 aa, Artificial Sequence
  source: /note="Description of Artificial Sequence: Synthetic peptide"
TIQKMLSSLL

SEQ ID NO: 21775 - protein, 10 aa, Artificial Sequence
  source: /note="Description of Artificial Sequence: Synthetic peptide"
IWYTTATIQK

SEQ ID NO: 21776 - protein, 10 aa, Artificial Sequence
  source: /note="Description of Artificial Sequence: Synthetic peptide"
WYTTATIQKM

SEQ ID NO: 21777 - protein, 10 aa, Artificial Sequence
  source: /note="Description of Artificial Sequence: Synthetic peptide"
YTTATIQKML

SEQ ID NO: 21778 - protein, 10 aa, Artificial Sequence
  source: /note="Description of Artificial Sequence: Synthetic peptide"
IQKMLSSLLS

SEQ ID NO: 21779 - protein, 9 aa, Artificial Sequence
  source: /note="Description of Artificial Sequence: Synthetic peptide"
VTFVILAPL

SEQ ID NO: 21780 - protein, 9 aa, Artificial Sequence
  source: /note="Description of Artificial Sequence: Synthetic peptide"
ILAPLFNPI

SEQ ID NO: 21781 - protein, 9 aa, Artificial Sequence
  source: /note="Description of Artificial Sequence: Synthetic peptide"
TFVILAPLF

SEQ ID NO: 21782 - protein, 9 aa, Artificial Sequence
  source: /note="Description of Artificial Sequence: Synthetic peptide"
APLFNPIIY

SEQ ID NO: 21783 - protein, 10 aa, Artificial Sequence
  source: /note="Description of Artificial Sequence: Synthetic peptide"
VILAPLFNPI

SEQ ID NO: 21784 - protein, 10 aa, Artificial Sequence
  source: /note="Description of Artificial Sequence: Synthetic peptide"
ILAPLFNPII

SEQ ID NO: 21785 - protein, 10 aa, Artificial Sequence
  source: /note="Description of Artificial Sequence: Synthetic peptide"
AVTFVILAPL

SEQ ID NO: 21786 - protein, 10 aa, Artificial Sequence
  source: /note="Description of Artificial Sequence: Synthetic peptide"
LFNPIIYSLK

SEQ ID NO: 21787 - protein, 10 aa, Artificial Sequence
  source: /note="Description of Artificial Sequence: Synthetic peptide"
VTFVILAPLF

SEQ ID NO: 21788 - protein, 10 aa, Artificial Sequence
  source: /note="Description of Artificial Sequence: Synthetic peptide"
LAPLFNPIIY

SEQ ID NO: 21789 - protein, 9 aa, Artificial Sequence
  source: /note="Description of Artificial Sequence: Synthetic peptide"
SLCNKEIIK

SEQ ID NO: 21790 - protein, 9 aa, Artificial Sequence
  source: /note="Description of Artificial Sequence: Synthetic peptide"
PIIYSLCNK

SEQ ID NO: 21791 - protein, 9 aa, Artificial Sequence
  source: /note="Description of Artificial Sequence: Synthetic peptide"
IYSLCNKEI

SEQ ID NO: 21792 - protein, 9 aa, Artificial Sequence
  source: /note="Description of Artificial Sequence: Synthetic peptide"
YSLCNKEII

SEQ ID NO: 21793 - protein, 10 aa, Artificial Sequence
  source: /note="Description of Artificial Sequence: Synthetic peptide"
IIYSLCNKEI

SEQ ID NO: 21794 - protein, 10 aa, Artificial Sequence
  source: /note="Description of Artificial Sequence: Synthetic peptide"
YSLCNKEIIK

SEQ ID NO: 21795 - protein, 10 aa, Artificial Sequence
  source: /note="Description of Artificial Sequence: Synthetic peptide"
IYSLCNKEII

SEQ ID NO: 21796 - protein, 10 aa, Artificial Sequence
  source: /note="Description of Artificial Sequence: Synthetic peptide"
CNKEIIKAIK

SEQ ID NO: 21797 - protein, 10 aa, Artificial Sequence
  source: /note="Description of Artificial Sequence: Synthetic peptide"
MVNPIIYSLC

SEQ ID NO: 21798 - protein, 9 aa, Artificial Sequence
  source: /note="Description of Artificial Sequence: Synthetic peptide"
LTLVFMATV

SEQ ID NO: 21799 - protein, 9 aa, Artificial Sequence
  source: /note="Description of Artificial Sequence: Synthetic peptide"
TLVFMATVV

SEQ ID NO: 21800 - protein, 9 aa, Artificial Sequence
  source: /note="Description of Artificial Sequence: Synthetic peptide"
FMATVVPSF

SEQ ID NO: 21801 - protein, 9 aa, Artificial Sequence
  source: /note="Description of Artificial Sequence: Synthetic peptide"
FCMSGLAKL

SEQ ID NO: 21802 - protein, 9 aa, Artificial Sequence
  source: /note="Description of Artificial Sequence: Synthetic peptide"
GLAKLTLCK

SEQ ID NO: 21803 - protein, 9 aa, Artificial Sequence
  source: /note="Description of Artificial Sequence: Synthetic peptide"
SFCMSGLAK

SEQ ID NO: 21804 - protein, 9 aa, Artificial Sequence
  source: /note="Description of Artificial Sequence: Synthetic peptide"
GSHLTLVFM

SEQ ID NO: 21805 - protein, 9 aa, Artificial Sequence
  source: /note="Description of Artificial Sequence: Synthetic peptide"
VPSFCMSGL

SEQ ID NO: 21806 - protein, 9 aa, Artificial Sequence
  source: /note="Description of Artificial Sequence: Synthetic peptide"
MSGLAKLTL

SEQ ID NO: 21807 - protein, 9 aa, Artificial Sequence
  source: /note="Description of Artificial Sequence: Synthetic peptide"
TLCKSGRSW

SEQ ID NO: 21808 - protein, 9 aa, Artificial Sequence
  source: /note="Description of Artificial Sequence: Synthetic peptide"
CKSGRSWPW

SEQ ID NO: 21809 - protein, 10 aa, Artificial Sequence
  source: /note="Description of Artificial Sequence: Synthetic peptide"
HLTLVFMATV

SEQ ID NO: 21810 - protein, 10 aa, Artificial Sequence
  source: /note="Description of Artificial Sequence: Synthetic peptide"
LTLVFMATVV

SEQ ID NO: 21811 - protein, 10 aa, Artificial Sequence
  source: /note="Description of Artificial Sequence: Synthetic peptide"
FMATVVPSFC

SEQ ID NO: 21812 - protein, 10 aa, Artificial Sequence
  source: /note="Description of Artificial Sequence: Synthetic peptide"
VVPSFCMSGL

SEQ ID NO: 21813 - protein, 10 aa, Artificial Sequence
  source: /note="Description of Artificial Sequence: Synthetic peptide"
CMSGLAKLTL

SEQ ID NO: 21814 - protein, 10 aa, Artificial Sequence
  source: /note="Description of Artificial Sequence: Synthetic peptide"
PSFCMSGLAK

SEQ ID NO: 21815 - protein, 10 aa, Artificial Sequence
  source: /note="Description of Artificial Sequence: Synthetic peptide"
SGLAKLTLCK

SEQ ID NO: 21816 - protein, 10 aa, Artificial Sequence
  source: /note="Description of Artificial Sequence: Synthetic peptide"
VFMATVVPSF

SEQ ID NO: 21817 - protein, 10 aa, Artificial Sequence
  source: /note="Description of Artificial Sequence: Synthetic peptide"
MATVVPSFCM

SEQ ID NO: 21818 - protein, 10 aa, Artificial Sequence
  source: /note="Description of Artificial Sequence: Synthetic peptide"
LTLCKSGRSW

SEQ ID NO: 21819 - protein, 9 aa, Artificial Sequence
  source: /note="Description of Artificial Sequence: Synthetic peptide"
CLSQIFFSL

SEQ ID NO: 21820 - protein, 9 aa, Artificial Sequence
  source: /note="Description of Artificial Sequence: Synthetic peptide"
SQIFFSLHL

SEQ ID NO: 21821 - protein, 9 aa, Artificial Sequence
  source: /note="Description of Artificial Sequence: Synthetic peptide"
SLHLDAWTI

SEQ ID NO: 21822 - protein, 9 aa, Artificial Sequence
  source: /note="Description of Artificial Sequence: Synthetic peptide"
FFSLHLDAW

SEQ ID NO: 21823 - protein, 9 aa, Artificial Sequence
  source: /note="Description of Artificial Sequence: Synthetic peptide"
LHLDAWTIY

SEQ ID NO: 21824 - protein, 10 aa, Artificial Sequence
  source: /note="Description of Artificial Sequence: Synthetic peptide"
FSLHLDAWTI

SEQ ID NO: 21825 - protein, 10 aa, Artificial Sequence
  source: /note="Description of Artificial Sequence: Synthetic peptide"
IFFSLHLDAW

SEQ ID NO: 21826 - protein, 10 aa, Artificial Sequence
  source: /note="Description of Artificial Sequence: Synthetic peptide"
SLHLDAWTIY

SEQ ID NO: 21827 - protein, 10 aa, Artificial Sequence
  source: /note="Description of Artificial Sequence: Synthetic peptide"
LSQIFFSLHL

SEQ ID NO: 21828 - protein, 9 aa, Artificial Sequence
  source: /note="Description of Artificial Sequence: Synthetic peptide"
MEIPHFFVI

SEQ ID NO: 21829 - protein, 9 aa, Artificial Sequence
  source: /note="Description of Artificial Sequence: Synthetic peptide"
EMEIPHFFV

SEQ ID NO: 21830 - protein, 9 aa, Artificial Sequence
  source: /note="Description of Artificial Sequence: Synthetic peptide"
IPHFFVIYL

SEQ ID NO: 21831 - protein, 10 aa, Artificial Sequence
  source: /note="Description of Artificial Sequence: Synthetic peptide"
MEIPHFFVIY

SEQ ID NO: 21832 - protein, 10 aa, Artificial Sequence
  source: /note="Description of Artificial Sequence: Synthetic peptide"
IPHFFVIYLK

SEQ ID NO: 21833 - protein, 10 aa, Artificial Sequence
  source: /note="Description of Artificial Sequence: Synthetic peptide"
TEMEIPHFFV

SEQ ID NO: 21834 - protein, 10 aa, Artificial Sequence
  source: /note="Description of Artificial Sequence: Synthetic peptide"
EMEIPHFFVI

SEQ ID NO: 21835 - protein, 10 aa, Artificial Sequence
  source: /note="Description of Artificial Sequence: Synthetic peptide"
EIPHFFVIYL

SEQ ID NO: 21836 - protein, 9 aa, Artificial Sequence
  source: /note="Description of Artificial Sequence: Synthetic peptide"
ILFFFFPQK

SEQ ID NO: 21837 - protein, 9 aa, Artificial Sequence
  source: /note="Description of Artificial Sequence: Synthetic peptide"
LFFFFPQKV

SEQ ID NO: 21838 - protein, 9 aa, Artificial Sequence
  source: /note="Description of Artificial Sequence: Synthetic peptide"
ATESHRCLR

SEQ ID NO: 21839 - protein, 9 aa, Artificial Sequence
  source: /note="Description of Artificial Sequence: Synthetic peptide"
GSRTAAGPR

SEQ ID NO: 21840 - protein, 9 aa, Artificial Sequence
  source: /note="Description of Artificial Sequence: Synthetic peptide"
RTAAGPRWA

SEQ ID NO: 21841 - protein, 9 aa, Artificial Sequence
  source: /note="Description of Artificial Sequence: Synthetic peptide"
TAAGPRWAV

SEQ ID NO: 21842 - protein, 9 aa, Artificial Sequence
  source: /note="Description of Artificial Sequence: Synthetic peptide"
TLRGSRTAA

SEQ ID NO: 21843 - protein, 9 aa, Artificial Sequence
  source: /note="Description of Artificial Sequence: Synthetic peptide"
RATESHRCL

SEQ ID NO: 21844 - protein, 9 aa, Artificial Sequence
  source: /note="Description of Artificial Sequence: Synthetic peptide"
LRIPPPGTL

SEQ ID NO: 21845 - protein, 9 aa, Artificial Sequence
  source: /note="Description of Artificial Sequence: Synthetic peptide"
FPQKVSELH

SEQ ID NO: 21846 - protein, 10 aa, Artificial Sequence
  source: /note="Description of Artificial Sequence: Synthetic peptide"
ILFFFFPQKV

SEQ ID NO: 21847 - protein, 10 aa, Artificial Sequence
  source: /note="Description of Artificial Sequence: Synthetic peptide"
RTAAGPRWAV

SEQ ID NO: 21848 - protein, 10 aa, Artificial Sequence
  source: /note="Description of Artificial Sequence: Synthetic peptide"
PILFFFFPQK

SEQ ID NO: 21849 - protein, 10 aa, Artificial Sequence
  source: /note="Description of Artificial Sequence: Synthetic peptide"
FFFPQKVSEL

SEQ ID NO: 21850 - protein, 10 aa, Artificial Sequence
  source: /note="Description of Artificial Sequence: Synthetic peptide"
RATESHRCLR

SEQ ID NO: 21851 - protein, 10 aa, Artificial Sequence
  source: /note="Description of Artificial Sequence: Synthetic peptide"
CLRIPPPGTL

SEQ ID NO: 21852 - protein, 10 aa, Artificial Sequence
  source: /note="Description of Artificial Sequence: Synthetic peptide"
GTLRGSRTAA

SEQ ID NO: 21853 - protein, 10 aa, Artificial Sequence
  source: /note="Description of Artificial Sequence: Synthetic peptide"
RGSRTAAGPR

SEQ ID NO: 21854 - protein, 10 aa, Artificial Sequence
  source: /note="Description of Artificial Sequence: Synthetic peptide"
ELHRATESHR

SEQ ID NO: 21855 - protein, 10 aa, Artificial Sequence
  source: /note="Description of Artificial Sequence: Synthetic peptide"
GPRWAVPVHV

SEQ ID NO: 21856 - protein, 10 aa, Artificial Sequence
  source: /note="Description of Artificial Sequence: Synthetic peptide"
EPAHHPGCQL

SEQ ID NO: 21857 - protein, 10 aa, Artificial Sequence
  source: /note="Description of Artificial Sequence: Synthetic peptide"
SELHRATESH

SEQ ID NO: 21858 - protein, 10 aa, Artificial Sequence
  source: /note="Description of Artificial Sequence: Synthetic peptide"
HRATESHRCL

SEQ ID NO: 21859 - protein, 10 aa, Artificial Sequence
  source: /note="Description of Artificial Sequence: Synthetic peptide"
GSRTAAGPRW

SEQ ID NO: 21860 - protein, 10 aa, Artificial Sequence
  source: /note="Description of Artificial Sequence: Synthetic peptide"
FPILFFFFPQ

SEQ ID NO: 21861 - protein, 9 aa, Artificial Sequence
  source: /note="Description of Artificial Sequence: Synthetic peptide"
ALKKMTMGR

SEQ ID NO: 21862 - protein, 9 aa, Artificial Sequence
  source: /note="Description of Artificial Sequence: Synthetic peptide"
KNALKKMTM

SEQ ID NO: 21863 - protein, 9 aa, Artificial Sequence
  source: /note="Description of Artificial Sequence: Synthetic peptide"
KKMTMGRQS

SEQ ID NO: 21864 - protein, 9 aa, Artificial Sequence
  source: /note="Description of Artificial Sequence: Synthetic peptide"
KMTMGRQSS

SEQ ID NO: 21865 - protein, 10 aa, Artificial Sequence
  source: /note="Description of Artificial Sequence: Synthetic peptide"
NALKKMTMGR

SEQ ID NO: 21866 - protein, 10 aa, Artificial Sequence
  source: /note="Description of Artificial Sequence: Synthetic peptide"
VKNALKKMTM

SEQ ID NO: 21867 - protein, 10 aa, Artificial Sequence
  source: /note="Description of Artificial Sequence: Synthetic peptide"
KKMTMGRQSS

SEQ ID NO: 21868 - protein, 9 aa, Artificial Sequence
  source: /note="Description of Artificial Sequence: Synthetic peptide"
VSMSRFHFY

SEQ ID NO: 21869 - protein, 9 aa, Artificial Sequence
  source: /note="Description of Artificial Sequence: Synthetic peptide"
VVSMSRFHF

SEQ ID NO: 21870 - protein, 9 aa, Artificial Sequence
  source: /note="Description of Artificial Sequence: Synthetic peptide"
MSRFHFYDS

SEQ ID NO: 21871 - protein, 9 aa, Artificial Sequence
  source: /note="Description of Artificial Sequence: Synthetic peptide"
RFHFYDSNV

SEQ ID NO: 21872 - protein, 9 aa, Artificial Sequence
  source: /note="Description of Artificial Sequence: Synthetic peptide"
VNVVSMSRF

SEQ ID NO: 21873 - protein, 9 aa, Artificial Sequence
  source: /note="Description of Artificial Sequence: Synthetic peptide"
FHFYDSNVI

SEQ ID NO: 21874 - protein, 10 aa, Artificial Sequence
  source: /note="Description of Artificial Sequence: Synthetic peptide"
VVSMSRFHFY

SEQ ID NO: 21875 - protein, 10 aa, Artificial Sequence
  source: /note="Description of Artificial Sequence: Synthetic peptide"
RFHFYDSNVI

SEQ ID NO: 21876 - protein, 10 aa, Artificial Sequence
  source: /note="Description of Artificial Sequence: Synthetic peptide"
MSRFHFYDSN

SEQ ID NO: 21877 - protein, 10 aa, Artificial Sequence
  source: /note="Description of Artificial Sequence: Synthetic peptide"
FVNVVSMSRF

SEQ ID NO: 21878 - protein, 10 aa, Artificial Sequence
  source: /note="Description of Artificial Sequence: Synthetic peptide"
NVVSMSRFHF

SEQ ID NO: 21879 - protein, 10 aa, Artificial Sequence
  source: /note="Description of Artificial Sequence: Synthetic peptide"
SRFHFYDSNV

SEQ ID NO: 21880 - protein, 10 aa, Artificial Sequence
  source: /note="Description of Artificial Sequence: Synthetic peptide"
FHFYDSNVIH

SEQ ID NO: 21881 - protein, 9 aa, Artificial Sequence
  source: /note="Description of Artificial Sequence: Synthetic peptide"
VVLPCIFSV

SEQ ID NO: 21882 - protein, 9 aa, Artificial Sequence
  source: /note="Description of Artificial Sequence: Synthetic peptide"
TAIVVLPCI

SEQ ID NO: 21883 - protein, 9 aa, Artificial Sequence
  source: /note="Description of Artificial Sequence: Synthetic peptide"
LPCIFSVSY

SEQ ID NO: 21884 - protein, 9 aa, Artificial Sequence
  source: /note="Description of Artificial Sequence: Synthetic peptide"
AIVVLPCIF

SEQ ID NO: 21885 - protein, 10 aa, Artificial Sequence
  source: /note="Description of Artificial Sequence: Synthetic peptide"
IVVLPCIFSV

SEQ ID NO: 21886 - protein, 10 aa, Artificial Sequence
  source: /note="Description of Artificial Sequence: Synthetic peptide"
VLPCIFSVSY

SEQ ID NO: 21887 - protein, 10 aa, Artificial Sequence
  source: /note="Description of Artificial Sequence: Synthetic peptide"
STAIVVLPCI

SEQ ID NO: 21888 - protein, 10 aa, Artificial Sequence
  source: /note="Description of Artificial Sequence: Synthetic peptide"
YGFSTAIVVL

SEQ ID NO: 21889 - protein, 10 aa, Artificial Sequence
  source: /note="Description of Artificial Sequence: Synthetic peptide"
TAIVVLPCIF

SEQ ID NO: 21890 - protein, 9 aa, Artificial Sequence
  source: /note="Description of Artificial Sequence: Synthetic peptide"
NSAGRQNAF

SEQ ID NO: 21891 - protein, 9 aa, Artificial Sequence
  source: /note="Description of Artificial Sequence: Synthetic peptide"
NAFSTCGAH

SEQ ID NO: 21892 - protein, 9 aa, Artificial Sequence
  source: /note="Description of Artificial Sequence: Synthetic peptide"
RQNAFSTCG

SEQ ID NO: 21893 - protein, 10 aa, Artificial Sequence
  source: /note="Description of Artificial Sequence: Synthetic peptide"
RMNSAGRQNA

SEQ ID NO: 21894 - protein, 10 aa, Artificial Sequence
  source: /note="Description of Artificial Sequence: Synthetic peptide"
RQNAFSTCGA

SEQ ID NO: 21895 - protein, 10 aa, Artificial Sequence
  source: /note="Description of Artificial Sequence: Synthetic peptide"
MNSAGRQNAF

SEQ ID NO: 21896 - protein, 10 aa, Artificial Sequence
  source: /note="Description of Artificial Sequence: Synthetic peptide"
NAFSTCGAHL

SEQ ID NO: 21897 - protein, 9 aa, Artificial Sequence
  source: /note="Description of Artificial Sequence: Synthetic peptide"
LVQVFFVFV

SEQ ID NO: 21898 - protein, 9 aa, Artificial Sequence
  source: /note="Description of Artificial Sequence: Synthetic peptide"
TISVEGCLV

SEQ ID NO: 21899 - protein, 9 aa, Artificial Sequence
  source: /note="Description of Artificial Sequence: Synthetic peptide"
CLVQVFFVF

SEQ ID NO: 21900 - protein, 9 aa, Artificial Sequence
  source: /note="Description of Artificial Sequence: Synthetic peptide"
VEGCLVQVF

SEQ ID NO: 21901 - protein, 9 aa, Artificial Sequence
  source: /note="Description of Artificial Sequence: Synthetic peptide"
VQVFFVFVT

SEQ ID NO: 21902 - protein, 10 aa, Artificial Sequence
  source: /note="Description of Artificial Sequence: Synthetic peptide"
CLVQVFFVFV

SEQ ID NO: 21903 - protein, 10 aa, Artificial Sequence
  source: /note="Description of Artificial Sequence: Synthetic peptide"
VQVFFVFVTA

SEQ ID NO: 21904 - protein, 10 aa, Artificial Sequence
  source: /note="Description of Artificial Sequence: Synthetic peptide"
KTISVEGCLV

SEQ ID NO: 21905 - protein, 10 aa, Artificial Sequence
  source: /note="Description of Artificial Sequence: Synthetic peptide"
GCLVQVFFVF

SEQ ID NO: 21906 - protein, 10 aa, Artificial Sequence
  source: /note="Description of Artificial Sequence: Synthetic peptide"
EGCLVQVFFV

SEQ ID NO: 21907 - protein, 10 aa, Artificial Sequence
  source: /note="Description of Artificial Sequence: Synthetic peptide"
SVEGCLVQVF

SEQ ID NO: 21908 - protein, 10 aa, Artificial Sequence
  source: /note="Description of Artificial Sequence: Synthetic peptide"
VEGCLVQVFF

SEQ ID NO: 21909 - protein, 9 aa, Artificial Sequence
  source: /note="Description of Artificial Sequence: Synthetic peptide"
FIFTLWNDK

SEQ ID NO: 21910 - protein, 9 aa, Artificial Sequence
  source: /note="Description of Artificial Sequence: Synthetic peptide"
FTLWNDKVK

SEQ ID NO: 21911 - protein, 9 aa, Artificial Sequence
  source: /note="Description of Artificial Sequence: Synthetic peptide"
LNPFIFTLW

SEQ ID NO: 21912 - protein, 10 aa, Artificial Sequence
  source: /note="Description of Artificial Sequence: Synthetic peptide"
FIFTLWNDKV

SEQ ID NO: 21913 - protein, 10 aa, Artificial Sequence
  source: /note="Description of Artificial Sequence: Synthetic peptide"
TLWNDKVKEA

SEQ ID NO: 21914 - protein, 10 aa, Artificial Sequence
  source: /note="Description of Artificial Sequence: Synthetic peptide"
FLNPFIFTLW

SEQ ID NO: 21915 - protein, 9 aa, Artificial Sequence
  source: /note="Description of Artificial Sequence: Synthetic peptide"
KTFSFNFCL

SEQ ID NO: 21916 - protein, 9 aa, Artificial Sequence
  source: /note="Description of Artificial Sequence: Synthetic peptide"
SFNFCLENI

SEQ ID NO: 21917 - protein, 9 aa, Artificial Sequence
  source: /note="Description of Artificial Sequence: Synthetic peptide"
FNFCLENII

SEQ ID NO: 21918 - protein, 9 aa, Artificial Sequence
  source: /note="Description of Artificial Sequence: Synthetic peptide"
LENIIDDFF

SEQ ID NO: 21919 - protein, 10 aa, Artificial Sequence
  source: /note="Description of Artificial Sequence: Synthetic peptide"
FSFNFCLENI

SEQ ID NO: 21920 - protein, 10 aa, Artificial Sequence
  source: /note="Description of Artificial Sequence: Synthetic peptide"
SFNFCLENII

SEQ ID NO: 21921 - protein, 10 aa, Artificial Sequence
  source: /note="Description of Artificial Sequence: Synthetic peptide"
KTFSFNFCLE

SEQ ID NO: 21922 - protein, 10 aa, Artificial Sequence
  source: /note="Description of Artificial Sequence: Synthetic peptide"
KKTFSFNFCL

SEQ ID NO: 21923 - protein, 9 aa, Artificial Sequence
  source: /note="Description of Artificial Sequence: Synthetic peptide"
RLRPDHRLM

SEQ ID NO: 21924 - protein, 9 aa, Artificial Sequence
  source: /note="Description of Artificial Sequence: Synthetic peptide"
DSRLRPDHR

SEQ ID NO: 21925 - protein, 10 aa, Artificial Sequence
  source: /note="Description of Artificial Sequence: Synthetic peptide"
RLRPDHRLME

SEQ ID NO: 21926 - protein, 10 aa, Artificial Sequence
  source: /note="Description of Artificial Sequence: Synthetic peptide"
SRLRPDHRLM

SEQ ID NO: 21927 - protein, 9 aa, Artificial Sequence
  source: /note="Description of Artificial Sequence: Synthetic peptide"
VLQAWLEPL

SEQ ID NO: 21928 - protein, 9 aa, Artificial Sequence
  source: /note="Description of Artificial Sequence: Synthetic peptide"
ALRVLQAWL

SEQ ID NO: 21929 - protein, 9 aa, Artificial Sequence
  source: /note="Description of Artificial Sequence: Synthetic peptide"
KIHLHHAAR

SEQ ID NO: 21930 - protein, 9 aa, Artificial Sequence
  source: /note="Description of Artificial Sequence: Synthetic peptide"
HAARCHPLR

SEQ ID NO: 21931 - protein, 9 aa, Artificial Sequence
  source: /note="Description of Artificial Sequence: Synthetic peptide"
AARCHPLRI

SEQ ID NO: 21932 - protein, 9 aa, Artificial Sequence
  source: /note="Description of Artificial Sequence: Synthetic peptide"
HLNCSQHHR

SEQ ID NO: 21933 - protein, 9 aa, Artificial Sequence
  source: /note="Description of Artificial Sequence: Synthetic peptide"
SQHHRGQAL

SEQ ID NO: 21934 - protein, 9 aa, Artificial Sequence
  source: /note="Description of Artificial Sequence: Synthetic peptide"
HHAARCHPL

SEQ ID NO: 21935 - protein, 9 aa, Artificial Sequence
  source: /note="Description of Artificial Sequence: Synthetic peptide"
EQVSHHPPL

SEQ ID NO: 21936 - protein, 9 aa, Artificial Sequence
  source: /note="Description of Artificial Sequence: Synthetic peptide"
CALRVLQAW

SEQ ID NO: 21937 - protein, 9 aa, Artificial Sequence
  source: /note="Description of Artificial Sequence: Synthetic peptide"
LQAWLEPLA

SEQ ID NO: 21938 - protein, 9 aa, Artificial Sequence
  source: /note="Description of Artificial Sequence: Synthetic peptide"
LQQVPGKIH

SEQ ID NO: 21939 - protein, 9 aa, Artificial Sequence
  source: /note="Description of Artificial Sequence: Synthetic peptide"
QQVPGKIHL

SEQ ID NO: 21940 - protein, 9 aa, Artificial Sequence
  source: /note="Description of Artificial Sequence: Synthetic peptide"
GKIHLHHAA

SEQ ID NO: 21941 - protein, 9 aa, Artificial Sequence
  source: /note="Description of Artificial Sequence: Synthetic peptide"
GQWESLRVE

SEQ ID NO: 21942 - protein, 9 aa, Artificial Sequence
  source: /note="Description of Artificial Sequence: Synthetic peptide"
EPLAGDHHL

SEQ ID NO: 21943 - protein, 9 aa, Artificial Sequence
  source: /note="Description of Artificial Sequence: Synthetic peptide"
HPLRIPGQW

SEQ ID NO: 21944 - protein, 10 aa, Artificial Sequence
  source: /note="Description of Artificial Sequence: Synthetic peptide"
RVLQAWLEPL

SEQ ID NO: 21945 - protein, 10 aa, Artificial Sequence
  source: /note="Description of Artificial Sequence: Synthetic peptide"
VLQAWLEPLA

SEQ ID NO: 21946 - protein, 10 aa, Artificial Sequence
  source: /note="Description of Artificial Sequence: Synthetic peptide"
KIHLHHAARC

SEQ ID NO: 21947 - protein, 10 aa, Artificial Sequence
  source: /note="Description of Artificial Sequence: Synthetic peptide"
HHAARCHPLR

SEQ ID NO: 21948 - protein, 10 aa, Artificial Sequence
  source: /note="Description of Artificial Sequence: Synthetic peptide"
CEQVSHHPPL

SEQ ID NO: 21949 - protein, 10 aa, Artificial Sequence
  source: /note="Description of Artificial Sequence: Synthetic peptide"
SHHPPLSCAL

SEQ ID NO: 21950 - protein, 10 aa, Artificial Sequence
  source: /note="Description of Artificial Sequence: Synthetic peptide"
LQAWLEPLAG

SEQ ID NO: 21951 - protein, 10 aa, Artificial Sequence
  source: /note="Description of Artificial Sequence: Synthetic peptide"
LQQVPGKIHL

SEQ ID NO: 21952 - protein, 10 aa, Artificial Sequence
  source: /note="Description of Artificial Sequence: Synthetic peptide"
QQVPGKIHLH

SEQ ID NO: 21953 - protein, 10 aa, Artificial Sequence
  source: /note="Description of Artificial Sequence: Synthetic peptide"
LHHAARCHPL

SEQ ID NO: 21954 - protein, 10 aa, Artificial Sequence
  source: /note="Description of Artificial Sequence: Synthetic peptide"
LRIPGQWESL

SEQ ID NO: 21955 - protein, 10 aa, Artificial Sequence
  source: /note="Description of Artificial Sequence: Synthetic peptide"
WESLRVEEEH

SEQ ID NO: 21956 - protein, 10 aa, Artificial Sequence
  source: /note="Description of Artificial Sequence: Synthetic peptide"
LEPLAGDHHL

SEQ ID NO: 21957 - protein, 10 aa, Artificial Sequence
  source: /note="Description of Artificial Sequence: Synthetic peptide"
HPPLSCALRV

SEQ ID NO: 21958 - protein, 10 aa, Artificial Sequence
  source: /note="Description of Artificial Sequence: Synthetic peptide"
IPGQWESLRV

SEQ ID NO: 21959 - protein, 9 aa, Artificial Sequence
  source: /note="Description of Artificial Sequence: Synthetic peptide"
FQNGRRACL

SEQ ID NO: 21960 - protein, 10 aa, Artificial Sequence
  source: /note="Description of Artificial Sequence: Synthetic peptide"
LTGGAFQNGR

SEQ ID NO: 21961 - protein, 9 aa, Artificial Sequence
  source: /note="Description of Artificial Sequence: Synthetic peptide"
RQFGIPMDR

SEQ ID NO: 21962 - protein, 9 aa, Artificial Sequence
  source: /note="Description of Artificial Sequence: Synthetic peptide"
PKRQFGIPM

SEQ ID NO: 21963 - protein, 10 aa, Artificial Sequence
  source: /note="Description of Artificial Sequence: Synthetic peptide"
RQFGIPMDRI

SEQ ID NO: 21964 - protein, 10 aa, Artificial Sequence
  source: /note="Description of Artificial Sequence: Synthetic peptide"
HPKRQFGIPM

SEQ ID NO: 21965 - protein, 10 aa, Artificial Sequence
  source: /note="Description of Artificial Sequence: Synthetic peptide"
KVVDHPKRQF

SEQ ID NO: 21966 - protein, 10 aa, Artificial Sequence
  source: /note="Description of Artificial Sequence: Synthetic peptide"
KGDNIKMPHK

SEQ ID NO: 21967 - protein, 10 aa, Artificial Sequence
  source: /note="Description of Artificial Sequence: Synthetic peptide"
KVDVAEEEKK

SEQ ID NO: 21968 - protein, 9 aa, Artificial Sequence
  source: /note="Description of Artificial Sequence: Synthetic peptide"
QASLLIILK

SEQ ID NO: 21969 - protein, 9 aa, Artificial Sequence
  source: /note="Description of Artificial Sequence: Synthetic peptide"
IDQASLLII

SEQ ID NO: 21970 - protein, 9 aa, Artificial Sequence
  source: /note="Description of Artificial Sequence: Synthetic peptide"
DQASLLIIL

SEQ ID NO: 21971 - protein, 10 aa, Artificial Sequence
  source: /note="Description of Artificial Sequence: Synthetic peptide"
QEIDQASLLI

SEQ ID NO: 21972 - protein, 10 aa, Artificial Sequence
  source: /note="Description of Artificial Sequence: Synthetic peptide"
IDQASLLIIL

SEQ ID NO: 21973 - protein, 9 aa, Artificial Sequence
  source: /note="Description of Artificial Sequence: Synthetic peptide"
MLLQMLWYV

SEQ ID NO: 21974 - protein, 9 aa, Artificial Sequence
  source: /note="Description of Artificial Sequence: Synthetic peptide"
LQMLWYVGR

SEQ ID NO: 21975 - protein, 9 aa, Artificial Sequence
  source: /note="Description of Artificial Sequence: Synthetic peptide"
LMLLQMLWY

SEQ ID NO: 21976 - protein, 9 aa, Artificial Sequence
  source: /note="Description of Artificial Sequence: Synthetic peptide"
LTALMLLQM

SEQ ID NO: 21977 - protein, 9 aa, Artificial Sequence
  source: /note="Description of Artificial Sequence: Synthetic peptide"
ALMLLQMLW

SEQ ID NO: 21978 - protein, 10 aa, Artificial Sequence
  source: /note="Description of Artificial Sequence: Synthetic peptide"
FLTALMLLQM

SEQ ID NO: 21979 - protein, 10 aa, Artificial Sequence
  source: /note="Description of Artificial Sequence: Synthetic peptide"
LMLLQMLWYV

SEQ ID NO: 21980 - protein, 10 aa, Artificial Sequence
  source: /note="Description of Artificial Sequence: Synthetic peptide"
ALMLLQMLWY

SEQ ID NO: 21981 - protein, 10 aa, Artificial Sequence
  source: /note="Description of Artificial Sequence: Synthetic peptide"
LLQMLWYVGR

SEQ ID NO: 21982 - protein, 10 aa, Artificial Sequence
  source: /note="Description of Artificial Sequence: Synthetic peptide"
TALMLLQMLW

SEQ ID NO: 21983 - protein, 10 aa, Artificial Sequence
  source: /note="Description of Artificial Sequence: Synthetic peptide"
RMNQGKINNA

SEQ ID NO: 21984 - protein, 10 aa, Artificial Sequence
  source: /note="Description of Artificial Sequence: Synthetic peptide"
GKINNAEENL

SEQ ID NO: 21985 - protein, 9 aa, Artificial Sequence
  source: /note="Description of Artificial Sequence: Synthetic peptide"
ILNREREIV

SEQ ID NO: 21986 - protein, 9 aa, Artificial Sequence
  source: /note="Description of Artificial Sequence: Synthetic peptide"
REREIVPVE

SEQ ID NO: 21987 - protein, 10 aa, Artificial Sequence
  source: /note="Description of Artificial Sequence: Synthetic peptide"
LNREREIVPV

SEQ ID NO: 21988 - protein, 10 aa, Artificial Sequence
  source: /note="Description of Artificial Sequence: Synthetic peptide"
TQILNREREI

SEQ ID NO: 21989 - protein, 10 aa, Artificial Sequence
  source: /note="Description of Artificial Sequence: Synthetic peptide"
REREIVPVEL

SEQ ID NO: 21990 - protein, 10 aa, Artificial Sequence
  source: /note="Description of Artificial Sequence: Synthetic peptide"
REIVPVELEP

SEQ ID NO: 21991 - protein, 9 aa, Artificial Sequence
  source: /note="Description of Artificial Sequence: Synthetic peptide"
KSKTAAAAD

SEQ ID NO: 21992 - protein, 10 aa, Artificial Sequence
  source: /note="Description of Artificial Sequence: Synthetic peptide"
KSKTAAAADV

SEQ ID NO: 21993 - protein, 10 aa, Artificial Sequence
  source: /note="Description of Artificial Sequence: Synthetic peptide"
TAAAADVNGF

SEQ ID NO: 21994 - protein, 9 aa, Artificial Sequence
  source: /note="Description of Artificial Sequence: Synthetic peptide"
RGRRSLGRS

SEQ ID NO: 21995 - protein, 9 aa, Artificial Sequence
  source: /note="Description of Artificial Sequence: Synthetic peptide"
SAGRGRRSL

SEQ ID NO: 21996 - protein, 10 aa, Artificial Sequence
  source: /note="Description of Artificial Sequence: Synthetic peptide"
AGRGRRSLGR

SEQ ID NO: 21997 - protein, 10 aa, Artificial Sequence
  source: /note="Description of Artificial Sequence: Synthetic peptide"
CPAATPGNSA

SEQ ID NO: 21998 - protein, 10 aa, Artificial Sequence
  source: /note="Description of Artificial Sequence: Synthetic peptide"
NSAGRGRRSL

SEQ ID NO: 21999 - protein, 9 aa, Artificial Sequence
  source: /note="Description of Artificial Sequence: Synthetic peptide"
KLVQLNKLF

SEQ ID NO: 22000 - protein, 10 aa, Artificial Sequence
  source: /note="Description of Artificial Sequence: Synthetic peptide"
ALKFDTTPNK

SEQ ID NO: 22001 - protein, 10 aa, Artificial Sequence
  source: /note="Description of Artificial Sequence: Synthetic peptide"
DTTPNKLVQL

SEQ ID NO: 22002 - protein, 10 aa, Artificial Sequence
  source: /note="Description of Artificial Sequence: Synthetic peptide"
LKFDTTPNKL

SEQ ID NO: 22003 - protein, 10 aa, Artificial Sequence
  source: /note="Description of Artificial Sequence: Synthetic peptide"
NKLVQLNKLF

SEQ ID NO: 22004 - protein, 9 aa, Artificial Sequence
  source: /note="Description of Artificial Sequence: Synthetic peptide"
FLFEYDTPA

SEQ ID NO: 22005 - protein, 9 aa, Artificial Sequence
  source: /note="Description of Artificial Sequence: Synthetic peptide"
DTPAWCWCV

SEQ ID NO: 22006 - protein, 9 aa, Artificial Sequence
  source: /note="Description of Artificial Sequence: Synthetic peptide"
TPAWCWCVI

SEQ ID NO: 22007 - protein, 9 aa, Artificial Sequence
  source: /note="Description of Artificial Sequence: Synthetic peptide"
WCVIRRWAL

SEQ ID NO: 22008 - protein, 10 aa, Artificial Sequence
  source: /note="Description of Artificial Sequence: Synthetic peptide"
FLFEYDTPAW

SEQ ID NO: 22009 - protein, 10 aa, Artificial Sequence
  source: /note="Description of Artificial Sequence: Synthetic peptide"
AWCWCVIRRW

SEQ ID NO: 22010 - protein, 10 aa, Artificial Sequence
  source: /note="Description of Artificial Sequence: Synthetic peptide"
CWCVIRRWAL

SEQ ID NO: 22011 - protein, 10 aa, Artificial Sequence
  source: /note="Description of Artificial Sequence: Synthetic peptide"
TPAWCWCVIR

SEQ ID NO: 22012 - protein, 10 aa, Artificial Sequence
  source: /note="Description of Artificial Sequence: Synthetic peptide"
DTPAWCWCVI

SEQ ID NO: 22013 - protein, 10 aa, Artificial Sequence
  source: /note="Description of Artificial Sequence: Synthetic peptide"
FEYDTPAWCW

SEQ ID NO: 22014 - protein, 9 aa, Artificial Sequence
  source: /note="Description of Artificial Sequence: Synthetic peptide"
WMDQQSKGI

SEQ ID NO: 22015 - protein, 9 aa, Artificial Sequence
  source: /note="Description of Artificial Sequence: Synthetic peptide"
KGWMDQQSK

SEQ ID NO: 22016 - protein, 9 aa, Artificial Sequence
  source: /note="Description of Artificial Sequence: Synthetic peptide"
YQPAPPSGF

SEQ ID NO: 22017 - protein, 9 aa, Artificial Sequence
  source: /note="Description of Artificial Sequence: Synthetic peptide"
QPAPPSGFF

SEQ ID NO: 22018 - protein, 10 aa, Artificial Sequence
  source: /note="Description of Artificial Sequence: Synthetic peptide"
PYQPAPPSGF

SEQ ID NO: 22019 - protein, 10 aa, Artificial Sequence
  source: /note="Description of Artificial Sequence: Synthetic peptide"
YQPAPPSGFF

SEQ ID NO: 22020 - protein, 10 aa, Artificial Sequence
  source: /note="Description of Artificial Sequence: Synthetic peptide"
QPAPPSGFFM

SEQ ID NO: 22021 - protein, 10 aa, Artificial Sequence
  source: /note="Description of Artificial Sequence: Synthetic peptide"
APPSGFFMAA

SEQ ID NO: 22022 - protein, 10 aa, Artificial Sequence
  source: /note="Description of Artificial Sequence: Synthetic peptide"
PPSGFFMAAI

SEQ ID NO: 22023 - protein, 9 aa, Artificial Sequence
  source: /note="Description of Artificial Sequence: Synthetic peptide"
SQRDPSLCK

SEQ ID NO: 22024 - protein, 9 aa, Artificial Sequence
  source: /note="Description of Artificial Sequence: Synthetic peptide"
CKSGVGNIF

SEQ ID NO: 22025 - protein, 10 aa, Artificial Sequence
  source: /note="Description of Artificial Sequence: Synthetic peptide"
SLCKSGVGNI

SEQ ID NO: 22026 - protein, 10 aa, Artificial Sequence
  source: /note="Description of Artificial Sequence: Synthetic peptide"
WSQRDPSLCK

SEQ ID NO: 22027 - protein, 10 aa, Artificial Sequence
  source: /note="Description of Artificial Sequence: Synthetic peptide"
LCKSGVGNIF

SEQ ID NO: 22028 - protein, 10 aa, Artificial Sequence
  source: /note="Description of Artificial Sequence: Synthetic peptide"
AERAIEKNEW

SEQ ID NO: 22029 - protein, 9 aa, Artificial Sequence
  source: /note="Description of Artificial Sequence: Synthetic peptide"
SRKERETEL

SEQ ID NO: 22030 - protein, 9 aa, Artificial Sequence
  source: /note="Description of Artificial Sequence: Synthetic peptide"
KERETELGA

SEQ ID NO: 22031 - protein, 9 aa, Artificial Sequence
  source: /note="Description of Artificial Sequence: Synthetic peptide"
RETELGARA

SEQ ID NO: 22032 - protein, 10 aa, Artificial Sequence
  source: /note="Description of Artificial Sequence: Synthetic peptide"
KSRKERETEL

SEQ ID NO: 22033 - protein, 10 aa, Artificial Sequence
  source: /note="Description of Artificial Sequence: Synthetic peptide"
TELGARAKEF

SEQ ID NO: 22034 - protein, 9 aa, Artificial Sequence
  source: /note="Description of Artificial Sequence: Synthetic peptide"
NLCWSSSEK

SEQ ID NO: 22035 - protein, 9 aa, Artificial Sequence
  source: /note="Description of Artificial Sequence: Synthetic peptide"
KTNLCWSSS

SEQ ID NO: 22036 - protein, 9 aa, Artificial Sequence
  source: /note="Description of Artificial Sequence: Synthetic peptide"
AQWKTNLCW

SEQ ID NO: 22037 - protein, 9 aa, Artificial Sequence
  source: /note="Description of Artificial Sequence: Synthetic peptide"
DEMNGNGAQ

SEQ ID NO: 22038 - protein, 10 aa, Artificial Sequence
  source: /note="Description of Artificial Sequence: Synthetic peptide"
TNLCWSSSEK

SEQ ID NO: 22039 - protein, 10 aa, Artificial Sequence
  source: /note="Description of Artificial Sequence: Synthetic peptide"
AQWKTNLCWS

SEQ ID NO: 22040 - protein, 10 aa, Artificial Sequence
  source: /note="Description of Artificial Sequence: Synthetic peptide"
DEMNGNGAQW

SEQ ID NO: 22041 - protein, 9 aa, Artificial Sequence
  source: /note="Description of Artificial Sequence: Synthetic peptide"
VLYVSPPQK

SEQ ID NO: 22042 - protein, 9 aa, Artificial Sequence
  source: /note="Description of Artificial Sequence: Synthetic peptide"
RSKGLVLYV

SEQ ID NO: 22043 - protein, 9 aa, Artificial Sequence
  source: /note="Description of Artificial Sequence: Synthetic peptide"
GRSKGLVLY

SEQ ID NO: 22044 - protein, 10 aa, Artificial Sequence
  source: /note="Description of Artificial Sequence: Synthetic peptide"
MMEGGRSKGL

SEQ ID NO: 22045 - protein, 10 aa, Artificial Sequence
  source: /note="Description of Artificial Sequence: Synthetic peptide"
LVLYVSPPQK

SEQ ID NO: 22046 - protein, 10 aa, Artificial Sequence
  source: /note="Description of Artificial Sequence: Synthetic peptide"
VLYVSPPQKK

SEQ ID NO: 22047 - protein, 10 aa, Artificial Sequence
  source: /note="Description of Artificial Sequence: Synthetic peptide"
RSKGLVLYVS

SEQ ID NO: 22048 - protein, 10 aa, Artificial Sequence
  source: /note="Description of Artificial Sequence: Synthetic peptide"
VSPPQKKPLK

SEQ ID NO: 22049 - protein, 10 aa, Artificial Sequence
  source: /note="Description of Artificial Sequence: Synthetic peptide"
GGRSKGLVLY

SEQ ID NO: 22050 - protein, 9 aa, Artificial Sequence
  source: /note="Description of Artificial Sequence: Synthetic peptide"
RVWFCMFLL

SEQ ID NO: 22051 - protein, 9 aa, Artificial Sequence
  source: /note="Description of Artificial Sequence: Synthetic peptide"
KVGRWSQQR

SEQ ID NO: 22052 - protein, 9 aa, Artificial Sequence
  source: /note="Description of Artificial Sequence: Synthetic peptide"
RWSQQRVWF

SEQ ID NO: 22053 - protein, 9 aa, Artificial Sequence
  source: /note="Description of Artificial Sequence: Synthetic peptide"
QQRVWFCMF

SEQ ID NO: 22054 - protein, 9 aa, Artificial Sequence
  source: /note="Description of Artificial Sequence: Synthetic peptide"
TITSAKVGR

SEQ ID NO: 22055 - protein, 9 aa, Artificial Sequence
  source: /note="Description of Artificial Sequence: Synthetic peptide"
WFCMFLLPR

SEQ ID NO: 22056 - protein, 9 aa, Artificial Sequence
  source: /note="Description of Artificial Sequence: Synthetic peptide"
GRWSQQRVW

SEQ ID NO: 22057 - protein, 9 aa, Artificial Sequence
  source: /note="Description of Artificial Sequence: Synthetic peptide"
SQQRVWFCM

SEQ ID NO: 22058 - protein, 10 aa, Artificial Sequence
  source: /note="Description of Artificial Sequence: Synthetic peptide"
GTITSAKVGR

SEQ ID NO: 22059 - protein, 10 aa, Artificial Sequence
  source: /note="Description of Artificial Sequence: Synthetic peptide"
VWFCMFLLPR

SEQ ID NO: 22060 - protein, 10 aa, Artificial Sequence
  source: /note="Description of Artificial Sequence: Synthetic peptide"
SQQRVWFCMF

SEQ ID NO: 22061 - protein, 10 aa, Artificial Sequence
  source: /note="Description of Artificial Sequence: Synthetic peptide"
KVGRWSQQRV

SEQ ID NO: 22062 - protein, 10 aa, Artificial Sequence
  source: /note="Description of Artificial Sequence: Synthetic peptide"
QQRVWFCMFL

SEQ ID NO: 22063 - protein, 10 aa, Artificial Sequence
  source: /note="Description of Artificial Sequence: Synthetic peptide"
WFCMFLLPRR

SEQ ID NO: 22064 - protein, 10 aa, Artificial Sequence
  source: /note="Description of Artificial Sequence: Synthetic peptide"
VGRWSQQRVW

SEQ ID NO: 22065 - protein, 10 aa, Artificial Sequence
  source: /note="Description of Artificial Sequence: Synthetic peptide"
GRWSQQRVWF

SEQ ID NO: 22066 - protein, 10 aa, Artificial Sequence
  source: /note="Description of Artificial Sequence: Synthetic peptide"
WSQQRVWFCM

SEQ ID NO: 22067 - protein, 10 aa, Artificial Sequence
  source: /note="Description of Artificial Sequence: Synthetic peptide"
CMFLLPRRSH

SEQ ID NO: 22068 - protein, 9 aa, Artificial Sequence
  source: /note="Description of Artificial Sequence: Synthetic peptide"
VLYVSPPQK

SEQ ID NO: 22069 - protein, 9 aa, Artificial Sequence
  source: /note="Description of Artificial Sequence: Synthetic peptide"
RSKGLVLYV

SEQ ID NO: 22070 - protein, 9 aa, Artificial Sequence
  source: /note="Description of Artificial Sequence: Synthetic peptide"
GRSKGLVLY

SEQ ID NO: 22071 - protein, 10 aa, Artificial Sequence
  source: /note="Description of Artificial Sequence: Synthetic peptide"
MMEGGRSKGL

SEQ ID NO: 22072 - protein, 10 aa, Artificial Sequence
  source: /note="Description of Artificial Sequence: Synthetic peptide"
LVLYVSPPQK

SEQ ID NO: 22073 - protein, 10 aa, Artificial Sequence
  source: /note="Description of Artificial Sequence: Synthetic peptide"
VLYVSPPQKK

SEQ ID NO: 22074 - protein, 10 aa, Artificial Sequence
  source: /note="Description of Artificial Sequence: Synthetic peptide"
RSKGLVLYVS

SEQ ID NO: 22075 - protein, 10 aa, Artificial Sequence
  source: /note="Description of Artificial Sequence: Synthetic peptide"
VSPPQKKPLK

SEQ ID NO: 22076 - protein, 10 aa, Artificial Sequence
  source: /note="Description of Artificial Sequence: Synthetic peptide"
GGRSKGLVLY

SEQ ID NO: 22077 - protein, 9 aa, Artificial Sequence
  source: /note="Description of Artificial Sequence: Synthetic peptide"
RGQPYATKW

SEQ ID NO: 22078 - protein, 9 aa, Artificial Sequence
  source: /note="Description of Artificial Sequence: Synthetic peptide"
INHTGDQSL

SEQ ID NO: 22079 - protein, 10 aa, Artificial Sequence
  source: /note="Description of Artificial Sequence: Synthetic peptide"
HTGDQSLPSK

SEQ ID NO: 22080 - protein, 9 aa, Artificial Sequence
  source: /note="Description of Artificial Sequence: Synthetic peptide"
GLFLPAIEI

SEQ ID NO: 22081 - protein, 9 aa, Artificial Sequence
  source: /note="Description of Artificial Sequence: Synthetic peptide"
FLPAIEISL

SEQ ID NO: 22082 - protein, 9 aa, Artificial Sequence
  source: /note="Description of Artificial Sequence: Synthetic peptide"
DQAGLFLPA

SEQ ID NO: 22083 - protein, 10 aa, Artificial Sequence
  source: /note="Description of Artificial Sequence: Synthetic peptide"
LFLPAIEISL

SEQ ID NO: 22084 - protein, 10 aa, Artificial Sequence
  source: /note="Description of Artificial Sequence: Synthetic peptide"
DQAGLFLPAI

SEQ ID NO: 22085 - protein, 10 aa, Artificial Sequence
  source: /note="Description of Artificial Sequence: Synthetic peptide"
LPAIEISLDV

SEQ ID NO: 22086 - protein, 10 aa, Artificial Sequence
  source: /note="Description of Artificial Sequence: Synthetic peptide"
IDQAGLFLPA

SEQ ID NO: 22087 - protein, 9 aa, Artificial Sequence
  source: /note="Description of Artificial Sequence: Synthetic peptide"
RLLRCGMSV

SEQ ID NO: 22088 - protein, 9 aa, Artificial Sequence
  source: /note="Description of Artificial Sequence: Synthetic peptide"
GMSVLACAL

SEQ ID NO: 22089 - protein, 9 aa, Artificial Sequence
  source: /note="Description of Artificial Sequence: Synthetic peptide"
LLRCGMSVL

SEQ ID NO: 22090 - protein, 9 aa, Artificial Sequence
  source: /note="Description of Artificial Sequence: Synthetic peptide"
SETKKVVNL

SEQ ID NO: 22091 - protein, 10 aa, Artificial Sequence
  source: /note="Description of Artificial Sequence: Synthetic peptide"
RLLRCGMSVL

SEQ ID NO: 22092 - protein, 10 aa, Artificial Sequence
  source: /note="Description of Artificial Sequence: Synthetic peptide"
LLRCGMSVLA

SEQ ID NO: 22093 - protein, 10 aa, Artificial Sequence
  source: /note="Description of Artificial Sequence: Synthetic peptide"
CGMSVLACAL

SEQ ID NO: 22094 - protein, 9 aa, Artificial Sequence
  source: /note="Description of Artificial Sequence: Synthetic peptide"
LKTLDLLHL

SEQ ID NO: 22095 - protein, 10 aa, Artificial Sequence
  source: /note="Description of Artificial Sequence: Synthetic peptide"
SELTTHDLKT

SEQ ID NO: 22096 - protein, 9 aa, Artificial Sequence
  source: /note="Description of Artificial Sequence: Synthetic peptide"
VTSRDTGIY

SEQ ID NO: 22097 - protein, 9 aa, Artificial Sequence
  source: /note="Description of Artificial Sequence: Synthetic peptide"
RDTGIYTCI

SEQ ID NO: 22098 - protein, 10 aa, Artificial Sequence
  source: /note="Description of Artificial Sequence: Synthetic peptide"
PVTSRDTGIY

SEQ ID NO: 22099 - protein, 9 aa, Artificial Sequence
  source: /note="Description of Artificial Sequence: Synthetic peptide"
EAEAEAAAF

SEQ ID NO: 22100 - protein, 9 aa, Artificial Sequence
  source: /note="Description of Artificial Sequence: Synthetic peptide"
VEEAEAEAA

SEQ ID NO: 22101 - protein, 9 aa, Artificial Sequence
  source: /note="Description of Artificial Sequence: Synthetic peptide"
AEAEAAAFG

SEQ ID NO: 22102 - protein, 10 aa, Artificial Sequence
  source: /note="Description of Artificial Sequence: Synthetic peptide"
EEAEAEAAAF

SEQ ID NO: 22103 - protein, 10 aa, Artificial Sequence
  source: /note="Description of Artificial Sequence: Synthetic peptide"
AEAEAAAFGS

SEQ ID NO: 22104 - protein, 10 aa, Artificial Sequence
  source: /note="Description of Artificial Sequence: Synthetic peptide"
VEEAEAEAAA

SEQ ID NO: 22105 - protein, 9 aa, Artificial Sequence
  source: /note="Description of Artificial Sequence: Synthetic peptide"
RERGPPPAT

SEQ ID NO: 22106 - protein, 10 aa, Artificial Sequence
  source: /note="Description of Artificial Sequence: Synthetic peptide"
ALRERGPPPA

SEQ ID NO: 22107 - protein, 10 aa, Artificial Sequence
  source: /note="Description of Artificial Sequence: Synthetic peptide"
RERGPPPATA

SEQ ID NO: 22108 - protein, 9 aa, Artificial Sequence
  source: /note="Description of Artificial Sequence: Synthetic peptide"
STAGPEANL

SEQ ID NO: 22109 - protein, 9 aa, Artificial Sequence
  source: /note="Description of Artificial Sequence: Synthetic peptide"
APSTAGPEA

SEQ ID NO: 22110 - protein, 9 aa, Artificial Sequence
  source: /note="Description of Artificial Sequence: Synthetic peptide"
GQQAQAPST

SEQ ID NO: 22111 - protein, 9 aa, Artificial Sequence
  source: /note="Description of Artificial Sequence: Synthetic peptide"
QQAQAPSTA

SEQ ID NO: 22112 - protein, 10 aa, Artificial Sequence
  source: /note="Description of Artificial Sequence: Synthetic peptide"
GQQAQAPSTA

SEQ ID NO: 22113 - protein, 10 aa, Artificial Sequence
  source: /note="Description of Artificial Sequence: Synthetic peptide"
QQAQAPSTAG

SEQ ID NO: 22114 - protein, 9 aa, Artificial Sequence
  source: /note="Description of Artificial Sequence: Synthetic peptide"
WGVPWMTSM

SEQ ID NO: 22115 - protein, 9 aa, Artificial Sequence
  source: /note="Description of Artificial Sequence: Synthetic peptide"
RNGSWGVPW

SEQ ID NO: 22116 - protein, 10 aa, Artificial Sequence
  source: /note="Description of Artificial Sequence: Synthetic peptide"
KSCRNGSWGV

SEQ ID NO: 22117 - protein, 10 aa, Artificial Sequence
  source: /note="Description of Artificial Sequence: Synthetic peptide"
CRNGSWGVPW

SEQ ID NO: 22118 - protein, 10 aa, Artificial Sequence
  source: /note="Description of Artificial Sequence: Synthetic peptide"
RNGSWGVPWM

SEQ ID NO: 22119 - protein, 10 aa, Artificial Sequence
  source: /note="Description of Artificial Sequence: Synthetic peptide"
SWGVPWMTSM

SEQ ID NO: 22120 - protein, 9 aa, Artificial Sequence
  source: /note="Description of Artificial Sequence: Synthetic peptide"
TLCCWLTWA

SEQ ID NO: 22121 - protein, 9 aa, Artificial Sequence
  source: /note="Description of Artificial Sequence: Synthetic peptide"
WLTWAQVSA

SEQ ID NO: 22122 - protein, 9 aa, Artificial Sequence
  source: /note="Description of Artificial Sequence: Synthetic peptide"
RTALITHTL

SEQ ID NO: 22123 - protein, 9 aa, Artificial Sequence
  source: /note="Description of Artificial Sequence: Synthetic peptide"
HTLCCWLTW

SEQ ID NO: 22124 - protein, 9 aa, Artificial Sequence
  source: /note="Description of Artificial Sequence: Synthetic peptide"
CQKSRTALI

SEQ ID NO: 22125 - protein, 9 aa, Artificial Sequence
  source: /note="Description of Artificial Sequence: Synthetic peptide"
KSRTALITH

SEQ ID NO: 22126 - protein, 9 aa, Artificial Sequence
  source: /note="Description of Artificial Sequence: Synthetic peptide"
LTWAQVSAF

SEQ ID NO: 22127 - protein, 9 aa, Artificial Sequence
  source: /note="Description of Artificial Sequence: Synthetic peptide"
LCQKSRTAL

SEQ ID NO: 22128 - protein, 10 aa, Artificial Sequence
  source: /note="Description of Artificial Sequence: Synthetic peptide"
LITHTLCCWL

SEQ ID NO: 22129 - protein, 10 aa, Artificial Sequence
  source: /note="Description of Artificial Sequence: Synthetic peptide"
KSRTALITHT

SEQ ID NO: 22130 - protein, 10 aa, Artificial Sequence
  source: /note="Description of Artificial Sequence: Synthetic peptide"
HTLCCWLTWA

SEQ ID NO: 22131 - protein, 10 aa, Artificial Sequence
  source: /note="Description of Artificial Sequence: Synthetic peptide"
ELCQKSRTAL

SEQ ID NO: 22132 - protein, 10 aa, Artificial Sequence
  source: /note="Description of Artificial Sequence: Synthetic peptide"
WLTWAQVSAF

SEQ ID NO: 22133 - protein, 10 aa, Artificial Sequence
  source: /note="Description of Artificial Sequence: Synthetic peptide"
SRTALITHTL

SEQ ID NO: 22134 - protein, 10 aa, Artificial Sequence
  source: /note="Description of Artificial Sequence: Synthetic peptide"
ALITHTLCCW

SEQ ID NO: 22135 - protein, 9 aa, Artificial Sequence
  source: /note="Description of Artificial Sequence: Synthetic peptide"
SLGGGTFLV

SEQ ID NO: 22136 - protein, 9 aa, Artificial Sequence
  source: /note="Description of Artificial Sequence: Synthetic peptide"
FLVSAVFLL

SEQ ID NO: 22137 - protein, 9 aa, Artificial Sequence
  source: /note="Description of Artificial Sequence: Synthetic peptide"
AVFLLAVPL

SEQ ID NO: 22138 - protein, 9 aa, Artificial Sequence
  source: /note="Description of Artificial Sequence: Synthetic peptide"
LLKWHLVEI

SEQ ID NO: 22139 - protein, 9 aa, Artificial Sequence
  source: /note="Description of Artificial Sequence: Synthetic peptide"
LVSAVFLLA

SEQ ID NO: 22140 - protein, 9 aa, Artificial Sequence
  source: /note="Description of Artificial Sequence: Synthetic peptide"
FLLAVPLLK

SEQ ID NO: 22141 - protein, 9 aa, Artificial Sequence
  source: /note="Description of Artificial Sequence: Synthetic peptide"
LLAVPLLKK

SEQ ID NO: 22142 - protein, 9 aa, Artificial Sequence
  source: /note="Description of Artificial Sequence: Synthetic peptide"
TFLVSAVFL

SEQ ID NO: 22143 - protein, 9 aa, Artificial Sequence
  source: /note="Description of Artificial Sequence: Synthetic peptide"
VFLLAVPLL

SEQ ID NO: 22144 - protein, 9 aa, Artificial Sequence
  source: /note="Description of Artificial Sequence: Synthetic peptide"
GTFLVSAVF

SEQ ID NO: 22145 - protein, 9 aa, Artificial Sequence
  source: /note="Description of Artificial Sequence: Synthetic peptide"
VSAVFLLAV

SEQ ID NO: 22146 - protein, 9 aa, Artificial Sequence
  source: /note="Description of Artificial Sequence: Synthetic peptide"
LKWHLVEIA

SEQ ID NO: 22147 - protein, 9 aa, Artificial Sequence
  source: /note="Description of Artificial Sequence: Synthetic peptide"
HLVEIAPKW

SEQ ID NO: 22148 - protein, 10 aa, Artificial Sequence
  source: /note="Description of Artificial Sequence: Synthetic peptide"
FLVSAVFLLA

SEQ ID NO: 22149 - protein, 10 aa, Artificial Sequence
  source: /note="Description of Artificial Sequence: Synthetic peptide"
LVSAVFLLAV

SEQ ID NO: 22150 - protein, 10 aa, Artificial Sequence
  source: /note="Description of Artificial Sequence: Synthetic peptide"
AVFLLAVPLL

SEQ ID NO: 22151 - protein, 10 aa, Artificial Sequence
  source: /note="Description of Artificial Sequence: Synthetic peptide"
LLAVPLLKKL

SEQ ID NO: 22152 - protein, 10 aa, Artificial Sequence
  source: /note="Description of Artificial Sequence: Synthetic peptide"
KLLKWHLVEI

SEQ ID NO: 22153 - protein, 10 aa, Artificial Sequence
  source: /note="Description of Artificial Sequence: Synthetic peptide"
LLKKLLKWHL

SEQ ID NO: 22154 - protein, 10 aa, Artificial Sequence
  source: /note="Description of Artificial Sequence: Synthetic peptide"
LLKWHLVEIA

SEQ ID NO: 22155 - protein, 10 aa, Artificial Sequence
  source: /note="Description of Artificial Sequence: Synthetic peptide"
HLVEIAPKWI

SEQ ID NO: 22156 - protein, 10 aa, Artificial Sequence
  source: /note="Description of Artificial Sequence: Synthetic peptide"
FLLAVPLLKK

SEQ ID NO: 22157 - protein, 10 aa, Artificial Sequence
  source: /note="Description of Artificial Sequence: Synthetic peptide"
VFLLAVPLLK

SEQ ID NO: 22158 - protein, 10 aa, Artificial Sequence
  source: /note="Description of Artificial Sequence: Synthetic peptide"
AVPLLKKLLK

SEQ ID NO: 22159 - protein, 10 aa, Artificial Sequence
  source: /note="Description of Artificial Sequence: Synthetic peptide"
TFLVSAVFLL

SEQ ID NO: 22160 - protein, 10 aa, Artificial Sequence
  source: /note="Description of Artificial Sequence: Synthetic peptide"
GTFLVSAVFL

SEQ ID NO: 22161 - protein, 10 aa, Artificial Sequence
  source: /note="Description of Artificial Sequence: Synthetic peptide"
KWHLVEIAPK

SEQ ID NO: 22162 - protein, 10 aa, Artificial Sequence
  source: /note="Description of Artificial Sequence: Synthetic peptide"
TSLGGGTFLV

SEQ ID NO: 22163 - protein, 10 aa, Artificial Sequence
  source: /note="Description of Artificial Sequence: Synthetic peptide"
SAVFLLAVPL

SEQ ID NO: 22164 - protein, 10 aa, Artificial Sequence
  source: /note="Description of Artificial Sequence: Synthetic peptide"
GGTFLVSAVF

SEQ ID NO: 22165 - protein, 10 aa, Artificial Sequence
  source: /note="Description of Artificial Sequence: Synthetic peptide"
VPLLKKLLKW

SEQ ID NO: 22166 - protein, 9 aa, Artificial Sequence
  source: /note="Description of Artificial Sequence: Synthetic peptide"
LLRMGAGRL

SEQ ID NO: 22167 - protein, 9 aa, Artificial Sequence
  source: /note="Description of Artificial Sequence: Synthetic peptide"
RMGAGRLGA

SEQ ID NO: 22168 - protein, 9 aa, Artificial Sequence
  source: /note="Description of Artificial Sequence: Synthetic peptide"
LLLRMGAGR

SEQ ID NO: 22169 - protein, 9 aa, Artificial Sequence
  source: /note="Description of Artificial Sequence: Synthetic peptide"
GAGRLGAPM

SEQ ID NO: 22170 - protein, 10 aa, Artificial Sequence
  source: /note="Description of Artificial Sequence: Synthetic peptide"
RQRLLLRMGA

SEQ ID NO: 22171 - protein, 10 aa, Artificial Sequence
  source: /note="Description of Artificial Sequence: Synthetic peptide"
RLLLRMGAGR

SEQ ID NO: 22172 - protein, 10 aa, Artificial Sequence
  source: /note="Description of Artificial Sequence: Synthetic peptide"
AGRLGAPMER

SEQ ID NO: 22173 - protein, 10 aa, Artificial Sequence
  source: /note="Description of Artificial Sequence: Synthetic peptide"
MGAGRLGAPM

SEQ ID NO: 22174 - protein, 10 aa, Artificial Sequence
  source: /note="Description of Artificial Sequence: Synthetic peptide"
LRMGAGRLGA

SEQ ID NO: 22175 - protein, 9 aa, Artificial Sequence
  source: /note="Description of Artificial Sequence: Synthetic peptide"
IYGGDYEIF

SEQ ID NO: 22176 - protein, 9 aa, Artificial Sequence
  source: /note="Description of Artificial Sequence: Synthetic peptide"
IFGLPGWAV

SEQ ID NO: 22177 - protein, 9 aa, Artificial Sequence
  source: /note="Description of Artificial Sequence: Synthetic peptide"
DIYGGDYEI

SEQ ID NO: 22178 - protein, 9 aa, Artificial Sequence
  source: /note="Description of Artificial Sequence: Synthetic peptide"
EIFGLPGWA

SEQ ID NO: 22179 - protein, 9 aa, Artificial Sequence
  source: /note="Description of Artificial Sequence: Synthetic peptide"
YEIFGLPGW

SEQ ID NO: 22180 - protein, 10 aa, Artificial Sequence
  source: /note="Description of Artificial Sequence: Synthetic peptide"
EIFGLPGWAV

SEQ ID NO: 22181 - protein, 10 aa, Artificial Sequence
  source: /note="Description of Artificial Sequence: Synthetic peptide"
DIYGGDYEIF

SEQ ID NO: 22182 - protein, 10 aa, Artificial Sequence
  source: /note="Description of Artificial Sequence: Synthetic peptide"
RDIYGGDYEI

SEQ ID NO: 22183 - protein, 10 aa, Artificial Sequence
  source: /note="Description of Artificial Sequence: Synthetic peptide"
YEIFGLPGWA

SEQ ID NO: 22184 - protein, 9 aa, Artificial Sequence
  source: /note="Description of Artificial Sequence: Synthetic peptide"
QLVETGGYV

SEQ ID NO: 22185 - protein, 9 aa, Artificial Sequence
  source: /note="Description of Artificial Sequence: Synthetic peptide"
NQLVETGGY

SEQ ID NO: 22186 - protein, 9 aa, Artificial Sequence
  source: /note="Description of Artificial Sequence: Synthetic peptide"
YVGLPSVSY

SEQ ID NO: 22187 - protein, 9 aa, Artificial Sequence
  source: /note="Description of Artificial Sequence: Synthetic peptide"
VETGGYVGL

SEQ ID NO: 22188 - protein, 10 aa, Artificial Sequence
  source: /note="Description of Artificial Sequence: Synthetic peptide"
YVGLPSVSYA

SEQ ID NO: 22189 - protein, 10 aa, Artificial Sequence
  source: /note="Description of Artificial Sequence: Synthetic peptide"
GYVGLPSVSY

SEQ ID NO: 22190 - protein, 9 aa, Artificial Sequence
  source: /note="Description of Artificial Sequence: Synthetic peptide"
KEEPCFFSG

SEQ ID NO: 22191 - protein, 9 aa, Artificial Sequence
  source: /note="Description of Artificial Sequence: Synthetic peptide"
EEAVGTPDV

SEQ ID NO: 22192 - protein, 9 aa, Artificial Sequence
  source: /note="Description of Artificial Sequence: Synthetic peptide"
SPLCVIPPV

SEQ ID NO: 22193 - protein, 10 aa, Artificial Sequence
  source: /note="Description of Artificial Sequence: Synthetic peptide"
CSPLCVIPPV

SEQ ID NO: 22194 - protein, 9 aa, Artificial Sequence
  source: /note="Description of Artificial Sequence: Synthetic peptide"
TLEHWMEHV

SEQ ID NO: 22195 - protein, 9 aa, Artificial Sequence
  source: /note="Description of Artificial Sequence: Synthetic peptide"
MEHVKVQSI

SEQ ID NO: 22196 - protein, 10 aa, Artificial Sequence
  source: /note="Description of Artificial Sequence: Synthetic peptide"
WMEHVKVQSI

SEQ ID NO: 22197 - protein, 10 aa, Artificial Sequence
  source: /note="Description of Artificial Sequence: Synthetic peptide"
TLEHWMEHVK

SEQ ID NO: 22198 - protein, 10 aa, Artificial Sequence
  source: /note="Description of Artificial Sequence: Synthetic peptide"
DTLEHWMEHV

SEQ ID NO: 22199 - protein, 10 aa, Artificial Sequence
  source: /note="Description of Artificial Sequence: Synthetic peptide"
MEHVKVQSIV

SEQ ID NO: 22200 - protein, 10 aa, Artificial Sequence
  source: /note="Description of Artificial Sequence: Synthetic peptide"
LEHWMEHVKV

SEQ ID NO: 22201 - protein, 9 aa, Artificial Sequence
  source: /note="Description of Artificial Sequence: Synthetic peptide"
ALASGPPAT

SEQ ID NO: 22202 - protein, 9 aa, Artificial Sequence
  source: /note="Description of Artificial Sequence: Synthetic peptide"
RALASGPPA

SEQ ID NO: 22203 - protein, 10 aa, Artificial Sequence
  source: /note="Description of Artificial Sequence: Synthetic peptide"
ALASGPPATA

SEQ ID NO: 22204 - protein, 10 aa, Artificial Sequence
  source: /note="Description of Artificial Sequence: Synthetic peptide"
RALASGPPAT

SEQ ID NO: 22205 - protein, 10 aa, Artificial Sequence
  source: /note="Description of Artificial Sequence: Synthetic peptide"
HRALASGPPA

SEQ ID NO: 22206 - protein, 9 aa, Artificial Sequence
  source: /note="Description of Artificial Sequence: Synthetic peptide"
EETEAQHLY

SEQ ID NO: 22207 - protein, 9 aa, Artificial Sequence
  source: /note="Description of Artificial Sequence: Synthetic peptide"
LEETEAQHL

SEQ ID NO: 22208 - protein, 9 aa, Artificial Sequence
  source: /note="Description of Artificial Sequence: Synthetic peptide"
TEAQHLYQS

SEQ ID NO: 22209 - protein, 10 aa, Artificial Sequence
  source: /note="Description of Artificial Sequence: Synthetic peptide"
LEETEAQHLY

SEQ ID NO: 22210 - protein, 10 aa, Artificial Sequence
  source: /note="Description of Artificial Sequence: Synthetic peptide"
TEAQHLYQSI

SEQ ID NO: 22211 - protein, 9 aa, Artificial Sequence
  source: /note="Description of Artificial Sequence: Synthetic peptide"
SMKKETSLH

SEQ ID NO: 22212 - protein, 9 aa, Artificial Sequence
  source: /note="Description of Artificial Sequence: Synthetic peptide"
DSMKKETSL

SEQ ID NO: 22213 - protein, 9 aa, Artificial Sequence
  source: /note="Description of Artificial Sequence: Synthetic peptide"
MKKETSLHH

SEQ ID NO: 22214 - protein, 10 aa, Artificial Sequence
  source: /note="Description of Artificial Sequence: Synthetic peptide"
SMKKETSLHH

SEQ ID NO: 22215 - protein, 9 aa, Artificial Sequence
  source: /note="Description of Artificial Sequence: Synthetic peptide"
RMWVENIQK

SEQ ID NO: 22216 - protein, 9 aa, Artificial Sequence
  source: /note="Description of Artificial Sequence: Synthetic peptide"
IQKKKARLA

SEQ ID NO: 22217 - protein, 9 aa, Artificial Sequence
  source: /note="Description of Artificial Sequence: Synthetic peptide"
KARLACLSF

SEQ ID NO: 22218 - protein, 9 aa, Artificial Sequence
  source: /note="Description of Artificial Sequence: Synthetic peptide"
LPRMWVENI

SEQ ID NO: 22219 - protein, 9 aa, Artificial Sequence
  source: /note="Description of Artificial Sequence: Synthetic peptide"
NPISMSTSL

SEQ ID NO: 22220 - protein, 9 aa, Artificial Sequence
  source: /note="Description of Artificial Sequence: Synthetic peptide"
NIQKKKARL

SEQ ID NO: 22221 - protein, 9 aa, Artificial Sequence
  source: /note="Description of Artificial Sequence: Synthetic peptide"
KKKARLACL

SEQ ID NO: 22222 - protein, 9 aa, Artificial Sequence
  source: /note="Description of Artificial Sequence: Synthetic peptide"
LACLSFNPI

SEQ ID NO: 22223 - protein, 9 aa, Artificial Sequence
  source: /note="Description of Artificial Sequence: Synthetic peptide"
CLSFNPISM

SEQ ID NO: 22224 - protein, 10 aa, Artificial Sequence
  source: /note="Description of Artificial Sequence: Synthetic peptide"
YLPRMWVENI

SEQ ID NO: 22225 - protein, 10 aa, Artificial Sequence
  source: /note="Description of Artificial Sequence: Synthetic peptide"
RLACLSFNPI

SEQ ID NO: 22226 - protein, 10 aa, Artificial Sequence
  source: /note="Description of Artificial Sequence: Synthetic peptide"
RMWVENIQKK

SEQ ID NO: 22227 - protein, 10 aa, Artificial Sequence
  source: /note="Description of Artificial Sequence: Synthetic peptide"
KARLACLSFN

SEQ ID NO: 22228 - protein, 10 aa, Artificial Sequence
  source: /note="Description of Artificial Sequence: Synthetic peptide"
KKARLACLSF

SEQ ID NO: 22229 - protein, 10 aa, Artificial Sequence
  source: /note="Description of Artificial Sequence: Synthetic peptide"
ACLSFNPISM

SEQ ID NO: 22230 - protein, 10 aa, Artificial Sequence
  source: /note="Description of Artificial Sequence: Synthetic peptide"
EPAAAAAAAI

SEQ ID NO: 22231 - protein, 9 aa, Artificial Sequence
  source: /note="Description of Artificial Sequence: Synthetic peptide"
RLCQSRIAL

SEQ ID NO: 22232 - protein, 9 aa, Artificial Sequence
  source: /note="Description of Artificial Sequence: Synthetic peptide"
LSRLCQSRI

SEQ ID NO: 22233 - protein, 10 aa, Artificial Sequence
  source: /note="Description of Artificial Sequence: Synthetic peptide"
GLSRLCQSRI

SEQ ID NO: 22234 - protein, 10 aa, Artificial Sequence
  source: /note="Description of Artificial Sequence: Synthetic peptide"
LSRLCQSRIA

SEQ ID NO: 22235 - protein, 10 aa, Artificial Sequence
  source: /note="Description of Artificial Sequence: Synthetic peptide"
SRLCQSRIAL

SEQ ID NO: 22236 - protein, 9 aa, Artificial Sequence
  source: /note="Description of Artificial Sequence: Synthetic peptide"
PVRPCRCCR

SEQ ID NO: 22237 - protein, 9 aa, Artificial Sequence
  source: /note="Description of Artificial Sequence: Synthetic peptide"
MPPPVRPCR

SEQ ID NO: 22238 - protein, 9 aa, Artificial Sequence
  source: /note="Description of Artificial Sequence: Synthetic peptide"
RPCRCCRCL

SEQ ID NO: 22239 - protein, 10 aa, Artificial Sequence
  source: /note="Description of Artificial Sequence: Synthetic peptide"
LLMPPPVRPC

SEQ ID NO: 22240 - protein, 10 aa, Artificial Sequence
  source: /note="Description of Artificial Sequence: Synthetic peptide"
LMPPPVRPCR

SEQ ID NO: 22241 - protein, 10 aa, Artificial Sequence
  source: /note="Description of Artificial Sequence: Synthetic peptide"
NPALLMPPPV

SEQ ID NO: 22242 - protein, 9 aa, Artificial Sequence
  source: /note="Description of Artificial Sequence: Synthetic peptide"
MVSASCSQR

SEQ ID NO: 22243 - protein, 9 aa, Artificial Sequence
  source: /note="Description of Artificial Sequence: Synthetic peptide"
LEPTTMVSA

SEQ ID NO: 22244 - protein, 10 aa, Artificial Sequence
  source: /note="Description of Artificial Sequence: Synthetic peptide"
MVSASCSQRL

SEQ ID NO: 22245 - protein, 10 aa, Artificial Sequence
  source: /note="Description of Artificial Sequence: Synthetic peptide"
TMVSASCSQR

SEQ ID NO: 22246 - protein, 9 aa, Artificial Sequence
  source: /note="Description of Artificial Sequence: Synthetic peptide"
SERALAPQS

SEQ ID NO: 22247 - protein, 9 aa, Artificial Sequence
  source: /note="Description of Artificial Sequence: Synthetic peptide"
RSYDTYTPH

SEQ ID NO: 22248 - protein, 9 aa, Artificial Sequence
  source: /note="Description of Artificial Sequence: Synthetic peptide"
SYDTYTPHI

SEQ ID NO: 22249 - protein, 9 aa, Artificial Sequence
  source: /note="Description of Artificial Sequence: Synthetic peptide"
DTYTPHICR

SEQ ID NO: 22250 - protein, 10 aa, Artificial Sequence
  source: /note="Description of Artificial Sequence: Synthetic peptide"
RSYDTYTPHI

SEQ ID NO: 22251 - protein, 9 aa, Artificial Sequence
  source: /note="Description of Artificial Sequence: Synthetic peptide"
KLHQTDNFA

SEQ ID NO: 22252 - protein, 9 aa, Artificial Sequence
  source: /note="Description of Artificial Sequence: Synthetic peptide"
RKLHQTDNF

SEQ ID NO: 22253 - protein, 10 aa, Artificial Sequence
  source: /note="Description of Artificial Sequence: Synthetic peptide"
IRKLHQTDNF

SEQ ID NO: 22254 - protein, 10 aa, Artificial Sequence
  source: /note="Description of Artificial Sequence: Synthetic peptide"
HQTDNFAQSS

SEQ ID NO: 22255 - protein, 9 aa, Artificial Sequence
  source: /note="Description of Artificial Sequence: Synthetic peptide"
TITDQSLDK

SEQ ID NO: 22256 - protein, 9 aa, Artificial Sequence
  source: /note="Description of Artificial Sequence: Synthetic peptide"
QSLDKAQAK

SEQ ID NO: 22257 - protein, 9 aa, Artificial Sequence
  source: /note="Description of Artificial Sequence: Synthetic peptide"
SLDKAQAKK

SEQ ID NO: 22258 - protein, 9 aa, Artificial Sequence
  source: /note="Description of Artificial Sequence: Synthetic peptide"
KAQAKKHAL

SEQ ID NO: 22259 - protein, 10 aa, Artificial Sequence
  source: /note="Description of Artificial Sequence: Synthetic peptide"
MTITDQSLDK

SEQ ID NO: 22260 - protein, 10 aa, Artificial Sequence
  source: /note="Description of Artificial Sequence: Synthetic peptide"
QSLDKAQAKK

SEQ ID NO: 22261 - protein, 9 aa, Artificial Sequence
  source: /note="Description of Artificial Sequence: Synthetic peptide"
QATEVLNEF

SEQ ID NO: 22262 - protein, 9 aa, Artificial Sequence
  source: /note="Description of Artificial Sequence: Synthetic peptide"
TEVLNEFFY

SEQ ID NO: 22263 - protein, 9 aa, Artificial Sequence
  source: /note="Description of Artificial Sequence: Synthetic peptide"
NEFFYSHLS

SEQ ID NO: 22264 - protein, 10 aa, Artificial Sequence
  source: /note="Description of Artificial Sequence: Synthetic peptide"
ATEVLNEFFY

SEQ ID NO: 22265 - protein, 10 aa, Artificial Sequence
  source: /note="Description of Artificial Sequence: Synthetic peptide"
VLNEFFYSHL

SEQ ID NO: 22266 - protein, 10 aa, Artificial Sequence
  source: /note="Description of Artificial Sequence: Synthetic peptide"
KQATEVLNEF

SEQ ID NO: 22267 - protein, 10 aa, Artificial Sequence
  source: /note="Description of Artificial Sequence: Synthetic peptide"
FFYSHLSNPY

SEQ ID NO: 22268 - protein, 10 aa, Artificial Sequence
  source: /note="Description of Artificial Sequence: Synthetic peptide"
NEFFYSHLSN

SEQ ID NO: 22269 - protein, 9 aa, Artificial Sequence
  source: /note="Description of Artificial Sequence: Synthetic peptide"
HSHSHHHHR

SEQ ID NO: 22270 - protein, 9 aa, Artificial Sequence
  source: /note="Description of Artificial Sequence: Synthetic peptide"
RPPVTLRQV

SEQ ID NO: 22271 - protein, 9 aa, Artificial Sequence
  source: /note="Description of Artificial Sequence: Synthetic peptide"
RQVVPATQC

SEQ ID NO: 22272 - protein, 10 aa, Artificial Sequence
  source: /note="Description of Artificial Sequence: Synthetic peptide"
RPPVTLRQVV

SEQ ID NO: 22273 - protein, 10 aa, Artificial Sequence
  source: /note="Description of Artificial Sequence: Synthetic peptide"
RQVVPATQCG

SEQ ID NO: 22274 - protein, 10 aa, Artificial Sequence
  source: /note="Description of Artificial Sequence: Synthetic peptide"
HIAWDDEETR

SEQ ID NO: 22275 - protein, 9 aa, Artificial Sequence
  source: /note="Description of Artificial Sequence: Synthetic peptide"
NMPGAYIYA

SEQ ID NO: 22276 - protein, 9 aa, Artificial Sequence
  source: /note="Description of Artificial Sequence: Synthetic peptide"
TENNMPGAY

SEQ ID NO: 22277 - protein, 9 aa, Artificial Sequence
  source: /note="Description of Artificial Sequence: Synthetic peptide"
NNMPGAYIY

SEQ ID NO: 22278 - protein, 9 aa, Artificial Sequence
  source: /note="Description of Artificial Sequence: Synthetic peptide"
MPGAYIYAV

SEQ ID NO: 22279 - protein, 10 aa, Artificial Sequence
  source: /note="Description of Artificial Sequence: Synthetic peptide"
VTENNMPGAY

SEQ ID NO: 22280 - protein, 10 aa, Artificial Sequence
  source: /note="Description of Artificial Sequence: Synthetic peptide"
YVTENNMPGA

SEQ ID NO: 22281 - protein, 10 aa, Artificial Sequence
  source: /note="Description of Artificial Sequence: Synthetic peptide"
NMPGAYIYAV

SEQ ID NO: 22282 - protein, 10 aa, Artificial Sequence
  source: /note="Description of Artificial Sequence: Synthetic peptide"
YDVYVTENNM

SEQ ID NO: 22283 - protein, 10 aa, Artificial Sequence
  source: /note="Description of Artificial Sequence: Synthetic peptide"
MPGAYIYAVS

SEQ ID NO: 22284 - protein, 10 aa, Artificial Sequence
  source: /note="Description of Artificial Sequence: Synthetic peptide"
TENNMPGAYI

SEQ ID NO: 22285 - protein, 10 aa, Artificial Sequence
  source: /note="Description of Artificial Sequence: Synthetic peptide"
GTPASEVLPR

SEQ ID NO: 22286 - protein, 10 aa, Artificial Sequence
  source: /note="Description of Artificial Sequence: Synthetic peptide"
RNGTPASEVL

SEQ ID NO: 22287 - protein, 9 aa, Artificial Sequence
  source: /note="Description of Artificial Sequence: Synthetic peptide"
TELFETPEA

SEQ ID NO: 22288 - protein, 10 aa, Artificial Sequence
  source: /note="Description of Artificial Sequence: Synthetic peptide"
GMDSVPDTEL

SEQ ID NO: 22289 - protein, 10 aa, Artificial Sequence
  source: /note="Description of Artificial Sequence: Synthetic peptide"
MDSVPDTELF

SEQ ID NO: 22290 - protein, 10 aa, Artificial Sequence
  source: /note="Description of Artificial Sequence: Synthetic peptide"
VLDINDNPPL

SEQ ID NO: 22291 - protein, 10 aa, Artificial Sequence
  source: /note="Description of Artificial Sequence: Synthetic peptide"
LDINDNPPLF

SEQ ID NO: 22292 - protein, 9 aa, Artificial Sequence
  source: /note="Description of Artificial Sequence: Synthetic peptide"
AAHRHGPTH

SEQ ID NO: 22293 - protein, 10 aa, Artificial Sequence
  source: /note="Description of Artificial Sequence: Synthetic peptide"
GPTHHPSAGL

SEQ ID NO: 22294 - protein, 10 aa, Artificial Sequence
  source: /note="Description of Artificial Sequence: Synthetic peptide"
RHGPTHHPSA

SEQ ID NO: 22295 - protein, 9 aa, Artificial Sequence
  source: /note="Description of Artificial Sequence: Synthetic peptide"
IQLMKVSAM

SEQ ID NO: 22296 - protein, 10 aa, Artificial Sequence
  source: /note="Description of Artificial Sequence: Synthetic peptide"
QLMKVSAMDA

SEQ ID NO: 22297 - protein, 9 aa, Artificial Sequence
  source: /note="Description of Artificial Sequence: Synthetic peptide"
SVHTIPPMK

SEQ ID NO: 22298 - protein, 9 aa, Artificial Sequence
  source: /note="Description of Artificial Sequence: Synthetic peptide"
EVPVSVHTI

SEQ ID NO: 22299 - protein, 9 aa, Artificial Sequence
  source: /note="Description of Artificial Sequence: Synthetic peptide"
HTIPPMKEV

SEQ ID NO: 22300 - protein, 9 aa, Artificial Sequence
  source: /note="Description of Artificial Sequence: Synthetic peptide"
VSVHTIPPM

SEQ ID NO: 22301 - protein, 10 aa, Artificial Sequence
  source: /note="Description of Artificial Sequence: Synthetic peptide"
VSVHTIPPMK

SEQ ID NO: 22302 - protein, 10 aa, Artificial Sequence
  source: /note="Description of Artificial Sequence: Synthetic peptide"
TIPPMKEVVR

SEQ ID NO: 22303 - protein, 10 aa, Artificial Sequence
  source: /note="Description of Artificial Sequence: Synthetic peptide"
HTIPPMKEVV

SEQ ID NO: 22304 - protein, 10 aa, Artificial Sequence
  source: /note="Description of Artificial Sequence: Synthetic peptide"
FEVPVSVHTI

SEQ ID NO: 22305 - protein, 9 aa, Artificial Sequence
  source: /note="Description of Artificial Sequence: Synthetic peptide"
DISQITDFV

SEQ ID NO: 22306 - protein, 9 aa, Artificial Sequence
  source: /note="Description of Artificial Sequence: Synthetic peptide"
QITDFVDPF

SEQ ID NO: 22307 - protein, 9 aa, Artificial Sequence
  source: /note="Description of Artificial Sequence: Synthetic peptide"
SDISQITDF

SEQ ID NO: 22308 - protein, 10 aa, Artificial Sequence
  source: /note="Description of Artificial Sequence: Synthetic peptide"
SQITDFVDPF

SEQ ID NO: 22309 - protein, 9 aa, Artificial Sequence
  source: /note="Description of Artificial Sequence: Synthetic peptide"
ELSPSRPFV

SEQ ID NO: 22310 - protein, 9 aa, Artificial Sequence
  source: /note="Description of Artificial Sequence: Synthetic peptide"
FVLHSSLSR

SEQ ID NO: 22311 - protein, 9 aa, Artificial Sequence
  source: /note="Description of Artificial Sequence: Synthetic peptide"
RPFVLHSSL

SEQ ID NO: 22312 - protein, 9 aa, Artificial Sequence
  source: /note="Description of Artificial Sequence: Synthetic peptide"
LELSPSRPF

SEQ ID NO: 22313 - protein, 10 aa, Artificial Sequence
  source: /note="Description of Artificial Sequence: Synthetic peptide"
FVLHSSLSRR

SEQ ID NO: 22314 - protein, 10 aa, Artificial Sequence
  source: /note="Description of Artificial Sequence: Synthetic peptide"
SLELSPSRPF

SEQ ID NO: 22315 - protein, 10 aa, Artificial Sequence
  source: /note="Description of Artificial Sequence: Synthetic peptide"
LELSPSRPFV

SEQ ID NO: 22316 - protein, 9 aa, Artificial Sequence
  source: /note="Description of Artificial Sequence: Synthetic peptide"
QTKAFKFKV

SEQ ID NO: 22317 - protein, 9 aa, Artificial Sequence
  source: /note="Description of Artificial Sequence: Synthetic peptide"
KAFKFKVLA

SEQ ID NO: 22318 - protein, 9 aa, Artificial Sequence
  source: /note="Description of Artificial Sequence: Synthetic peptide"
AFKFKVLAK

SEQ ID NO: 22319 - protein, 9 aa, Artificial Sequence
  source: /note="Description of Artificial Sequence: Synthetic peptide"
TKAFKFKVL

SEQ ID NO: 22320 - protein, 9 aa, Artificial Sequence
  source: /note="Description of Artificial Sequence: Synthetic peptide"
HEQTKAFKF

SEQ ID NO: 22321 - protein, 10 aa, Artificial Sequence
  source: /note="Description of Artificial Sequence: Synthetic peptide"
KAFKFKVLAK

SEQ ID NO: 22322 - protein, 10 aa, Artificial Sequence
  source: /note="Description of Artificial Sequence: Synthetic peptide"
QTKAFKFKVL

SEQ ID NO: 22323 - protein, 9 aa, Artificial Sequence
  source: /note="Description of Artificial Sequence: Synthetic peptide"
YVNDRTCEL

SEQ ID NO: 22324 - protein, 10 aa, Artificial Sequence
  source: /note="Description of Artificial Sequence: Synthetic peptide"
YVNDRTCELF

SEQ ID NO: 22325 - protein, 9 aa, Artificial Sequence
  source: /note="Description of Artificial Sequence: Synthetic peptide"
AESGKVYTL

SEQ ID NO: 22326 - protein, 9 aa, Artificial Sequence
  source: /note="Description of Artificial Sequence: Synthetic peptide"
GKVYTLQPL

SEQ ID NO: 22327 - protein, 10 aa, Artificial Sequence
  source: /note="Description of Artificial Sequence: Synthetic peptide"
TLQPLDHEEL

SEQ ID NO: 22328 - protein, 10 aa, Artificial Sequence
  source: /note="Description of Artificial Sequence: Synthetic peptide"
KVYTLQPLDH

SEQ ID NO: 22329 - protein, 10 aa, Artificial Sequence
  source: /note="Description of Artificial Sequence: Synthetic peptide"
SGKVYTLQPL

SEQ ID NO: 22330 - protein, 10 aa, Artificial Sequence
  source: /note="Description of Artificial Sequence: Synthetic peptide"
HAESGKVYTL

SEQ ID NO: 22331 - protein, 9 aa, Artificial Sequence
  source: /note="Description of Artificial Sequence: Synthetic peptide"
IIKCYRYTV

SEQ ID NO: 22332 - protein, 9 aa, Artificial Sequence
  source: /note="Description of Artificial Sequence: Synthetic peptide"
YTVYGTACC

SEQ ID NO: 22333 - protein, 9 aa, Artificial Sequence
  source: /note="Description of Artificial Sequence: Synthetic peptide"
IKCYRYTVY

SEQ ID NO: 22334 - protein, 9 aa, Artificial Sequence
  source: /note="Description of Artificial Sequence: Synthetic peptide"
YRYTVYGTA

SEQ ID NO: 22335 - protein, 10 aa, Artificial Sequence
  source: /note="Description of Artificial Sequence: Synthetic peptide"
SIIKCYRYTV

SEQ ID NO: 22336 - protein, 10 aa, Artificial Sequence
  source: /note="Description of Artificial Sequence: Synthetic peptide"
VYGTACCGGF

SEQ ID NO: 22337 - protein, 10 aa, Artificial Sequence
  source: /note="Description of Artificial Sequence: Synthetic peptide"
IIKCYRYTVY

SEQ ID NO: 22338 - protein, 10 aa, Artificial Sequence
  source: /note="Description of Artificial Sequence: Synthetic peptide"
CYRYTVYGTA

SEQ ID NO: 22339 - protein, 10 aa, Artificial Sequence
  source: /note="Description of Artificial Sequence: Synthetic peptide"
YRYTVYGTAC

SEQ ID NO: 22340 - protein, 9 aa, Artificial Sequence
  source: /note="Description of Artificial Sequence: Synthetic peptide"
SSVVGSWSY

SEQ ID NO: 22341 - protein, 9 aa, Artificial Sequence
  source: /note="Description of Artificial Sequence: Synthetic peptide"
KPTLVCSSV

SEQ ID NO: 22342 - protein, 10 aa, Artificial Sequence
  source: /note="Description of Artificial Sequence: Synthetic peptide"
CSSVVGSWSY

SEQ ID NO: 22343 - protein, 10 aa, Artificial Sequence
  source: /note="Description of Artificial Sequence: Synthetic peptide"
KPTLVCSSVV

SEQ ID NO: 22344 - protein, 10 aa, Artificial Sequence
  source: /note="Description of Artificial Sequence: Synthetic peptide"
LVCSSVVGSW

SEQ ID NO: 22345 - protein, 9 aa, Artificial Sequence
  source: /note="Description of Artificial Sequence: Synthetic peptide"
VFPATQNNL

SEQ ID NO: 22346 - protein, 9 aa, Artificial Sequence
  source: /note="Description of Artificial Sequence: Synthetic peptide"
NNLFIAESR

SEQ ID NO: 22347 - protein, 9 aa, Artificial Sequence
  source: /note="Description of Artificial Sequence: Synthetic peptide"
FPATQNNLF

SEQ ID NO: 22348 - protein, 10 aa, Artificial Sequence
  source: /note="Description of Artificial Sequence: Synthetic peptide"
VFPATQNNLF

SEQ ID NO: 22349 - protein, 10 aa, Artificial Sequence
  source: /note="Description of Artificial Sequence: Synthetic peptide"
FPATQNNLFI

SEQ ID NO: 22350 - protein, 9 aa, Artificial Sequence
  source: /note="Description of Artificial Sequence: Synthetic peptide"
DSRFPLEGV

SEQ ID NO: 22351 - protein, 9 aa, Artificial Sequence
  source: /note="Description of Artificial Sequence: Synthetic peptide"
FPLEGVSDL

SEQ ID NO: 22352 - protein, 9 aa, Artificial Sequence
  source: /note="Description of Artificial Sequence: Synthetic peptide"
ELSKSLSLV

SEQ ID NO: 22353 - protein, 9 aa, Artificial Sequence
  source: /note="Description of Artificial Sequence: Synthetic peptide"
KSLSLVLGK

SEQ ID NO: 22354 - protein, 9 aa, Artificial Sequence
  source: /note="Description of Artificial Sequence: Synthetic peptide"
LSKSLSLVL

SEQ ID NO: 22355 - protein, 9 aa, Artificial Sequence
  source: /note="Description of Artificial Sequence: Synthetic peptide"
DELSKSLSL

SEQ ID NO: 22356 - protein, 10 aa, Artificial Sequence
  source: /note="Description of Artificial Sequence: Synthetic peptide"
DELSKSLSLV

SEQ ID NO: 22357 - protein, 9 aa, Artificial Sequence
  source: /note="Description of Artificial Sequence: Synthetic peptide"
NTTDLDEGV

SEQ ID NO: 22358 - protein, 10 aa, Artificial Sequence
  source: /note="Description of Artificial Sequence: Synthetic peptide"
TTDLDEGVNK

SEQ ID NO: 22359 - protein, 9 aa, Artificial Sequence
  source: /note="Description of Artificial Sequence: Synthetic peptide"
QLNASDPDK

SEQ ID NO: 22360 - protein, 9 aa, Artificial Sequence
  source: /note="Description of Artificial Sequence: Synthetic peptide"
KGLNGEISY

SEQ ID NO: 22361 - protein, 9 aa, Artificial Sequence
  source: /note="Description of Artificial Sequence: Synthetic peptide"
ILYPLQKGT

SEQ ID NO: 22362 - protein, 9 aa, Artificial Sequence
  source: /note="Description of Artificial Sequence: Synthetic peptide"
PMILYPLQK

SEQ ID NO: 22363 - protein, 10 aa, Artificial Sequence
  source: /note="Description of Artificial Sequence: Synthetic peptide"
ILYPLQKGTL

SEQ ID NO: 22364 - protein, 10 aa, Artificial Sequence
  source: /note="Description of Artificial Sequence: Synthetic peptide"
RPMILYPLQK

SEQ ID NO: 22365 - protein, 10 aa, Artificial Sequence
  source: /note="Description of Artificial Sequence: Synthetic peptide"
YPLQKGTLPC

SEQ ID NO: 22366 - protein, 9 aa, Artificial Sequence
  source: /note="Description of Artificial Sequence: Synthetic peptide"
ASEDICKTF

SEQ ID NO: 22367 - protein, 10 aa, Artificial Sequence
  source: /note="Description of Artificial Sequence: Synthetic peptide"
FSHASEDICK

SEQ ID NO: 22368 - protein, 10 aa, Artificial Sequence
  source: /note="Description of Artificial Sequence: Synthetic peptide"
HASEDICKTF

SEQ ID NO: 22369 - protein, 10 aa, Artificial Sequence
  source: /note="Description of Artificial Sequence: Synthetic peptide"
SEDICKTFEI

SEQ ID NO: 22370 - protein, 9 aa, Artificial Sequence
  source: /note="Description of Artificial Sequence: Synthetic peptide"
LPRSGTAQV

SEQ ID NO: 22371 - protein, 10 aa, Artificial Sequence
  source: /note="Description of Artificial Sequence: Synthetic peptide"
SLPRSGTAQV

SEQ ID NO: 22372 - protein, 10 aa, Artificial Sequence
  source: /note="Description of Artificial Sequence: Synthetic peptide"
TALDGGSLPR

SEQ ID NO: 22373 - protein, 10 aa, Artificial Sequence
  source: /note="Description of Artificial Sequence: Synthetic peptide"
LPRSGTAQVY

SEQ ID NO: 22374 - protein, 9 aa, Artificial Sequence
  source: /note="Description of Artificial Sequence: Synthetic peptide"
FLDSPIVRV

SEQ ID NO: 22375 - protein, 9 aa, Artificial Sequence
  source: /note="Description of Artificial Sequence: Synthetic peptide"
SFLDSPIVR

SEQ ID NO: 22376 - protein, 9 aa, Artificial Sequence
  source: /note="Description of Artificial Sequence: Synthetic peptide"
NSFLDSPIV

SEQ ID NO: 22377 - protein, 9 aa, Artificial Sequence
  source: /note="Description of Artificial Sequence: Synthetic peptide"
GVQVLENSF

SEQ ID NO: 22378 - protein, 9 aa, Artificial Sequence
  source: /note="Description of Artificial Sequence: Synthetic peptide"
VQVLENSFL

SEQ ID NO: 22379 - protein, 10 aa, Artificial Sequence
  source: /note="Description of Artificial Sequence: Synthetic peptide"
FLDSPIVRVL

SEQ ID NO: 22380 - protein, 10 aa, Artificial Sequence
  source: /note="Description of Artificial Sequence: Synthetic peptide"
NSFLDSPIVR

SEQ ID NO: 22381 - protein, 10 aa, Artificial Sequence
  source: /note="Description of Artificial Sequence: Synthetic peptide"
YGVQVLENSF

SEQ ID NO: 22382 - protein, 10 aa, Artificial Sequence
  source: /note="Description of Artificial Sequence: Synthetic peptide"
LENSFLDSPI

SEQ ID NO: 22383 - protein, 9 aa, Artificial Sequence
  source: /note="Description of Artificial Sequence: Synthetic peptide"
YSVANLAKY

SEQ ID NO: 22384 - protein, 9 aa, Artificial Sequence
  source: /note="Description of Artificial Sequence: Synthetic peptide"
YLGLGVGEL

SEQ ID NO: 22385 - protein, 9 aa, Artificial Sequence
  source: /note="Description of Artificial Sequence: Synthetic peptide"
AKYLGLGVG

SEQ ID NO: 22386 - protein, 10 aa, Artificial Sequence
  source: /note="Description of Artificial Sequence: Synthetic peptide"
NLAKYLGLGV

SEQ ID NO: 22387 - protein, 10 aa, Artificial Sequence
  source: /note="Description of Artificial Sequence: Synthetic peptide"
YLGLGVGELA

SEQ ID NO: 22388 - protein, 10 aa, Artificial Sequence
  source: /note="Description of Artificial Sequence: Synthetic peptide"
KYLGLGVGEL

SEQ ID NO: 22389 - protein, 10 aa, Artificial Sequence
  source: /note="Description of Artificial Sequence: Synthetic peptide"
GYSVANLAKY

SEQ ID NO: 22390 - protein, 10 aa, Artificial Sequence
  source: /note="Description of Artificial Sequence: Synthetic peptide"
YSVANLAKYL

SEQ ID NO: 22391 - protein, 9 aa, Artificial Sequence
  source: /note="Description of Artificial Sequence: Synthetic peptide"
SPRSATATL

SEQ ID NO: 22392 - protein, 9 aa, Artificial Sequence
  source: /note="Description of Artificial Sequence: Synthetic peptide"
GESPRSATA

SEQ ID NO: 22393 - protein, 10 aa, Artificial Sequence
  source: /note="Description of Artificial Sequence: Synthetic peptide"
LVKDNGESPR

SEQ ID NO: 22394 - protein, 10 aa, Artificial Sequence
  source: /note="Description of Artificial Sequence: Synthetic peptide"
ESPRSATATL

SEQ ID NO: 22395 - protein, 10 aa, Artificial Sequence
  source: /note="Description of Artificial Sequence: Synthetic peptide"
GESPRSATAT

SEQ ID NO: 22396 - protein, 9 aa, Artificial Sequence
  source: /note="Description of Artificial Sequence: Synthetic peptide"
QVYIEVVNV

SEQ ID NO: 22397 - protein, 9 aa, Artificial Sequence
  source: /note="Description of Artificial Sequence: Synthetic peptide"
EVVNVNDNA

SEQ ID NO: 22398 - protein, 9 aa, Artificial Sequence
  source: /note="Description of Artificial Sequence: Synthetic peptide"
NVNDNAPEF

SEQ ID NO: 22399 - protein, 10 aa, Artificial Sequence
  source: /note="Description of Artificial Sequence: Synthetic peptide"
AQVYIEVVNV

SEQ ID NO: 22400 - protein, 10 aa, Artificial Sequence
  source: /note="Description of Artificial Sequence: Synthetic peptide"
VNVNDNAPEF

SEQ ID NO: 22401 - protein, 10 aa, Artificial Sequence
  source: /note="Description of Artificial Sequence: Synthetic peptide"
IEVVNVNDNA

SEQ ID NO: 22402 - protein, 9 aa, Artificial Sequence
  source: /note="Description of Artificial Sequence: Synthetic peptide"
SVQNAWLSY

SEQ ID NO: 22403 - protein, 9 aa, Artificial Sequence
  source: /note="Description of Artificial Sequence: Synthetic peptide"
VQNAWLSYR

SEQ ID NO: 22404 - protein, 9 aa, Artificial Sequence
  source: /note="Description of Artificial Sequence: Synthetic peptide"
VVAVDRDSV

SEQ ID NO: 22405 - protein, 10 aa, Artificial Sequence
  source: /note="Description of Artificial Sequence: Synthetic peptide"
VQNAWLSYRL

SEQ ID NO: 22406 - protein, 10 aa, Artificial Sequence
  source: /note="Description of Artificial Sequence: Synthetic peptide"
SVQNAWLSYR

SEQ ID NO: 22407 - protein, 10 aa, Artificial Sequence
  source: /note="Description of Artificial Sequence: Synthetic peptide"
DSVQNAWLSY

SEQ ID NO: 22408 - protein, 10 aa, Artificial Sequence
  source: /note="Description of Artificial Sequence: Synthetic peptide"
VDRDSVQNAW

SEQ ID NO: 22409 - protein, 9 aa, Artificial Sequence
  source: /note="Description of Artificial Sequence: Synthetic peptide"
LSATVTLTM

SEQ ID NO: 22410 - protein, 9 aa, Artificial Sequence
  source: /note="Description of Artificial Sequence: Synthetic peptide"
ATVTLTMAV

SEQ ID NO: 22411 - protein, 9 aa, Artificial Sequence
  source: /note="Description of Artificial Sequence: Synthetic peptide"
LTMAVADSI

SEQ ID NO: 22412 - protein, 9 aa, Artificial Sequence
  source: /note="Description of Artificial Sequence: Synthetic peptide"
TVTLTMAVA

SEQ ID NO: 22413 - protein, 10 aa, Artificial Sequence
  source: /note="Description of Artificial Sequence: Synthetic peptide"
MAVADSIPEV

SEQ ID NO: 22414 - protein, 10 aa, Artificial Sequence
  source: /note="Description of Artificial Sequence: Synthetic peptide"
TLTMAVADSI

SEQ ID NO: 22415 - protein, 10 aa, Artificial Sequence
  source: /note="Description of Artificial Sequence: Synthetic peptide"
SATVTLTMAV

SEQ ID NO: 22416 - protein, 10 aa, Artificial Sequence
  source: /note="Description of Artificial Sequence: Synthetic peptide"
PLSATVTLTM

SEQ ID NO: 22417 - protein, 9 aa, Artificial Sequence
  source: /note="Description of Artificial Sequence: Synthetic peptide"
VFANSLQEV

SEQ ID NO: 22418 - protein, 9 aa, Artificial Sequence
  source: /note="Description of Artificial Sequence: Synthetic peptide"
LHLVFANSL

SEQ ID NO: 22419 - protein, 9 aa, Artificial Sequence
  source: /note="Description of Artificial Sequence: Synthetic peptide"
FANSLQEVL

SEQ ID NO: 22420 - protein, 10 aa, Artificial Sequence
  source: /note="Description of Artificial Sequence: Synthetic peptide"
LVFANSLQEV

SEQ ID NO: 22421 - protein, 10 aa, Artificial Sequence
  source: /note="Description of Artificial Sequence: Synthetic peptide"
TLHLVFANSL

SEQ ID NO: 22422 - protein, 10 aa, Artificial Sequence
  source: /note="Description of Artificial Sequence: Synthetic peptide"
VFANSLQEVL

SEQ ID NO: 22423 - protein, 9 aa, Artificial Sequence
  source: /note="Description of Artificial Sequence: Synthetic peptide"
HEDLDLTLY

SEQ ID NO: 22424 - protein, 10 aa, Artificial Sequence
  source: /note="Description of Artificial Sequence: Synthetic peptide"
IDHEDLDLTL

SEQ ID NO: 22425 - protein, 10 aa, Artificial Sequence
  source: /note="Description of Artificial Sequence: Synthetic peptide"
TPIDHEDLDL

SEQ ID NO: 22426 - protein, 10 aa, Artificial Sequence
  source: /note="Description of Artificial Sequence: Synthetic peptide"
HEDLDLTLYL

SEQ ID NO: 22427 - protein, 9 aa, Artificial Sequence
  source: /note="Description of Artificial Sequence: Synthetic peptide"
SARKLRVST

SEQ ID NO: 22428 - protein, 9 aa, Artificial Sequence
  source: /note="Description of Artificial Sequence: Synthetic peptide"
RKLRVSTEK

SEQ ID NO: 22429 - protein, 9 aa, Artificial Sequence
  source: /note="Description of Artificial Sequence: Synthetic peptide"
KLRVSTEKL

SEQ ID NO: 22430 - protein, 9 aa, Artificial Sequence
  source: /note="Description of Artificial Sequence: Synthetic peptide"
STEKLHFSV

SEQ ID NO: 22431 - protein, 9 aa, Artificial Sequence
  source: /note="Description of Artificial Sequence: Synthetic peptide"
RVSTEKLHF

SEQ ID NO: 22432 - protein, 10 aa, Artificial Sequence
  source: /note="Description of Artificial Sequence: Synthetic peptide"
KLRVSTEKLH

SEQ ID NO: 22433 - protein, 10 aa, Artificial Sequence
  source: /note="Description of Artificial Sequence: Synthetic peptide"
VSTEKLHFSV

SEQ ID NO: 22434 - protein, 10 aa, Artificial Sequence
  source: /note="Description of Artificial Sequence: Synthetic peptide"
RKLRVSTEKL

SEQ ID NO: 22435 - protein, 10 aa, Artificial Sequence
  source: /note="Description of Artificial Sequence: Synthetic peptide"
LRVSTEKLHF

SEQ ID NO: 22436 - protein, 10 aa, Artificial Sequence
  source: /note="Description of Artificial Sequence: Synthetic peptide"
TEKLHFSVDA

SEQ ID NO: 22437 - protein, 9 aa, Artificial Sequence
  source: /note="Description of Artificial Sequence: Synthetic peptide"
KLPHCRNLV

SEQ ID NO: 22438 - protein, 9 aa, Artificial Sequence
  source: /note="Description of Artificial Sequence: Synthetic peptide"
NLVLLCFLL

SEQ ID NO: 22439 - protein, 9 aa, Artificial Sequence
  source: /note="Description of Artificial Sequence: Synthetic peptide"
LPHCRNLVL

SEQ ID NO: 22440 - protein, 9 aa, Artificial Sequence
  source: /note="Description of Artificial Sequence: Synthetic peptide"
QKLPHCRNL

SEQ ID NO: 22441 - protein, 10 aa, Artificial Sequence
  source: /note="Description of Artificial Sequence: Synthetic peptide"
KLPHCRNLVL

SEQ ID NO: 22442 - protein, 10 aa, Artificial Sequence
  source: /note="Description of Artificial Sequence: Synthetic peptide"
LPHCRNLVLL

SEQ ID NO: 22443 - protein, 10 aa, Artificial Sequence
  source: /note="Description of Artificial Sequence: Synthetic peptide"
LQKLPHCRNL

SEQ ID NO: 22444 - protein, 10 aa, Artificial Sequence
  source: /note="Description of Artificial Sequence: Synthetic peptide"
HCRNLVLLCF

SEQ ID NO: 22445 - protein, 9 aa, Artificial Sequence
  source: /note="Description of Artificial Sequence: Synthetic peptide"
EEEKILETF

SEQ ID NO: 22446 - protein, 10 aa, Artificial Sequence
  source: /note="Description of Artificial Sequence: Synthetic peptide"
NEEEKILETF

SEQ ID NO: 22447 - protein, 10 aa, Artificial Sequence
  source: /note="Description of Artificial Sequence: Synthetic peptide"
LETFQLDSNL

SEQ ID NO: 22448 - protein, 9 aa, Artificial Sequence
  source: /note="Description of Artificial Sequence: Synthetic peptide"
CLDSYTGEI

SEQ ID NO: 22449 - protein, 9 aa, Artificial Sequence
  source: /note="Description of Artificial Sequence: Synthetic peptide"
AQIFCLDSY

SEQ ID NO: 22450 - protein, 9 aa, Artificial Sequence
  source: /note="Description of Artificial Sequence: Synthetic peptide"
HRVAQIFCL

SEQ ID NO: 22451 - protein, 10 aa, Artificial Sequence
  source: /note="Description of Artificial Sequence: Synthetic peptide"
VAQIFCLDSY

SEQ ID NO: 22452 - protein, 10 aa, Artificial Sequence
  source: /note="Description of Artificial Sequence: Synthetic peptide"
AQIFCLDSYT

SEQ ID NO: 22453 - protein, 9 aa, Artificial Sequence
  source: /note="Description of Artificial Sequence: Synthetic peptide"
ILFTNWYQA

SEQ ID NO: 22454 - protein, 9 aa, Artificial Sequence
  source: /note="Description of Artificial Sequence: Synthetic peptide"
FTNWYQASK

SEQ ID NO: 22455 - protein, 9 aa, Artificial Sequence
  source: /note="Description of Artificial Sequence: Synthetic peptide"
TSVMTEPCK

SEQ ID NO: 22456 - protein, 9 aa, Artificial Sequence
  source: /note="Description of Artificial Sequence: Synthetic peptide"
HQSHPCSTS

SEQ ID NO: 22457 - protein, 9 aa, Artificial Sequence
  source: /note="Description of Artificial Sequence: Synthetic peptide"
QSHPCSTSV

SEQ ID NO: 22458 - protein, 9 aa, Artificial Sequence
  source: /note="Description of Artificial Sequence: Synthetic peptide"
SHPCSTSVM

SEQ ID NO: 22459 - protein, 9 aa, Artificial Sequence
  source: /note="Description of Artificial Sequence: Synthetic peptide"
VMTEPCKIL

SEQ ID NO: 22460 - protein, 9 aa, Artificial Sequence
  source: /note="Description of Artificial Sequence: Synthetic peptide"
MTEPCKILF

SEQ ID NO: 22461 - protein, 9 aa, Artificial Sequence
  source: /note="Description of Artificial Sequence: Synthetic peptide"
CKILFTNWY

SEQ ID NO: 22462 - protein, 10 aa, Artificial Sequence
  source: /note="Description of Artificial Sequence: Synthetic peptide"
KILFTNWYQA

SEQ ID NO: 22463 - protein, 10 aa, Artificial Sequence
  source: /note="Description of Artificial Sequence: Synthetic peptide"
HQSHPCSTSV

SEQ ID NO: 22464 - protein, 10 aa, Artificial Sequence
  source: /note="Description of Artificial Sequence: Synthetic peptide"
ILFTNWYQAS

SEQ ID NO: 22465 - protein, 10 aa, Artificial Sequence
  source: /note="Description of Artificial Sequence: Synthetic peptide"
FTNWYQASKK

SEQ ID NO: 22466 - protein, 10 aa, Artificial Sequence
  source: /note="Description of Artificial Sequence: Synthetic peptide"
STSVMTEPCK

SEQ ID NO: 22467 - protein, 10 aa, Artificial Sequence
  source: /note="Description of Artificial Sequence: Synthetic peptide"
VMTEPCKILF

SEQ ID NO: 22468 - protein, 10 aa, Artificial Sequence
  source: /note="Description of Artificial Sequence: Synthetic peptide"
LFTNWYQASK

SEQ ID NO: 22469 - protein, 10 aa, Artificial Sequence
  source: /note="Description of Artificial Sequence: Synthetic peptide"
QSHPCSTSVM

SEQ ID NO: 22470 - protein, 10 aa, Artificial Sequence
  source: /note="Description of Artificial Sequence: Synthetic peptide"
EPCKILFTNW

SEQ ID NO: 22471 - protein, 9 aa, Artificial Sequence
  source: /note="Description of Artificial Sequence: Synthetic peptide"
PTPTTQPSY

SEQ ID NO: 22472 - protein, 10 aa, Artificial Sequence
  source: /note="Description of Artificial Sequence: Synthetic peptide"
TPTTQPSYQL

SEQ ID NO: 22473 - protein, 10 aa, Artificial Sequence
  source: /note="Description of Artificial Sequence: Synthetic peptide"
QPTPTTQPSY

SEQ ID NO: 22474 - protein, 9 aa, Artificial Sequence
  source: /note="Description of Artificial Sequence: Synthetic peptide"
HQIKQEFCR

SEQ ID NO: 22475 - protein, 9 aa, Artificial Sequence
  source: /note="Description of Artificial Sequence: Synthetic peptide"
QEFCRGTES

SEQ ID NO: 22476 - protein, 10 aa, Artificial Sequence
  source: /note="Description of Artificial Sequence: Synthetic peptide"
QEFCRGTESL

SEQ ID NO: 22477 - protein, 9 aa, Artificial Sequence
  source: /note="Description of Artificial Sequence: Synthetic peptide"
MQAKGIPQM

SEQ ID NO: 22478 - protein, 9 aa, Artificial Sequence
  source: /note="Description of Artificial Sequence: Synthetic peptide"
GIPQMAPPK

SEQ ID NO: 22479 - protein, 9 aa, Artificial Sequence
  source: /note="Description of Artificial Sequence: Synthetic peptide"
MAPPKRKRK

SEQ ID NO: 22480 - protein, 9 aa, Artificial Sequence
  source: /note="Description of Artificial Sequence: Synthetic peptide"
QMAPPKRKR

SEQ ID NO: 22481 - protein, 10 aa, Artificial Sequence
  source: /note="Description of Artificial Sequence: Synthetic peptide"
MQAKGIPQMA

SEQ ID NO: 22482 - protein, 10 aa, Artificial Sequence
  source: /note="Description of Artificial Sequence: Synthetic peptide"
KGIPQMAPPK

SEQ ID NO: 22483 - protein, 10 aa, Artificial Sequence
  source: /note="Description of Artificial Sequence: Synthetic peptide"
QMAPPKRKRK

SEQ ID NO: 22484 - protein, 10 aa, Artificial Sequence
  source: /note="Description of Artificial Sequence: Synthetic peptide"
MAPPKRKRKR

SEQ ID NO: 22485 - protein, 10 aa, Artificial Sequence
  source: /note="Description of Artificial Sequence: Synthetic peptide"
EMQAKGIPQM

SEQ ID NO: 22486 - protein, 9 aa, Artificial Sequence
  source: /note="Description of Artificial Sequence: Synthetic peptide"
RAKQRINTY

SEQ ID NO: 22487 - protein, 10 aa, Artificial Sequence
  source: /note="Description of Artificial Sequence: Synthetic peptide"
RAKQRINTYV

SEQ ID NO: 22488 - protein, 10 aa, Artificial Sequence
  source: /note="Description of Artificial Sequence: Synthetic peptide"
KRAKQRINTY

SEQ ID NO: 22489 - protein, 10 aa, Artificial Sequence
  source: /note="Description of Artificial Sequence: Synthetic peptide"
AKQRINTYVF

SEQ ID NO: 22490 - protein, 9 aa, Artificial Sequence
  source: /note="Description of Artificial Sequence: Synthetic peptide"
SQNLSTPPL

SEQ ID NO: 22491 - protein, 9 aa, Artificial Sequence
  source: /note="Description of Artificial Sequence: Synthetic peptide"
KKEEASQNL

SEQ ID NO: 22492 - protein, 10 aa, Artificial Sequence
  source: /note="Description of Artificial Sequence: Synthetic peptide"
SQNLSTPPLR

SEQ ID NO: 22493 - protein, 10 aa, Artificial Sequence
  source: /note="Description of Artificial Sequence: Synthetic peptide"
GKKEEASQNL

SEQ ID NO: 22494 - protein, 10 aa, Artificial Sequence
  source: /note="Description of Artificial Sequence: Synthetic peptide"
ASQNLSTPPL

SEQ ID NO: 22495 - protein, 10 aa, Artificial Sequence
  source: /note="Description of Artificial Sequence: Synthetic peptide"
KEEASQNLST

SEQ ID NO: 22496 - protein, 9 aa, Artificial Sequence
  source: /note="Description of Artificial Sequence: Synthetic peptide"
NIYKEGNLV

SEQ ID NO: 22497 - protein, 9 aa, Artificial Sequence
  source: /note="Description of Artificial Sequence: Synthetic peptide"
IYKEGNLVI

SEQ ID NO: 22498 - protein, 10 aa, Artificial Sequence
  source: /note="Description of Artificial Sequence: Synthetic peptide"
LVIQQAGKNM

SEQ ID NO: 22499 - protein, 10 aa, Artificial Sequence
  source: /note="Description of Artificial Sequence: Synthetic peptide"
KEGNLVIQQA

SEQ ID NO: 22500 - protein, 9 aa, Artificial Sequence
  source: /note="Description of Artificial Sequence: Synthetic peptide"
LESDNLCHY

SEQ ID NO: 22501 - protein, 9 aa, Artificial Sequence
  source: /note="Description of Artificial Sequence: Synthetic peptide"
CHYDFVDVY

SEQ ID NO: 22502 - protein, 9 aa, Artificial Sequence
  source: /note="Description of Artificial Sequence: Synthetic peptide"
SDNLCHYDF

SEQ ID NO: 22503 - protein, 10 aa, Artificial Sequence
  source: /note="Description of Artificial Sequence: Synthetic peptide"
ESDNLCHYDF

SEQ ID NO: 22504 - protein, 10 aa, Artificial Sequence
  source: /note="Description of Artificial Sequence: Synthetic peptide"
NLCHYDFVDV

SEQ ID NO: 22505 - protein, 10 aa, Artificial Sequence
  source: /note="Description of Artificial Sequence: Synthetic peptide"
LCHYDFVDVY

SEQ ID NO: 22506 - protein, 10 aa, Artificial Sequence
  source: /note="Description of Artificial Sequence: Synthetic peptide"
KFRRFQKRKR

SEQ ID NO: 22507 - protein, 9 aa, Artificial Sequence
  source: /note="Description of Artificial Sequence: Synthetic peptide"
HAADVAQLT

SEQ ID NO: 22508 - protein, 9 aa, Artificial Sequence
  source: /note="Description of Artificial Sequence: Synthetic peptide"
DVAQLTHVL

SEQ ID NO: 22509 - protein, 9 aa, Artificial Sequence
  source: /note="Description of Artificial Sequence: Synthetic peptide"
LHAADVAQL

SEQ ID NO: 22510 - protein, 9 aa, Artificial Sequence
  source: /note="Description of Artificial Sequence: Synthetic peptide"
AQLTHVLLS

SEQ ID NO: 22511 - protein, 10 aa, Artificial Sequence
  source: /note="Description of Artificial Sequence: Synthetic peptide"
SLHAADVAQL

SEQ ID NO: 22512 - protein, 10 aa, Artificial Sequence
  source: /note="Description of Artificial Sequence: Synthetic peptide"
DVAQLTHVLL

SEQ ID NO: 22513 - protein, 10 aa, Artificial Sequence
  source: /note="Description of Artificial Sequence: Synthetic peptide"
LTHVLLSTPA

SEQ ID NO: 22514 - protein, 10 aa, Artificial Sequence
  source: /note="Description of Artificial Sequence: Synthetic peptide"
HAADVAQLTH

SEQ ID NO: 22515 - protein, 10 aa, Artificial Sequence
  source: /note="Description of Artificial Sequence: Synthetic peptide"
ADVAQLTHVL

SEQ ID NO: 22516 - protein, 10 aa, Artificial Sequence
  source: /note="Description of Artificial Sequence: Synthetic peptide"
AQLTHVLLST

SEQ ID NO: 22517 - protein, 9 aa, Artificial Sequence
  source: /note="Description of Artificial Sequence: Synthetic peptide"
KTIVVTCAV

SEQ ID NO: 22518 - protein, 9 aa, Artificial Sequence
  source: /note="Description of Artificial Sequence: Synthetic peptide"
TVYKSGKTI

SEQ ID NO: 22519 - protein, 9 aa, Artificial Sequence
  source: /note="Description of Artificial Sequence: Synthetic peptide"
YKSGKTIVV

SEQ ID NO: 22520 - protein, 10 aa, Artificial Sequence
  source: /note="Description of Artificial Sequence: Synthetic peptide"
ALKTVYKSGK

SEQ ID NO: 22521 - protein, 10 aa, Artificial Sequence
  source: /note="Description of Artificial Sequence: Synthetic peptide"
KTIVVTCAVF

SEQ ID NO: 22522 - protein, 10 aa, Artificial Sequence
  source: /note="Description of Artificial Sequence: Synthetic peptide"
KTVYKSGKTI

SEQ ID NO: 22523 - protein, 10 aa, Artificial Sequence
  source: /note="Description of Artificial Sequence: Synthetic peptide"
TVYKSGKTIV

SEQ ID NO: 22524 - protein, 10 aa, Artificial Sequence
  source: /note="Description of Artificial Sequence: Synthetic peptide"
YKSGKTIVVT

SEQ ID NO: 22525 - protein, 9 aa, Artificial Sequence
  source: /note="Description of Artificial Sequence: Synthetic peptide"
KQALMLELK

SEQ ID NO: 22526 - protein, 9 aa, Artificial Sequence
  source: /note="Description of Artificial Sequence: Synthetic peptide"
EKQALMLEL

SEQ ID NO: 22527 - protein, 9 aa, Artificial Sequence
  source: /note="Description of Artificial Sequence: Synthetic peptide"
ALMLELKIM

SEQ ID NO: 22528 - protein, 9 aa, Artificial Sequence
  source: /note="Description of Artificial Sequence: Synthetic peptide"
LELKIMSHL

SEQ ID NO: 22529 - protein, 10 aa, Artificial Sequence
  source: /note="Description of Artificial Sequence: Synthetic peptide"
MLELKIMSHL

SEQ ID NO: 22530 - protein, 10 aa, Artificial Sequence
  source: /note="Description of Artificial Sequence: Synthetic peptide"
RSSEKQALML

SEQ ID NO: 22531 - protein, 10 aa, Artificial Sequence
  source: /note="Description of Artificial Sequence: Synthetic peptide"
SEKQALMLEL

SEQ ID NO: 22532 - protein, 10 aa, Artificial Sequence
  source: /note="Description of Artificial Sequence: Synthetic peptide"
KQALMLELKI

SEQ ID NO: 22533 - protein, 10 aa, Artificial Sequence
  source: /note="Description of Artificial Sequence: Synthetic peptide"
LMLELKIMSH

SEQ ID NO: 22534 - protein, 9 aa, Artificial Sequence
  source: /note="Description of Artificial Sequence: Synthetic peptide"
TMAKAPGLV

SEQ ID NO: 22535 - protein, 9 aa, Artificial Sequence
  source: /note="Description of Artificial Sequence: Synthetic peptide"
MYPSTTMAK

SEQ ID NO: 22536 - protein, 9 aa, Artificial Sequence
  source: /note="Description of Artificial Sequence: Synthetic peptide"
TTMAKAPGL

SEQ ID NO: 22537 - protein, 9 aa, Artificial Sequence
  source: /note="Description of Artificial Sequence: Synthetic peptide"
YPSTTMAKA

SEQ ID NO: 22538 - protein, 10 aa, Artificial Sequence
  source: /note="Description of Artificial Sequence: Synthetic peptide"
TTMAKAPGLV

SEQ ID NO: 22539 - protein, 10 aa, Artificial Sequence
  source: /note="Description of Artificial Sequence: Synthetic peptide"
IMYPSTTMAK

SEQ ID NO: 22540 - protein, 10 aa, Artificial Sequence
  source: /note="Description of Artificial Sequence: Synthetic peptide"
MYPSTTMAKA

SEQ ID NO: 22541 - protein, 10 aa, Artificial Sequence
  source: /note="Description of Artificial Sequence: Synthetic peptide"
KAPGLVSCTF

SEQ ID NO: 22542 - protein, 9 aa, Artificial Sequence
  source: /note="Description of Artificial Sequence: Synthetic peptide"
HIKTKIEDK

SEQ ID NO: 22543 - protein, 10 aa, Artificial Sequence
  source: /note="Description of Artificial Sequence: Synthetic peptide"
IEDKDELLSV

SEQ ID NO: 22544 - protein, 9 aa, Artificial Sequence
  source: /note="Description of Artificial Sequence: Synthetic peptide"
EPIYRNWQY

SEQ ID NO: 22545 - protein, 9 aa, Artificial Sequence
  source: /note="Description of Artificial Sequence: Synthetic peptide"
WQYVGKTTS

SEQ ID NO: 22546 - protein, 10 aa, Artificial Sequence
  source: /note="Description of Artificial Sequence: Synthetic peptide"
WWGEPIYRNW

SEQ ID NO: 22547 - protein, 10 aa, Artificial Sequence
  source: /note="Description of Artificial Sequence: Synthetic peptide"
IYRNWQYVGK

SEQ ID NO: 22548 - protein, 10 aa, Artificial Sequence
  source: /note="Description of Artificial Sequence: Synthetic peptide"
EPIYRNWQYV

SEQ ID NO: 22549 - protein, 10 aa, Artificial Sequence
  source: /note="Description of Artificial Sequence: Synthetic peptide"
WQYVGKTTSS

SEQ ID NO: 22550 - protein, 9 aa, Artificial Sequence
  source: /note="Description of Artificial Sequence: Synthetic peptide"
QESPGGFEA

SEQ ID NO: 22551 - protein, 10 aa, Artificial Sequence
  source: /note="Description of Artificial Sequence: Synthetic peptide"
GQESPGGFEA

SEQ ID NO: 22552 - protein, 10 aa, Artificial Sequence
  source: /note="Description of Artificial Sequence: Synthetic peptide"
YPKRSSEVAW

SEQ ID NO: 22553 - protein, 10 aa, Artificial Sequence
  source: /note="Description of Artificial Sequence: Synthetic peptide"
VAWEGDGDSM

SEQ ID NO: 22554 - protein, 9 aa, Artificial Sequence
  source: /note="Description of Artificial Sequence: Synthetic peptide"
IVKKSTSSL

SEQ ID NO: 22555 - protein, 9 aa, Artificial Sequence
  source: /note="Description of Artificial Sequence: Synthetic peptide"
TSSLSTTQV

SEQ ID NO: 22556 - protein, 9 aa, Artificial Sequence
  source: /note="Description of Artificial Sequence: Synthetic peptide"
KKSTSSLST

SEQ ID NO: 22557 - protein, 10 aa, Artificial Sequence
  source: /note="Description of Artificial Sequence: Synthetic peptide"
HIVKKSTSSL

SEQ ID NO: 22558 - protein, 10 aa, Artificial Sequence
  source: /note="Description of Artificial Sequence: Synthetic peptide"
STSSLSTTQV

SEQ ID NO: 22559 - protein, 10 aa, Artificial Sequence
  source: /note="Description of Artificial Sequence: Synthetic peptide"
IVKKSTSSLS

SEQ ID NO: 22560 - protein, 10 aa, Artificial Sequence
  source: /note="Description of Artificial Sequence: Synthetic peptide"
KKSTSSLSTT

SEQ ID NO: 22561 - protein, 9 aa, Artificial Sequence
  source: /note="Description of Artificial Sequence: Synthetic peptide"
REEWEGPTA

SEQ ID NO: 22562 - protein, 9 aa, Artificial Sequence
  source: /note="Description of Artificial Sequence: Synthetic peptide"
EEQPSREEW

SEQ ID NO: 22563 - protein, 9 aa, Artificial Sequence
  source: /note="Description of Artificial Sequence: Synthetic peptide"
EEWEGPTAG

SEQ ID NO: 22564 - protein, 9 aa, Artificial Sequence
  source: /note="Description of Artificial Sequence: Synthetic peptide"
EENPPGSCA

SEQ ID NO: 22565 - protein, 9 aa, Artificial Sequence
  source: /note="Description of Artificial Sequence: Synthetic peptide"
RTAPSLTCV

SEQ ID NO: 22566 - protein, 9 aa, Artificial Sequence
  source: /note="Description of Artificial Sequence: Synthetic peptide"
QMGFFILQL

SEQ ID NO: 22567 - protein, 9 aa, Artificial Sequence
  source: /note="Description of Artificial Sequence: Synthetic peptide"
VLVMHPRGA

SEQ ID NO: 22568 - protein, 9 aa, Artificial Sequence
  source: /note="Description of Artificial Sequence: Synthetic peptide"
MGFFILQLR

SEQ ID NO: 22569 - protein, 9 aa, Artificial Sequence
  source: /note="Description of Artificial Sequence: Synthetic peptide"
GARSLSVEM

SEQ ID NO: 22570 - protein, 9 aa, Artificial Sequence
  source: /note="Description of Artificial Sequence: Synthetic peptide"
KVRPTSCRT

SEQ ID NO: 22571 - protein, 9 aa, Artificial Sequence
  source: /note="Description of Artificial Sequence: Synthetic peptide"
SPGSGARSL

SEQ ID NO: 22572 - protein, 9 aa, Artificial Sequence
  source: /note="Description of Artificial Sequence: Synthetic peptide"
RPTSCRTAP

SEQ ID NO: 22573 - protein, 9 aa, Artificial Sequence
  source: /note="Description of Artificial Sequence: Synthetic peptide"
VMHPRGASP

SEQ ID NO: 22574 - protein, 9 aa, Artificial Sequence
  source: /note="Description of Artificial Sequence: Synthetic peptide"
SSGEQQMGF

SEQ ID NO: 22575 - protein, 9 aa, Artificial Sequence
  source: /note="Description of Artificial Sequence: Synthetic peptide"
GEQQMGFFI

SEQ ID NO: 22576 - protein, 9 aa, Artificial Sequence
  source: /note="Description of Artificial Sequence: Synthetic peptide"
EQQMGFFIL

SEQ ID NO: 22577 - protein, 9 aa, Artificial Sequence
  source: /note="Description of Artificial Sequence: Synthetic peptide"
RPSNEESWW

SEQ ID NO: 22578 - protein, 10 aa, Artificial Sequence
  source: /note="Description of Artificial Sequence: Synthetic peptide"
QQMGFFILQL

SEQ ID NO: 22579 - protein, 10 aa, Artificial Sequence
  source: /note="Description of Artificial Sequence: Synthetic peptide"
VMHPRGASPR

SEQ ID NO: 22580 - protein, 10 aa, Artificial Sequence
  source: /note="Description of Artificial Sequence: Synthetic peptide"
SVEMCTPCEK

SEQ ID NO: 22581 - protein, 10 aa, Artificial Sequence
  source: /note="Description of Artificial Sequence: Synthetic peptide"
QMGFFILQLR

SEQ ID NO: 22582 - protein, 10 aa, Artificial Sequence
  source: /note="Description of Artificial Sequence: Synthetic peptide"
RSPSPGSGAR

SEQ ID NO: 22583 - protein, 10 aa, Artificial Sequence
  source: /note="Description of Artificial Sequence: Synthetic peptide"
KVRPTSCRTA

SEQ ID NO: 22584 - protein, 10 aa, Artificial Sequence
  source: /note="Description of Artificial Sequence: Synthetic peptide"
WWKVRPTSCR

SEQ ID NO: 22585 - protein, 10 aa, Artificial Sequence
  source: /note="Description of Artificial Sequence: Synthetic peptide"
HPRGASPRSP

SEQ ID NO: 22586 - protein, 10 aa, Artificial Sequence
  source: /note="Description of Artificial Sequence: Synthetic peptide"
RPTSCRTAPS

SEQ ID NO: 22587 - protein, 10 aa, Artificial Sequence
  source: /note="Description of Artificial Sequence: Synthetic peptide"
APSLTCVGPL

SEQ ID NO: 22588 - protein, 10 aa, Artificial Sequence
  source: /note="Description of Artificial Sequence: Synthetic peptide"
GPLSSGEQQM

SEQ ID NO: 22589 - protein, 10 aa, Artificial Sequence
  source: /note="Description of Artificial Sequence: Synthetic peptide"
SGARSLSVEM

SEQ ID NO: 22590 - protein, 10 aa, Artificial Sequence
  source: /note="Description of Artificial Sequence: Synthetic peptide"
LSSGEQQMGF

SEQ ID NO: 22591 - protein, 10 aa, Artificial Sequence
  source: /note="Description of Artificial Sequence: Synthetic peptide"
GEQQMGFFIL

SEQ ID NO: 22592 - protein, 10 aa, Artificial Sequence
  source: /note="Description of Artificial Sequence: Synthetic peptide"
EESWWKVRPT

SEQ ID NO: 22593 - protein, 9 aa, Artificial Sequence
  source: /note="Description of Artificial Sequence: Synthetic peptide"
KLGQIIMKK

SEQ ID NO: 22594 - protein, 9 aa, Artificial Sequence
  source: /note="Description of Artificial Sequence: Synthetic peptide"
KMRRPVCYK

SEQ ID NO: 22595 - protein, 9 aa, Artificial Sequence
  source: /note="Description of Artificial Sequence: Synthetic peptide"
IMKKMRRPV

SEQ ID NO: 22596 - protein, 9 aa, Artificial Sequence
  source: /note="Description of Artificial Sequence: Synthetic peptide"
QIIMKKMRR

SEQ ID NO: 22597 - protein, 9 aa, Artificial Sequence
  source: /note="Description of Artificial Sequence: Synthetic peptide"
MKKMRRPVC

SEQ ID NO: 22598 - protein, 9 aa, Artificial Sequence
  source: /note="Description of Artificial Sequence: Synthetic peptide"
QKKLGQIIM

SEQ ID NO: 22599 - protein, 9 aa, Artificial Sequence
  source: /note="Description of Artificial Sequence: Synthetic peptide"
KKMRRPVCY

SEQ ID NO: 22600 - protein, 10 aa, Artificial Sequence
  source: /note="Description of Artificial Sequence: Synthetic peptide"
IIMKKMRRPV

SEQ ID NO: 22601 - protein, 10 aa, Artificial Sequence
  source: /note="Description of Artificial Sequence: Synthetic peptide"
KKMRRPVCYK

SEQ ID NO: 22602 - protein, 10 aa, Artificial Sequence
  source: /note="Description of Artificial Sequence: Synthetic peptide"
IMKKMRRPVC

SEQ ID NO: 22603 - protein, 10 aa, Artificial Sequence
  source: /note="Description of Artificial Sequence: Synthetic peptide"
DQKKLGQIIM

SEQ ID NO: 22604 - protein, 10 aa, Artificial Sequence
  source: /note="Description of Artificial Sequence: Synthetic peptide"
KLGQIIMKKM

SEQ ID NO: 22605 - protein, 10 aa, Artificial Sequence
  source: /note="Description of Artificial Sequence: Synthetic peptide"
MKKMRRPVCY

SEQ ID NO: 22606 - protein, 9 aa, Artificial Sequence
  source: /note="Description of Artificial Sequence: Synthetic peptide"
FTGASVFFV

SEQ ID NO: 22607 - protein, 9 aa, Artificial Sequence
  source: /note="Description of Artificial Sequence: Synthetic peptide"
SVFFVHEGY

SEQ ID NO: 22608 - protein, 9 aa, Artificial Sequence
  source: /note="Description of Artificial Sequence: Synthetic peptide"
IFTGASVFF

SEQ ID NO: 22609 - protein, 9 aa, Artificial Sequence
  source: /note="Description of Artificial Sequence: Synthetic peptide"
GIFTGASVF

SEQ ID NO: 22610 - protein, 9 aa, Artificial Sequence
  source: /note="Description of Artificial Sequence: Synthetic peptide"
VGIFTGASV

SEQ ID NO: 22611 - protein, 10 aa, Artificial Sequence
  source: /note="Description of Artificial Sequence: Synthetic peptide"
RVGIFTGASV

SEQ ID NO: 22612 - protein, 10 aa, Artificial Sequence
  source: /note="Description of Artificial Sequence: Synthetic peptide"
ASVFFVHEGY

SEQ ID NO: 22613 - protein, 10 aa, Artificial Sequence
  source: /note="Description of Artificial Sequence: Synthetic peptide"
IFTGASVFFV

SEQ ID NO: 22614 - protein, 10 aa, Artificial Sequence
  source: /note="Description of Artificial Sequence: Synthetic peptide"
VGIFTGASVF

SEQ ID NO: 22615 - protein, 10 aa, Artificial Sequence
  source: /note="Description of Artificial Sequence: Synthetic peptide"
GIFTGASVFF

SEQ ID NO: 22616 - protein, 9 aa, Artificial Sequence
  source: /note="Description of Artificial Sequence: Synthetic peptide"
ELMPHTFSK

SEQ ID NO: 22617 - protein, 9 aa, Artificial Sequence
  source: /note="Description of Artificial Sequence: Synthetic peptide"
GSRPELMPH

SEQ ID NO: 22618 - protein, 9 aa, Artificial Sequence
  source: /note="Description of Artificial Sequence: Synthetic peptide"
HTFSKSPST

SEQ ID NO: 22619 - protein, 9 aa, Artificial Sequence
  source: /note="Description of Artificial Sequence: Synthetic peptide"
YLANMGGSR

SEQ ID NO: 22620 - protein, 9 aa, Artificial Sequence
  source: /note="Description of Artificial Sequence: Synthetic peptide"
STSGICSPT

SEQ ID NO: 22621 - protein, 9 aa, Artificial Sequence
  source: /note="Description of Artificial Sequence: Synthetic peptide"
RPELMPHTF

SEQ ID NO: 22622 - protein, 9 aa, Artificial Sequence
  source: /note="Description of Artificial Sequence: Synthetic peptide"
NMGGSRPEL

SEQ ID NO: 22623 - protein, 9 aa, Artificial Sequence
  source: /note="Description of Artificial Sequence: Synthetic peptide"
SKSPSTSGI

SEQ ID NO: 22624 - protein, 9 aa, Artificial Sequence
  source: /note="Description of Artificial Sequence: Synthetic peptide"
TSGICSPTW

SEQ ID NO: 22625 - protein, 10 aa, Artificial Sequence
  source: /note="Description of Artificial Sequence: Synthetic peptide"
MPHTFSKSPS

SEQ ID NO: 22626 - protein, 10 aa, Artificial Sequence
  source: /note="Description of Artificial Sequence: Synthetic peptide"
ANMGGSRPEL

SEQ ID NO: 22627 - protein, 10 aa, Artificial Sequence
  source: /note="Description of Artificial Sequence: Synthetic peptide"
NMGGSRPELM

SEQ ID NO: 22628 - protein, 10 aa, Artificial Sequence
  source: /note="Description of Artificial Sequence: Synthetic peptide"
SRPELMPHTF

SEQ ID NO: 22629 - protein, 10 aa, Artificial Sequence
  source: /note="Description of Artificial Sequence: Synthetic peptide"
FSKSPSTSGI

SEQ ID NO: 22630 - protein, 10 aa, Artificial Sequence
  source: /note="Description of Artificial Sequence: Synthetic peptide"
STSGICSPTW

SEQ ID NO: 22631 - protein, 9 aa, Artificial Sequence
  source: /note="Description of Artificial Sequence: Synthetic peptide"
TVHKAMEAV

SEQ ID NO: 22632 - protein, 9 aa, Artificial Sequence
  source: /note="Description of Artificial Sequence: Synthetic peptide"
ETVHKAMEA

SEQ ID NO: 22633 - protein, 9 aa, Artificial Sequence
  source: /note="Description of Artificial Sequence: Synthetic peptide"
HKAMEAVAA

SEQ ID NO: 22634 - protein, 9 aa, Artificial Sequence
  source: /note="Description of Artificial Sequence: Synthetic peptide"
DEETVHKAM

SEQ ID NO: 22635 - protein, 10 aa, Artificial Sequence
  source: /note="Description of Artificial Sequence: Synthetic peptide"
ETVHKAMEAV

SEQ ID NO: 22636 - protein, 10 aa, Artificial Sequence
  source: /note="Description of Artificial Sequence: Synthetic peptide"
EETVHKAMEA

SEQ ID NO: 22637 - protein, 9 aa, Artificial Sequence
  source: /note="Description of Artificial Sequence: Synthetic peptide"
THVALCKMY

SEQ ID NO: 22638 - protein, 10 aa, Artificial Sequence
  source: /note="Description of Artificial Sequence: Synthetic peptide"
NTHVALCKMY

SEQ ID NO: 22639 - protein, 9 aa, Artificial Sequence
  source: /note="Description of Artificial Sequence: Synthetic peptide"
HWAKFGPPL

SEQ ID NO: 22640 - protein, 9 aa, Artificial Sequence
  source: /note="Description of Artificial Sequence: Synthetic peptide"
AKFGPPLLL

SEQ ID NO: 22641 - protein, 10 aa, Artificial Sequence
  source: /note="Description of Artificial Sequence: Synthetic peptide"
HWAKFGPPLL

SEQ ID NO: 22642 - protein, 10 aa, Artificial Sequence
  source: /note="Description of Artificial Sequence: Synthetic peptide"
KFGPPLLLQV

SEQ ID NO: 22643 - protein, 9 aa, Artificial Sequence
  source: /note="Description of Artificial Sequence: Synthetic peptide"
RLIIGQNGV

SEQ ID NO: 22644 - protein, 10 aa, Artificial Sequence
  source: /note="Description of Artificial Sequence: Synthetic peptide"
VLSTPAVSCI

SEQ ID NO: 22645 - protein, 10 aa, Artificial Sequence
  source: /note="Description of Artificial Sequence: Synthetic peptide"
RLIIGQNGVL

SEQ ID NO: 22646 - protein, 10 aa, Artificial Sequence
  source: /note="Description of Artificial Sequence: Synthetic peptide"
GQNGVLSTPA

SEQ ID NO: 22647 - protein, 9 aa, Artificial Sequence
  source: /note="Description of Artificial Sequence: Synthetic peptide"
SQRELTGGL

SEQ ID NO: 22648 - protein, 9 aa, Artificial Sequence
  source: /note="Description of Artificial Sequence: Synthetic peptide"
ASLLGRALK

SEQ ID NO: 22649 - protein, 9 aa, Artificial Sequence
  source: /note="Description of Artificial Sequence: Synthetic peptide"
RALKSHHPG

SEQ ID NO: 22650 - protein, 9 aa, Artificial Sequence
  source: /note="Description of Artificial Sequence: Synthetic peptide"
KSHHPGNAG

SEQ ID NO: 22651 - protein, 9 aa, Artificial Sequence
  source: /note="Description of Artificial Sequence: Synthetic peptide"
KAQAQSPVR

SEQ ID NO: 22652 - protein, 9 aa, Artificial Sequence
  source: /note="Description of Artificial Sequence: Synthetic peptide"
QAQSPVRRK

SEQ ID NO: 22653 - protein, 9 aa, Artificial Sequence
  source: /note="Description of Artificial Sequence: Synthetic peptide"
GKAQAQSPV

SEQ ID NO: 22654 - protein, 9 aa, Artificial Sequence
  source: /note="Description of Artificial Sequence: Synthetic peptide"
AQSPVRRKL

SEQ ID NO: 22655 - protein, 9 aa, Artificial Sequence
  source: /note="Description of Artificial Sequence: Synthetic peptide"
RKLNHGPSS

SEQ ID NO: 22656 - protein, 9 aa, Artificial Sequence
  source: /note="Description of Artificial Sequence: Synthetic peptide"
RELTGGLLL

SEQ ID NO: 22657 - protein, 10 aa, Artificial Sequence
  source: /note="Description of Artificial Sequence: Synthetic peptide"
ALKSHHPGNA

SEQ ID NO: 22658 - protein, 10 aa, Artificial Sequence
  source: /note="Description of Artificial Sequence: Synthetic peptide"
KLNHGPSSQR

SEQ ID NO: 22659 - protein, 10 aa, Artificial Sequence
  source: /note="Description of Artificial Sequence: Synthetic peptide"
KSHHPGNAGR

SEQ ID NO: 22660 - protein, 10 aa, Artificial Sequence
  source: /note="Description of Artificial Sequence: Synthetic peptide"
KAQAQSPVRR

SEQ ID NO: 22661 - protein, 10 aa, Artificial Sequence
  source: /note="Description of Artificial Sequence: Synthetic peptide"
AQAQSPVRRK

SEQ ID NO: 22662 - protein, 10 aa, Artificial Sequence
  source: /note="Description of Artificial Sequence: Synthetic peptide"
SQRELTGGLL

SEQ ID NO: 22663 - protein, 9 aa, Artificial Sequence
  source: /note="Description of Artificial Sequence: Synthetic peptide"
ALPDPAPAA

SEQ ID NO: 22664 - protein, 9 aa, Artificial Sequence
  source: /note="Description of Artificial Sequence: Synthetic peptide"
AVRQPRPAP

SEQ ID NO: 22665 - protein, 9 aa, Artificial Sequence
  source: /note="Description of Artificial Sequence: Synthetic peptide"
RQPRPAPPL

SEQ ID NO: 22666 - protein, 9 aa, Artificial Sequence
  source: /note="Description of Artificial Sequence: Synthetic peptide"
MICMPVGGA

SEQ ID NO: 22667 - protein, 9 aa, Artificial Sequence
  source: /note="Description of Artificial Sequence: Synthetic peptide"
MPVGGARPL

SEQ ID NO: 22668 - protein, 9 aa, Artificial Sequence
  source: /note="Description of Artificial Sequence: Synthetic peptide"
GARPLTGVL

SEQ ID NO: 22669 - protein, 9 aa, Artificial Sequence
  source: /note="Description of Artificial Sequence: Synthetic peptide"
GPAPPHCPA

SEQ ID NO: 22670 - protein, 9 aa, Artificial Sequence
  source: /note="Description of Artificial Sequence: Synthetic peptide"
LPDPAPAAV

SEQ ID NO: 22671 - protein, 9 aa, Artificial Sequence
  source: /note="Description of Artificial Sequence: Synthetic peptide"
LPPHAPLGL

SEQ ID NO: 22672 - protein, 9 aa, Artificial Sequence
  source: /note="Description of Artificial Sequence: Synthetic peptide"
HRLPPHAPL

SEQ ID NO: 22673 - protein, 9 aa, Artificial Sequence
  source: /note="Description of Artificial Sequence: Synthetic peptide"
AQQNAGHDH

SEQ ID NO: 22674 - protein, 9 aa, Artificial Sequence
  source: /note="Description of Artificial Sequence: Synthetic peptide"
WPAGCGPAP

SEQ ID NO: 22675 - protein, 10 aa, Artificial Sequence
  source: /note="Description of Artificial Sequence: Synthetic peptide"
VMICMPVGGA

SEQ ID NO: 22676 - protein, 10 aa, Artificial Sequence
  source: /note="Description of Artificial Sequence: Synthetic peptide"
VLHSPEEWPA

SEQ ID NO: 22677 - protein, 10 aa, Artificial Sequence
  source: /note="Description of Artificial Sequence: Synthetic peptide"
ALPDPAPAAV

SEQ ID NO: 22678 - protein, 10 aa, Artificial Sequence
  source: /note="Description of Artificial Sequence: Synthetic peptide"
RLPPHAPLGL

SEQ ID NO: 22679 - protein, 10 aa, Artificial Sequence
  source: /note="Description of Artificial Sequence: Synthetic peptide"
CMPVGGARPL

SEQ ID NO: 22680 - protein, 10 aa, Artificial Sequence
  source: /note="Description of Artificial Sequence: Synthetic peptide"
MICMPVGGAR

SEQ ID NO: 22681 - protein, 10 aa, Artificial Sequence
  source: /note="Description of Artificial Sequence: Synthetic peptide"
GARPLTGVLH

SEQ ID NO: 22682 - protein, 10 aa, Artificial Sequence
  source: /note="Description of Artificial Sequence: Synthetic peptide"
AVRQPRPAPP

SEQ ID NO: 22683 - protein, 10 aa, Artificial Sequence
  source: /note="Description of Artificial Sequence: Synthetic peptide"
AGHDHAEAGK

SEQ ID NO: 22684 - protein, 10 aa, Artificial Sequence
  source: /note="Description of Artificial Sequence: Synthetic peptide"
MPVGGARPLT

SEQ ID NO: 22685 - protein, 10 aa, Artificial Sequence
  source: /note="Description of Artificial Sequence: Synthetic peptide"
GPAPPHCPAL

SEQ ID NO: 22686 - protein, 10 aa, Artificial Sequence
  source: /note="Description of Artificial Sequence: Synthetic peptide"
CPALPDPAPA

SEQ ID NO: 22687 - protein, 10 aa, Artificial Sequence
  source: /note="Description of Artificial Sequence: Synthetic peptide"
RPAPPLHHRL

SEQ ID NO: 22688 - protein, 10 aa, Artificial Sequence
  source: /note="Description of Artificial Sequence: Synthetic peptide"
HHRLPPHAPL

SEQ ID NO: 22689 - protein, 10 aa, Artificial Sequence
  source: /note="Description of Artificial Sequence: Synthetic peptide"
EEWPAGCGPA

SEQ ID NO: 22690 - protein, 10 aa, Artificial Sequence
  source: /note="Description of Artificial Sequence: Synthetic peptide"
VRQPRPAPPL

SEQ ID NO: 22691 - protein, 10 aa, Artificial Sequence
  source: /note="Description of Artificial Sequence: Synthetic peptide"
RQPRPAPPLH

SEQ ID NO: 22692 - protein, 10 aa, Artificial Sequence
  source: /note="Description of Artificial Sequence: Synthetic peptide"
AQQNAGHDHA

SEQ ID NO: 22693 - protein, 10 aa, Artificial Sequence
  source: /note="Description of Artificial Sequence: Synthetic peptide"
WPAGCGPAPP

SEQ ID NO: 22694 - protein, 9 aa, Artificial Sequence
  source: /note="Description of Artificial Sequence: Synthetic peptide"
RVWPSTTTL

SEQ ID NO: 22695 - protein, 9 aa, Artificial Sequence
  source: /note="Description of Artificial Sequence: Synthetic peptide"
TTTLSCPPR

SEQ ID NO: 22696 - protein, 9 aa, Artificial Sequence
  source: /note="Description of Artificial Sequence: Synthetic peptide"
RVASRVWPS

SEQ ID NO: 22697 - protein, 9 aa, Artificial Sequence
  source: /note="Description of Artificial Sequence: Synthetic peptide"
ASRVWPSTT

SEQ ID NO: 22698 - protein, 9 aa, Artificial Sequence
  source: /note="Description of Artificial Sequence: Synthetic peptide"
RSSTSCSTA

SEQ ID NO: 22699 - protein, 9 aa, Artificial Sequence
  source: /note="Description of Artificial Sequence: Synthetic peptide"
HWCPTQPRR

SEQ ID NO: 22700 - protein, 9 aa, Artificial Sequence
  source: /note="Description of Artificial Sequence: Synthetic peptide"
TQPRRVASR

SEQ ID NO: 22701 - protein, 9 aa, Artificial Sequence
  source: /note="Description of Artificial Sequence: Synthetic peptide"
CPTQPRRVA

SEQ ID NO: 22702 - protein, 9 aa, Artificial Sequence
  source: /note="Description of Artificial Sequence: Synthetic peptide"
QPRRVASRV

SEQ ID NO: 22703 - protein, 9 aa, Artificial Sequence
  source: /note="Description of Artificial Sequence: Synthetic peptide"
WPSTTTLSC

SEQ ID NO: 22704 - protein, 9 aa, Artificial Sequence
  source: /note="Description of Artificial Sequence: Synthetic peptide"
GQTSHWCPT

SEQ ID NO: 22705 - protein, 9 aa, Artificial Sequence
  source: /note="Description of Artificial Sequence: Synthetic peptide"
SRVWPSTTT

SEQ ID NO: 22706 - protein, 9 aa, Artificial Sequence
  source: /note="Description of Artificial Sequence: Synthetic peptide"
MPVGGQTSH

SEQ ID NO: 22707 - protein, 10 aa, Artificial Sequence
  source: /note="Description of Artificial Sequence: Synthetic peptide"
TSHWCPTQPR

SEQ ID NO: 22708 - protein, 10 aa, Artificial Sequence
  source: /note="Description of Artificial Sequence: Synthetic peptide"
STTTLSCPPR

SEQ ID NO: 22709 - protein, 10 aa, Artificial Sequence
  source: /note="Description of Artificial Sequence: Synthetic peptide"
RVASRVWPST

SEQ ID NO: 22710 - protein, 10 aa, Artificial Sequence
  source: /note="Description of Artificial Sequence: Synthetic peptide"
ASRVWPSTTT

SEQ ID NO: 22711 - protein, 10 aa, Artificial Sequence
  source: /note="Description of Artificial Sequence: Synthetic peptide"
RSSTSCSTAA

SEQ ID NO: 22712 - protein, 10 aa, Artificial Sequence
  source: /note="Description of Artificial Sequence: Synthetic peptide"
STSCSTAATA

SEQ ID NO: 22713 - protein, 10 aa, Artificial Sequence
  source: /note="Description of Artificial Sequence: Synthetic peptide"
PTQPRRVASR

SEQ ID NO: 22714 - protein, 10 aa, Artificial Sequence
  source: /note="Description of Artificial Sequence: Synthetic peptide"
CPTQPRRVAS

SEQ ID NO: 22715 - protein, 10 aa, Artificial Sequence
  source: /note="Description of Artificial Sequence: Synthetic peptide"
QPRRVASRVW

SEQ ID NO: 22716 - protein, 10 aa, Artificial Sequence
  source: /note="Description of Artificial Sequence: Synthetic peptide"
APSPCTPRAA

SEQ ID NO: 22717 - protein, 10 aa, Artificial Sequence
  source: /note="Description of Artificial Sequence: Synthetic peptide"
MPVGGQTSHW

SEQ ID NO: 22718 - protein, 10 aa, Artificial Sequence
  source: /note="Description of Artificial Sequence: Synthetic peptide"
SRVWPSTTTL

SEQ ID NO: 22719 - protein, 10 aa, Artificial Sequence
  source: /note="Description of Artificial Sequence: Synthetic peptide"
SSHSKKNNWL

SEQ ID NO: 22720 - protein, 9 aa, Artificial Sequence
  source: /note="Description of Artificial Sequence: Synthetic peptide"
CLLIYLQSL

SEQ ID NO: 22721 - protein, 9 aa, Artificial Sequence
  source: /note="Description of Artificial Sequence: Synthetic peptide"
YLQSLHAPL

SEQ ID NO: 22722 - protein, 9 aa, Artificial Sequence
  source: /note="Description of Artificial Sequence: Synthetic peptide"
SLHAPLHSL

SEQ ID NO: 22723 - protein, 9 aa, Artificial Sequence
  source: /note="Description of Artificial Sequence: Synthetic peptide"
RLFKLCQKL

SEQ ID NO: 22724 - protein, 9 aa, Artificial Sequence
  source: /note="Description of Artificial Sequence: Synthetic peptide"
LIYLQSLHA

SEQ ID NO: 22725 - protein, 9 aa, Artificial Sequence
  source: /note="Description of Artificial Sequence: Synthetic peptide"
RSPSPHCLL

SEQ ID NO: 22726 - protein, 9 aa, Artificial Sequence
  source: /note="Description of Artificial Sequence: Synthetic peptide"
LHSLLRLFK

SEQ ID NO: 22727 - protein, 9 aa, Artificial Sequence
  source: /note="Description of Artificial Sequence: Synthetic peptide"
HAPLHSLLR

SEQ ID NO: 22728 - protein, 9 aa, Artificial Sequence
  source: /note="Description of Artificial Sequence: Synthetic peptide"
SPSPHCLLI

SEQ ID NO: 22729 - protein, 9 aa, Artificial Sequence
  source: /note="Description of Artificial Sequence: Synthetic peptide"
SPHCLLIYL

SEQ ID NO: 22730 - protein, 9 aa, Artificial Sequence
  source: /note="Description of Artificial Sequence: Synthetic peptide"
APLHSLLRL

SEQ ID NO: 22731 - protein, 9 aa, Artificial Sequence
  source: /note="Description of Artificial Sequence: Synthetic peptide"
LQSLHAPLH

SEQ ID NO: 22732 - protein, 9 aa, Artificial Sequence
  source: /note="Description of Artificial Sequence: Synthetic peptide"
LHAPLHSLL

SEQ ID NO: 22733 - protein, 9 aa, Artificial Sequence
  source: /note="Description of Artificial Sequence: Synthetic peptide"
FKLCQKLSF

SEQ ID NO: 22734 - protein, 10 aa, Artificial Sequence
  source: /note="Description of Artificial Sequence: Synthetic peptide"
LLIYLQSLHA

SEQ ID NO: 22735 - protein, 10 aa, Artificial Sequence
  source: /note="Description of Artificial Sequence: Synthetic peptide"
SLHAPLHSLL

SEQ ID NO: 22736 - protein, 10 aa, Artificial Sequence
  source: /note="Description of Artificial Sequence: Synthetic peptide"
PLHSLLRLFK

SEQ ID NO: 22737 - protein, 10 aa, Artificial Sequence
  source: /note="Description of Artificial Sequence: Synthetic peptide"
LLRLFKLCQK

SEQ ID NO: 22738 - protein, 10 aa, Artificial Sequence
  source: /note="Description of Artificial Sequence: Synthetic peptide"
RSPSPHCLLI

SEQ ID NO: 22739 - protein, 10 aa, Artificial Sequence
  source: /note="Description of Artificial Sequence: Synthetic peptide"
IYLQSLHAPL

SEQ ID NO: 22740 - protein, 10 aa, Artificial Sequence
  source: /note="Description of Artificial Sequence: Synthetic peptide"
LFKLCQKLSF

SEQ ID NO: 22741 - protein, 10 aa, Artificial Sequence
  source: /note="Description of Artificial Sequence: Synthetic peptide"
SPSPHCLLIY

SEQ ID NO: 22742 - protein, 10 aa, Artificial Sequence
  source: /note="Description of Artificial Sequence: Synthetic peptide"
SPRSPSPHCL

SEQ ID NO: 22743 - protein, 10 aa, Artificial Sequence
  source: /note="Description of Artificial Sequence: Synthetic peptide"
APLHSLLRLF

SEQ ID NO: 22744 - protein, 10 aa, Artificial Sequence
  source: /note="Description of Artificial Sequence: Synthetic peptide"
YLQSLHAPLH

SEQ ID NO: 22745 - protein, 10 aa, Artificial Sequence
  source: /note="Description of Artificial Sequence: Synthetic peptide"
QSLHAPLHSL

SEQ ID NO: 22746 - protein, 9 aa, Artificial Sequence
  source: /note="Description of Artificial Sequence: Synthetic peptide"
TTSSTTTTI

SEQ ID NO: 22747 - protein, 10 aa, Artificial Sequence
  source: /note="Description of Artificial Sequence: Synthetic peptide"
TTTSSTTTTI

SEQ ID NO: 22748 - protein, 9 aa, Artificial Sequence
  source: /note="Description of Artificial Sequence: Synthetic peptide"
KTILYDPII

SEQ ID NO: 22749 - protein, 9 aa, Artificial Sequence
  source: /note="Description of Artificial Sequence: Synthetic peptide"
SFGMKTILY

SEQ ID NO: 22750 - protein, 9 aa, Artificial Sequence
  source: /note="Description of Artificial Sequence: Synthetic peptide"
QSFGMKTIL

SEQ ID NO: 22751 - protein, 9 aa, Artificial Sequence
  source: /note="Description of Artificial Sequence: Synthetic peptide"
MKTILYDPI

SEQ ID NO: 22752 - protein, 10 aa, Artificial Sequence
  source: /note="Description of Artificial Sequence: Synthetic peptide"
GMKTILYDPI

SEQ ID NO: 22753 - protein, 10 aa, Artificial Sequence
  source: /note="Description of Artificial Sequence: Synthetic peptide"
QSFGMKTILY

SEQ ID NO: 22754 - protein, 10 aa, Artificial Sequence
  source: /note="Description of Artificial Sequence: Synthetic peptide"
LYDPIISPEV

SEQ ID NO: 22755 - protein, 10 aa, Artificial Sequence
  source: /note="Description of Artificial Sequence: Synthetic peptide"
MQSFGMKTIL

SEQ ID NO: 22756 - protein, 10 aa, Artificial Sequence
  source: /note="Description of Artificial Sequence: Synthetic peptide"
MKTILYDPII

SEQ ID NO: 22757 - protein, 9 aa, Artificial Sequence
  source: /note="Description of Artificial Sequence: Synthetic peptide"
EQNNVHPMR

SEQ ID NO: 22758 - protein, 9 aa, Artificial Sequence
  source: /note="Description of Artificial Sequence: Synthetic peptide"
NVHPMRDEV

SEQ ID NO: 22759 - protein, 9 aa, Artificial Sequence
  source: /note="Description of Artificial Sequence: Synthetic peptide"
LEQNNVHPM

SEQ ID NO: 22760 - protein, 10 aa, Artificial Sequence
  source: /note="Description of Artificial Sequence: Synthetic peptide"
HPMRDEVLPS

SEQ ID NO: 22761 - protein, 9 aa, Artificial Sequence
  source: /note="Description of Artificial Sequence: Synthetic peptide"
SLAPSSSSC

SEQ ID NO: 22762 - protein, 10 aa, Artificial Sequence
  source: /note="Description of Artificial Sequence: Synthetic peptide"
SLAPSSSSCC

SEQ ID NO: 22763 - protein, 9 aa, Artificial Sequence
  source: /note="Description of Artificial Sequence: Synthetic peptide"
LLCEASTFV

SEQ ID NO: 22764 - protein, 9 aa, Artificial Sequence
  source: /note="Description of Artificial Sequence: Synthetic peptide"
SLLCEASTF

SEQ ID NO: 22765 - protein, 9 aa, Artificial Sequence
  source: /note="Description of Artificial Sequence: Synthetic peptide"
CEASTFVLL

SEQ ID NO: 22766 - protein, 10 aa, Artificial Sequence
  source: /note="Description of Artificial Sequence: Synthetic peptide"
SLLCEASTFV

SEQ ID NO: 22767 - protein, 10 aa, Artificial Sequence
  source: /note="Description of Artificial Sequence: Synthetic peptide"
LLCEASTFVL

SEQ ID NO: 22768 - protein, 10 aa, Artificial Sequence
  source: /note="Description of Artificial Sequence: Synthetic peptide"
FSLLCEASTF

SEQ ID NO: 22769 - protein, 9 aa, Artificial Sequence
  source: /note="Description of Artificial Sequence: Synthetic peptide"
SVRVPSVTL

SEQ ID NO: 22770 - protein, 10 aa, Artificial Sequence
  source: /note="Description of Artificial Sequence: Synthetic peptide"
SVRVPSVTLV

SEQ ID NO: 22771 - protein, 10 aa, Artificial Sequence
  source: /note="Description of Artificial Sequence: Synthetic peptide"
SSVRVPSVTL

SEQ ID NO: 22772 - protein, 10 aa, Artificial Sequence
  source: /note="Description of Artificial Sequence: Synthetic peptide"
IESSSDEENL

SEQ ID NO: 22773 - protein, 9 aa, Artificial Sequence
  source: /note="Description of Artificial Sequence: Synthetic peptide"
KREVDMHPL

SEQ ID NO: 22774 - protein, 9 aa, Artificial Sequence
  source: /note="Description of Artificial Sequence: Synthetic peptide"
REVDMHPLC

SEQ ID NO: 22775 - protein, 9 aa, Artificial Sequence
  source: /note="Description of Artificial Sequence: Synthetic peptide"
DMHPLCPSL

SEQ ID NO: 22776 - protein, 10 aa, Artificial Sequence
  source: /note="Description of Artificial Sequence: Synthetic peptide"
HPLCPSLCTL

SEQ ID NO: 22777 - protein, 10 aa, Artificial Sequence
  source: /note="Description of Artificial Sequence: Synthetic peptide"
VDMHPLCPSL

SEQ ID NO: 22778 - protein, 10 aa, Artificial Sequence
  source: /note="Description of Artificial Sequence: Synthetic peptide"
REVDMHPLCP

SEQ ID NO: 22779 - protein, 9 aa, Artificial Sequence
  source: /note="Description of Artificial Sequence: Synthetic peptide"
RLCNLAVLL

SEQ ID NO: 22780 - protein, 9 aa, Artificial Sequence
  source: /note="Description of Artificial Sequence: Synthetic peptide"
NLAVLLFVA

SEQ ID NO: 22781 - protein, 9 aa, Artificial Sequence
  source: /note="Description of Artificial Sequence: Synthetic peptide"
LLKRLCNLA

SEQ ID NO: 22782 - protein, 9 aa, Artificial Sequence
  source: /note="Description of Artificial Sequence: Synthetic peptide"
LAVLLFVAV

SEQ ID NO: 22783 - protein, 9 aa, Artificial Sequence
  source: /note="Description of Artificial Sequence: Synthetic peptide"
ELLKRLCNL

SEQ ID NO: 22784 - protein, 9 aa, Artificial Sequence
  source: /note="Description of Artificial Sequence: Synthetic peptide"
LKRLCNLAV

SEQ ID NO: 22785 - protein, 9 aa, Artificial Sequence
  source: /note="Description of Artificial Sequence: Synthetic peptide"
KRLCNLAVL

SEQ ID NO: 22786 - protein, 9 aa, Artificial Sequence
  source: /note="Description of Artificial Sequence: Synthetic peptide"
LCNLAVLLF

SEQ ID NO: 22787 - protein, 10 aa, Artificial Sequence
  source: /note="Description of Artificial Sequence: Synthetic peptide"
NLAVLLFVAV

SEQ ID NO: 22788 - protein, 10 aa, Artificial Sequence
  source: /note="Description of Artificial Sequence: Synthetic peptide"
LLKRLCNLAV

SEQ ID NO: 22789 - protein, 10 aa, Artificial Sequence
  source: /note="Description of Artificial Sequence: Synthetic peptide"
RLCNLAVLLF

SEQ ID NO: 22790 - protein, 10 aa, Artificial Sequence
  source: /note="Description of Artificial Sequence: Synthetic peptide"
YELLKRLCNL

SEQ ID NO: 22791 - protein, 10 aa, Artificial Sequence
  source: /note="Description of Artificial Sequence: Synthetic peptide"
LKRLCNLAVL

SEQ ID NO: 22792 - protein, 10 aa, Artificial Sequence
  source: /note="Description of Artificial Sequence: Synthetic peptide"
KRLCNLAVLL

SEQ ID NO: 22793 - protein, 9 aa, Artificial Sequence
  source: /note="Description of Artificial Sequence: Synthetic peptide"
KLTWIMWSL

SEQ ID NO: 22794 - protein, 9 aa, Artificial Sequence
  source: /note="Description of Artificial Sequence: Synthetic peptide"
WIMWSLKST

SEQ ID NO: 22795 - protein, 9 aa, Artificial Sequence
  source: /note="Description of Artificial Sequence: Synthetic peptide"
LTWIMWSLK

SEQ ID NO: 22796 - protein, 9 aa, Artificial Sequence
  source: /note="Description of Artificial Sequence: Synthetic peptide"
SLKSTDTCR

SEQ ID NO: 22797 - protein, 9 aa, Artificial Sequence
  source: /note="Description of Artificial Sequence: Synthetic peptide"
TPFSGPPLL

SEQ ID NO: 22798 - protein, 9 aa, Artificial Sequence
  source: /note="Description of Artificial Sequence: Synthetic peptide"
LLKLTWIMW

SEQ ID NO: 22799 - protein, 10 aa, Artificial Sequence
  source: /note="Description of Artificial Sequence: Synthetic peptide"
VLTPFSGPPL

SEQ ID NO: 22800 - protein, 10 aa, Artificial Sequence
  source: /note="Description of Artificial Sequence: Synthetic peptide"
KLTWIMWSLK

SEQ ID NO: 22801 - protein, 10 aa, Artificial Sequence
  source: /note="Description of Artificial Sequence: Synthetic peptide"
SLKSTDTCRR

SEQ ID NO: 22802 - protein, 10 aa, Artificial Sequence
  source: /note="Description of Artificial Sequence: Synthetic peptide"
LKLTWIMWSL

SEQ ID NO: 22803 - protein, 9 aa, Artificial Sequence
  source: /note="Description of Artificial Sequence: Synthetic peptide"
SSGYGNPNY

SEQ ID NO: 22804 - protein, 10 aa, Artificial Sequence
  source: /note="Description of Artificial Sequence: Synthetic peptide"
DSSGYGNPNY

SEQ ID NO: 22805 - protein, 10 aa, Artificial Sequence
  source: /note="Description of Artificial Sequence: Synthetic peptide"
NEAPQCPSCM

SEQ ID NO: 22806 - protein, 9 aa, Artificial Sequence
  source: /note="Description of Artificial Sequence: Synthetic peptide"
LVYTLFHPL

SEQ ID NO: 22807 - protein, 9 aa, Artificial Sequence
  source: /note="Description of Artificial Sequence: Synthetic peptide"
YTLFHPLPR

SEQ ID NO: 22808 - protein, 9 aa, Artificial Sequence
  source: /note="Description of Artificial Sequence: Synthetic peptide"
AECDLVYTL

SEQ ID NO: 22809 - protein, 10 aa, Artificial Sequence
  source: /note="Description of Artificial Sequence: Synthetic peptide"
DLVYTLFHPL

SEQ ID NO: 22810 - protein, 10 aa, Artificial Sequence
  source: /note="Description of Artificial Sequence: Synthetic peptide"
LFHPLPRDEK

SEQ ID NO: 22811 - protein, 10 aa, Artificial Sequence
  source: /note="Description of Artificial Sequence: Synthetic peptide"
VYTLFHPLPR

SEQ ID NO: 22812 - protein, 10 aa, Artificial Sequence
  source: /note="Description of Artificial Sequence: Synthetic peptide"
AECDLVYTLF

SEQ ID NO: 22813 - protein, 9 aa, Artificial Sequence
  source: /note="Description of Artificial Sequence: Synthetic peptide"
TMPPQVPPA

SEQ ID NO: 22814 - protein, 9 aa, Artificial Sequence
  source: /note="Description of Artificial Sequence: Synthetic peptide"
LLHFATCWI

SEQ ID NO: 22815 - protein, 9 aa, Artificial Sequence
  source: /note="Description of Artificial Sequence: Synthetic peptide"
AMSGVLSPL

SEQ ID NO: 22816 - protein, 9 aa, Artificial Sequence
  source: /note="Description of Artificial Sequence: Synthetic peptide"
RLARTAGFL

SEQ ID NO: 22817 - protein, 9 aa, Artificial Sequence
  source: /note="Description of Artificial Sequence: Synthetic peptide"
FLQPRWAPG

SEQ ID NO: 22818 - protein, 9 aa, Artificial Sequence
  source: /note="Description of Artificial Sequence: Synthetic peptide"
LLPMAMSCL

SEQ ID NO: 22819 - protein, 9 aa, Artificial Sequence
  source: /note="Description of Artificial Sequence: Synthetic peptide"
EMRRLLHFA

SEQ ID NO: 22820 - protein, 9 aa, Artificial Sequence
  source: /note="Description of Artificial Sequence: Synthetic peptide"
WISFDLALT

SEQ ID NO: 22821 - protein, 9 aa, Artificial Sequence
  source: /note="Description of Artificial Sequence: Synthetic peptide"
VLSPLAQST

SEQ ID NO: 22822 - protein, 9 aa, Artificial Sequence
  source: /note="Description of Artificial Sequence: Synthetic peptide"
AMATERMRR

SEQ ID NO: 22823 - protein, 9 aa, Artificial Sequence
  source: /note="Description of Artificial Sequence: Synthetic peptide"
AMSCLRSQK

SEQ ID NO: 22824 - protein, 9 aa, Artificial Sequence
  source: /note="Description of Artificial Sequence: Synthetic peptide"
RTAGFLQPR

SEQ ID NO: 22825 - protein, 9 aa, Artificial Sequence
  source: /note="Description of Artificial Sequence: Synthetic peptide"
RWAPGPTLL

SEQ ID NO: 22826 - protein, 9 aa, Artificial Sequence
  source: /note="Description of Artificial Sequence: Synthetic peptide"
REMRRLLHF

SEQ ID NO: 22827 - protein, 9 aa, Artificial Sequence
  source: /note="Description of Artificial Sequence: Synthetic peptide"
HFATCWISF

SEQ ID NO: 22828 - protein, 9 aa, Artificial Sequence
  source: /note="Description of Artificial Sequence: Synthetic peptide"
CWISFDLAL

SEQ ID NO: 22829 - protein, 9 aa, Artificial Sequence
  source: /note="Description of Artificial Sequence: Synthetic peptide"
RMRRLARTA

SEQ ID NO: 22830 - protein, 9 aa, Artificial Sequence
  source: /note="Description of Artificial Sequence: Synthetic peptide"
RSQKREMRR

SEQ ID NO: 22831 - protein, 9 aa, Artificial Sequence
  source: /note="Description of Artificial Sequence: Synthetic peptide"
TSKTTSSLA

SEQ ID NO: 22832 - protein, 9 aa, Artificial Sequence
  source: /note="Description of Artificial Sequence: Synthetic peptide"
LPMAMSCLR

SEQ ID NO: 22833 - protein, 9 aa, Artificial Sequence
  source: /note="Description of Artificial Sequence: Synthetic peptide"
MSCLRSQKR

SEQ ID NO: 22834 - protein, 9 aa, Artificial Sequence
  source: /note="Description of Artificial Sequence: Synthetic peptide"
LTSKTTSSL

SEQ ID NO: 22835 - protein, 9 aa, Artificial Sequence
  source: /note="Description of Artificial Sequence: Synthetic peptide"
TSSLAMSGV

SEQ ID NO: 22836 - protein, 9 aa, Artificial Sequence
  source: /note="Description of Artificial Sequence: Synthetic peptide"
PPQVPPAPM

SEQ ID NO: 22837 - protein, 9 aa, Artificial Sequence
  source: /note="Description of Artificial Sequence: Synthetic peptide"
VPPAPMPPA

SEQ ID NO: 22838 - protein, 9 aa, Artificial Sequence
  source: /note="Description of Artificial Sequence: Synthetic peptide"
PPAPMPPAM

SEQ ID NO: 22839 - protein, 9 aa, Artificial Sequence
  source: /note="Description of Artificial Sequence: Synthetic peptide"
APMPPAMAT

SEQ ID NO: 22840 - protein, 9 aa, Artificial Sequence
  source: /note="Description of Artificial Sequence: Synthetic peptide"
QPRWAPGPT

SEQ ID NO: 22841 - protein, 9 aa, Artificial Sequence
  source: /note="Description of Artificial Sequence: Synthetic peptide"
APGPTLLPM

SEQ ID NO: 22842 - protein, 9 aa, Artificial Sequence
  source: /note="Description of Artificial Sequence: Synthetic peptide"
GPTLLPMAM

SEQ ID NO: 22843 - protein, 9 aa, Artificial Sequence
  source: /note="Description of Artificial Sequence: Synthetic peptide"
MATERMRRL

SEQ ID NO: 22844 - protein, 9 aa, Artificial Sequence
  source: /note="Description of Artificial Sequence: Synthetic peptide"
CLRSQKREM

SEQ ID NO: 22845 - protein, 9 aa, Artificial Sequence
  source: /note="Description of Artificial Sequence: Synthetic peptide"
RRLARTAGF

SEQ ID NO: 22846 - protein, 9 aa, Artificial Sequence
  source: /note="Description of Artificial Sequence: Synthetic peptide"
PRWAPGPTL

SEQ ID NO: 22847 - protein, 9 aa, Artificial Sequence
  source: /note="Description of Artificial Sequence: Synthetic peptide"
SQKREMRRL

SEQ ID NO: 22848 - protein, 9 aa, Artificial Sequence
  source: /note="Description of Artificial Sequence: Synthetic peptide"
QKREMRRLL

SEQ ID NO: 22849 - protein, 9 aa, Artificial Sequence
  source: /note="Description of Artificial Sequence: Synthetic peptide"
RLLHFATCW

SEQ ID NO: 22850 - protein, 9 aa, Artificial Sequence
  source: /note="Description of Artificial Sequence: Synthetic peptide"
SKTTSSLAM

SEQ ID NO: 22851 - protein, 9 aa, Artificial Sequence
  source: /note="Description of Artificial Sequence: Synthetic peptide"
SSLAMSGVL

SEQ ID NO: 22852 - protein, 9 aa, Artificial Sequence
  source: /note="Description of Artificial Sequence: Synthetic peptide"
LAMSGVLSP

SEQ ID NO: 22853 - protein, 10 aa, Artificial Sequence
  source: /note="Description of Artificial Sequence: Synthetic peptide"
TLLPMAMSCL

SEQ ID NO: 22854 - protein, 10 aa, Artificial Sequence
  source: /note="Description of Artificial Sequence: Synthetic peptide"
RLLHFATCWI

SEQ ID NO: 22855 - protein, 10 aa, Artificial Sequence
  source: /note="Description of Artificial Sequence: Synthetic peptide"
LAMSGVLSPL

SEQ ID NO: 22856 - protein, 10 aa, Artificial Sequence
  source: /note="Description of Artificial Sequence: Synthetic peptide"
AMSGVLSPLA

SEQ ID NO: 22857 - protein, 10 aa, Artificial Sequence
  source: /note="Description of Artificial Sequence: Synthetic peptide"
KTMPPQVPPA

SEQ ID NO: 22858 - protein, 10 aa, Artificial Sequence
  source: /note="Description of Artificial Sequence: Synthetic peptide"
AMATERMRRL

SEQ ID NO: 22859 - protein, 10 aa, Artificial Sequence
  source: /note="Description of Artificial Sequence: Synthetic peptide"
ALTSKTTSSL

SEQ ID NO: 22860 - protein, 10 aa, Artificial Sequence
  source: /note="Description of Artificial Sequence: Synthetic peptide"
TTSSLAMSGV

SEQ ID NO: 22861 - protein, 10 aa, Artificial Sequence
  source: /note="Description of Artificial Sequence: Synthetic peptide"
MAMSCLRSQK

SEQ ID NO: 22862 - protein, 10 aa, Artificial Sequence
  source: /note="Description of Artificial Sequence: Synthetic peptide"
ISFDLALTSK

SEQ ID NO: 22863 - protein, 10 aa, Artificial Sequence
  source: /note="Description of Artificial Sequence: Synthetic peptide"
ATERMRRLAR

SEQ ID NO: 22864 - protein, 10 aa, Artificial Sequence
  source: /note="Description of Artificial Sequence: Synthetic peptide"
RMRRLARTAG

SEQ ID NO: 22865 - protein, 10 aa, Artificial Sequence
  source: /note="Description of Artificial Sequence: Synthetic peptide"
CLRSQKREMR

SEQ ID NO: 22866 - protein, 10 aa, Artificial Sequence
  source: /note="Description of Artificial Sequence: Synthetic peptide"
RSQKREMRRL

SEQ ID NO: 22867 - protein, 10 aa, Artificial Sequence
  source: /note="Description of Artificial Sequence: Synthetic peptide"
SQKREMRRLL

SEQ ID NO: 22868 - protein, 10 aa, Artificial Sequence
  source: /note="Description of Artificial Sequence: Synthetic peptide"
TSKTTSSLAM

SEQ ID NO: 22869 - protein, 10 aa, Artificial Sequence
  source: /note="Description of Artificial Sequence: Synthetic peptide"
RTAGFLQPRW

SEQ ID NO: 22870 - protein, 10 aa, Artificial Sequence
  source: /note="Description of Artificial Sequence: Synthetic peptide"
LLPMAMSCLR

SEQ ID NO: 22871 - protein, 10 aa, Artificial Sequence
  source: /note="Description of Artificial Sequence: Synthetic peptide"
AMSCLRSQKR

SEQ ID NO: 22872 - protein, 10 aa, Artificial Sequence
  source: /note="Description of Artificial Sequence: Synthetic peptide"
QVPPAPMPPA

SEQ ID NO: 22873 - protein, 10 aa, Artificial Sequence
  source: /note="Description of Artificial Sequence: Synthetic peptide"
FATCWISFDL

SEQ ID NO: 22874 - protein, 10 aa, Artificial Sequence
  source: /note="Description of Artificial Sequence: Synthetic peptide"
LTSKTTSSLA

SEQ ID NO: 22875 - protein, 10 aa, Artificial Sequence
  source: /note="Description of Artificial Sequence: Synthetic peptide"
MPPQVPPAPM

SEQ ID NO: 22876 - protein, 10 aa, Artificial Sequence
  source: /note="Description of Artificial Sequence: Synthetic peptide"
VPPAPMPPAM

SEQ ID NO: 22877 - protein, 10 aa, Artificial Sequence
  source: /note="Description of Artificial Sequence: Synthetic peptide"
MPPAMATERM

SEQ ID NO: 22878 - protein, 10 aa, Artificial Sequence
  source: /note="Description of Artificial Sequence: Synthetic peptide"
QPRWAPGPTL

SEQ ID NO: 22879 - protein, 10 aa, Artificial Sequence
  source: /note="Description of Artificial Sequence: Synthetic peptide"
SPLAQSTSGM

SEQ ID NO: 22880 - protein, 10 aa, Artificial Sequence
  source: /note="Description of Artificial Sequence: Synthetic peptide"
MRRLARTAGF

SEQ ID NO: 22881 - protein, 10 aa, Artificial Sequence
  source: /note="Description of Artificial Sequence: Synthetic peptide"
EMRRLLHFAT

SEQ ID NO: 22882 - protein, 10 aa, Artificial Sequence
  source: /note="Description of Artificial Sequence: Synthetic peptide"
RRLARTAGFL

SEQ ID NO: 22883 - protein, 10 aa, Artificial Sequence
  source: /note="Description of Artificial Sequence: Synthetic peptide"
WAPGPTLLPM

SEQ ID NO: 22884 - protein, 10 aa, Artificial Sequence
  source: /note="Description of Artificial Sequence: Synthetic peptide"
KREMRRLLHF

SEQ ID NO: 22885 - protein, 10 aa, Artificial Sequence
  source: /note="Description of Artificial Sequence: Synthetic peptide"
REMRRLLHFA

SEQ ID NO: 22886 - protein, 10 aa, Artificial Sequence
  source: /note="Description of Artificial Sequence: Synthetic peptide"
RRLLHFATCW

SEQ ID NO: 22887 - protein, 10 aa, Artificial Sequence
  source: /note="Description of Artificial Sequence: Synthetic peptide"
LHFATCWISF

SEQ ID NO: 22888 - protein, 10 aa, Artificial Sequence
  source: /note="Description of Artificial Sequence: Synthetic peptide"
AQSTSGMRST

SEQ ID NO: 22889 - protein, 10 aa, Artificial Sequence
  source: /note="Description of Artificial Sequence: Synthetic peptide"
LPMAMSCLRS

SEQ ID NO: 22890 - protein, 9 aa, Artificial Sequence
  source: /note="Description of Artificial Sequence: Synthetic peptide"
ILCATYVKV

SEQ ID NO: 22891 - protein, 9 aa, Artificial Sequence
  source: /note="Description of Artificial Sequence: Synthetic peptide"
KILCATYVK

SEQ ID NO: 22892 - protein, 9 aa, Artificial Sequence
  source: /note="Description of Artificial Sequence: Synthetic peptide"
KVNIRDIDK

SEQ ID NO: 22893 - protein, 9 aa, Artificial Sequence
  source: /note="Description of Artificial Sequence: Synthetic peptide"
ATYVKVNIR

SEQ ID NO: 22894 - protein, 10 aa, Artificial Sequence
  source: /note="Description of Artificial Sequence: Synthetic peptide"
KILCATYVKV

SEQ ID NO: 22895 - protein, 10 aa, Artificial Sequence
  source: /note="Description of Artificial Sequence: Synthetic peptide"
TYVKVNIRDI

SEQ ID NO: 22896 - protein, 10 aa, Artificial Sequence
  source: /note="Description of Artificial Sequence: Synthetic peptide"
CATYVKVNIR

SEQ ID NO: 22897 - protein, 9 aa, Artificial Sequence
  source: /note="Description of Artificial Sequence: Synthetic peptide"
YVNVNIRGI

SEQ ID NO: 22898 - protein, 9 aa, Artificial Sequence
  source: /note="Description of Artificial Sequence: Synthetic peptide"
NVNIRGIDK

SEQ ID NO: 22899 - protein, 9 aa, Artificial Sequence
  source: /note="Description of Artificial Sequence: Synthetic peptide"
NIRGIDKIY

SEQ ID NO: 22900 - protein, 10 aa, Artificial Sequence
  source: /note="Description of Artificial Sequence: Synthetic peptide"
TYVNVNIRGI

SEQ ID NO: 22901 - protein, 10 aa, Artificial Sequence
  source: /note="Description of Artificial Sequence: Synthetic peptide"
VNIRGIDKIY

SEQ ID NO: 22902 - protein, 9 aa, Artificial Sequence
  source: /note="Description of Artificial Sequence: Synthetic peptide"
VTLECLHEA

SEQ ID NO: 22903 - protein, 9 aa, Artificial Sequence
  source: /note="Description of Artificial Sequence: Synthetic peptide"
LECLHEATL

SEQ ID NO: 22904 - protein, 10 aa, Artificial Sequence
  source: /note="Description of Artificial Sequence: Synthetic peptide"
CLHEATLITI

SEQ ID NO: 22905 - protein, 10 aa, Artificial Sequence
  source: /note="Description of Artificial Sequence: Synthetic peptide"
HEATLITIKH

SEQ ID NO: 22906 - protein, 10 aa, Artificial Sequence
  source: /note="Description of Artificial Sequence: Synthetic peptide"
LECLHEATLI

SEQ ID NO: 22907 - protein, 9 aa, Artificial Sequence
  source: /note="Description of Artificial Sequence: Synthetic peptide"
IVTLECLRK

SEQ ID NO: 22908 - protein, 9 aa, Artificial Sequence
  source: /note="Description of Artificial Sequence: Synthetic peptide"
LRKATLITI

SEQ ID NO: 22909 - protein, 9 aa, Artificial Sequence
  source: /note="Description of Artificial Sequence: Synthetic peptide"
LECLRKATL

SEQ ID NO: 22910 - protein, 10 aa, Artificial Sequence
  source: /note="Description of Artificial Sequence: Synthetic peptide"
CLRKATLITI

SEQ ID NO: 22911 - protein, 10 aa, Artificial Sequence
  source: /note="Description of Artificial Sequence: Synthetic peptide"
MIVTLECLRK

SEQ ID NO: 22912 - protein, 10 aa, Artificial Sequence
  source: /note="Description of Artificial Sequence: Synthetic peptide"
RKATLITIKH

SEQ ID NO: 22913 - protein, 10 aa, Artificial Sequence
  source: /note="Description of Artificial Sequence: Synthetic peptide"
LECLRKATLI

SEQ ID NO: 22914 - protein, 9 aa, Artificial Sequence
  source: /note="Description of Artificial Sequence: Synthetic peptide"
KEEHRPLAW

SEQ ID NO: 22915 - protein, 10 aa, Artificial Sequence
  source: /note="Description of Artificial Sequence: Synthetic peptide"
GAKEEHRPLA

SEQ ID NO: 22916 - protein, 10 aa, Artificial Sequence
  source: /note="Description of Artificial Sequence: Synthetic peptide"
RPLAWGNINL

SEQ ID NO: 22917 - protein, 10 aa, Artificial Sequence
  source: /note="Description of Artificial Sequence: Synthetic peptide"
AKEEHRPLAW

SEQ ID NO: 22918 - protein, 9 aa, Artificial Sequence
  source: /note="Description of Artificial Sequence: Synthetic peptide"
ALNLWLNPI

SEQ ID NO: 22919 - protein, 9 aa, Artificial Sequence
  source: /note="Description of Artificial Sequence: Synthetic peptide"
NLWLNPIGV

SEQ ID NO: 22920 - protein, 9 aa, Artificial Sequence
  source: /note="Description of Artificial Sequence: Synthetic peptide"
GKMALNLWL

SEQ ID NO: 22921 - protein, 10 aa, Artificial Sequence
  source: /note="Description of Artificial Sequence: Synthetic peptide"
MALNLWLNPI

SEQ ID NO: 22922 - protein, 9 aa, Artificial Sequence
  source: /note="Description of Artificial Sequence: Synthetic peptide"
GLKDLLNPI

SEQ ID NO: 22923 - protein, 9 aa, Artificial Sequence
  source: /note="Description of Artificial Sequence: Synthetic peptide"
LWPVPHGLK

SEQ ID NO: 22924 - protein, 9 aa, Artificial Sequence
  source: /note="Description of Artificial Sequence: Synthetic peptide"
VPHGLKDLL

SEQ ID NO: 22925 - protein, 10 aa, Artificial Sequence
  source: /note="Description of Artificial Sequence: Synthetic peptide"
NLWPVPHGLK

SEQ ID NO: 22926 - protein, 10 aa, Artificial Sequence
  source: /note="Description of Artificial Sequence: Synthetic peptide"
WPVPHGLKDL

SEQ ID NO: 22927 - protein, 10 aa, Artificial Sequence
  source: /note="Description of Artificial Sequence: Synthetic peptide"
HGLKDLLNPI

SEQ ID NO: 22928 - protein, 9 aa, Artificial Sequence
  source: /note="Description of Artificial Sequence: Synthetic peptide"
GLEDLAEPY

SEQ ID NO: 22929 - protein, 9 aa, Artificial Sequence
  source: /note="Description of Artificial Sequence: Synthetic peptide"
DLAEPYWCY

SEQ ID NO: 22930 - protein, 9 aa, Artificial Sequence
  source: /note="Description of Artificial Sequence: Synthetic peptide"
AEPYWCYWI

SEQ ID NO: 22931 - protein, 9 aa, Artificial Sequence
  source: /note="Description of Artificial Sequence: Synthetic peptide"
LAEPYWCYW

SEQ ID NO: 22932 - protein, 10 aa, Artificial Sequence
  source: /note="Description of Artificial Sequence: Synthetic peptide"
HGLEDLAEPY

SEQ ID NO: 22933 - protein, 9 aa, Artificial Sequence
  source: /note="Description of Artificial Sequence: Synthetic peptide"
ISTRDPLSK

SEQ ID NO: 22934 - protein, 9 aa, Artificial Sequence
  source: /note="Description of Artificial Sequence: Synthetic peptide"
STRDPLSKI

SEQ ID NO: 22935 - protein, 9 aa, Artificial Sequence
  source: /note="Description of Artificial Sequence: Synthetic peptide"
LSKITEQEK

SEQ ID NO: 22936 - protein, 10 aa, Artificial Sequence
  source: /note="Description of Artificial Sequence: Synthetic peptide"
AISTRDPLSK

SEQ ID NO: 22937 - protein, 10 aa, Artificial Sequence
  source: /note="Description of Artificial Sequence: Synthetic peptide"
SKITEQEKDF

SEQ ID NO: 22938 - protein, 10 aa, Artificial Sequence
  source: /note="Description of Artificial Sequence: Synthetic peptide"
SEITKQEKDF

SEQ ID NO: 22939 - protein, 10 aa, Artificial Sequence
  source: /note="Description of Artificial Sequence: Synthetic peptide"
KQEKDFLWSH

SEQ ID NO: 22940 - protein, 9 aa, Artificial Sequence
  source: /note="Description of Artificial Sequence: Synthetic peptide"
TAQEKDFLW

SEQ ID NO: 22941 - protein, 10 aa, Artificial Sequence
  source: /note="Description of Artificial Sequence: Synthetic peptide"
SEITAQEKDF

SEQ ID NO: 22942 - protein, 10 aa, Artificial Sequence
  source: /note="Description of Artificial Sequence: Synthetic peptide"
AQEKDFLWSH

SEQ ID NO: 22943 - protein, 10 aa, Artificial Sequence
  source: /note="Description of Artificial Sequence: Synthetic peptide"
ITAQEKDFLW

SEQ ID NO: 22944 - protein, 10 aa, Artificial Sequence
  source: /note="Description of Artificial Sequence: Synthetic peptide"
SEITGQEKDF

SEQ ID NO: 22945 - protein, 10 aa, Artificial Sequence
  source: /note="Description of Artificial Sequence: Synthetic peptide"
GQEKDFLWSH

SEQ ID NO: 22946 - protein, 9 aa, Artificial Sequence
  source: /note="Description of Artificial Sequence: Synthetic peptide"
KEKDFLWSH

SEQ ID NO: 22947 - protein, 9 aa, Artificial Sequence
  source: /note="Description of Artificial Sequence: Synthetic peptide"
TEKEKDFLW

SEQ ID NO: 22948 - protein, 10 aa, Artificial Sequence
  source: /note="Description of Artificial Sequence: Synthetic peptide"
SEITEKEKDF

SEQ ID NO: 22949 - protein, 10 aa, Artificial Sequence
  source: /note="Description of Artificial Sequence: Synthetic peptide"
EITEPEKDFL

SEQ ID NO: 22950 - protein, 10 aa, Artificial Sequence
  source: /note="Description of Artificial Sequence: Synthetic peptide"
SEITEPEKDF

SEQ ID NO: 22951 - protein, 10 aa, Artificial Sequence
  source: /note="Description of Artificial Sequence: Synthetic peptide"
EPEKDFLWSH

SEQ ID NO: 22952 - protein, 9 aa, Artificial Sequence
  source: /note="Description of Artificial Sequence: Synthetic peptide"
REKDFLWSH

SEQ ID NO: 22953 - protein, 9 aa, Artificial Sequence
  source: /note="Description of Artificial Sequence: Synthetic peptide"
TEREKDFLW

SEQ ID NO: 22954 - protein, 10 aa, Artificial Sequence
  source: /note="Description of Artificial Sequence: Synthetic peptide"
SEITEREKDF

SEQ ID NO: 22955 - protein, 10 aa, Artificial Sequence
  source: /note="Description of Artificial Sequence: Synthetic peptide"
VPPRPSSGEL

SEQ ID NO: 22956 - protein, 9 aa, Artificial Sequence
  source: /note="Description of Artificial Sequence: Synthetic peptide"
KTQKVQMKF

SEQ ID NO: 22957 - protein, 10 aa, Artificial Sequence
  source: /note="Description of Artificial Sequence: Synthetic peptide"
KDKTQKVQMK

SEQ ID NO: 22958 - protein, 10 aa, Artificial Sequence
  source: /note="Description of Artificial Sequence: Synthetic peptide"
KTQKVQMKFL

SEQ ID NO: 22959 - protein, 10 aa, Artificial Sequence
  source: /note="Description of Artificial Sequence: Synthetic peptide"
KKDKTQKVQM

SEQ ID NO: 22960 - protein, 9 aa, Artificial Sequence
  source: /note="Description of Artificial Sequence: Synthetic peptide"
RQLCDLRLF

SEQ ID NO: 22961 - protein, 9 aa, Artificial Sequence
  source: /note="Description of Artificial Sequence: Synthetic peptide"
ETRQLCDLR

SEQ ID NO: 22962 - protein, 10 aa, Artificial Sequence
  source: /note="Description of Artificial Sequence: Synthetic peptide"
EEFFDETRQL

SEQ ID NO: 22963 - protein, 9 aa, Artificial Sequence
  source: /note="Description of Artificial Sequence: Synthetic peptide"
QLFQPFLKV

SEQ ID NO: 22964 - protein, 9 aa, Artificial Sequence
  source: /note="Description of Artificial Sequence: Synthetic peptide"
LQLFQPFLK

SEQ ID NO: 22965 - protein, 9 aa, Artificial Sequence
  source: /note="Description of Artificial Sequence: Synthetic peptide"
RRLCDLQLF

SEQ ID NO: 22966 - protein, 9 aa, Artificial Sequence
  source: /note="Description of Artificial Sequence: Synthetic peptide"
CDLQLFQPF

SEQ ID NO: 22967 - protein, 10 aa, Artificial Sequence
  source: /note="Description of Artificial Sequence: Synthetic peptide"
LQLFQPFLKV

SEQ ID NO: 22968 - protein, 10 aa, Artificial Sequence
  source: /note="Description of Artificial Sequence: Synthetic peptide"
QLFQPFLKVI

SEQ ID NO: 22969 - protein, 10 aa, Artificial Sequence
  source: /note="Description of Artificial Sequence: Synthetic peptide"
DLQLFQPFLK

SEQ ID NO: 22970 - protein, 10 aa, Artificial Sequence
  source: /note="Description of Artificial Sequence: Synthetic peptide"
TRRLCDLQLF

SEQ ID NO: 22971 - protein, 10 aa, Artificial Sequence
  source: /note="Description of Artificial Sequence: Synthetic peptide"
LCDLQLFQPF

SEQ ID NO: 22972 - protein, 10 aa, Artificial Sequence
  source: /note="Description of Artificial Sequence: Synthetic peptide"
CDLQLFQPFL

SEQ ID NO: 22973 - protein, 9 aa, Artificial Sequence
  source: /note="Description of Artificial Sequence: Synthetic peptide"
NLFINLFSI

SEQ ID NO: 22974 - protein, 9 aa, Artificial Sequence
  source: /note="Description of Artificial Sequence: Synthetic peptide"
FINLFSIML

SEQ ID NO: 22975 - protein, 9 aa, Artificial Sequence
  source: /note="Description of Artificial Sequence: Synthetic peptide"
LFINLFSIM

SEQ ID NO: 22976 - protein, 9 aa, Artificial Sequence
  source: /note="Description of Artificial Sequence: Synthetic peptide"
FSIMLGSGM

SEQ ID NO: 22977 - protein, 10 aa, Artificial Sequence
  source: /note="Description of Artificial Sequence: Synthetic peptide"
IMLGSGMPEL

SEQ ID NO: 22978 - protein, 10 aa, Artificial Sequence
  source: /note="Description of Artificial Sequence: Synthetic peptide"
NLFINLFSIM

SEQ ID NO: 22979 - protein, 10 aa, Artificial Sequence
  source: /note="Description of Artificial Sequence: Synthetic peptide"
LFINLFSIML

SEQ ID NO: 22980 - protein, 10 aa, Artificial Sequence
  source: /note="Description of Artificial Sequence: Synthetic peptide"
LFSIMLGSGM

SEQ ID NO: 22981 - protein, 9 aa, Artificial Sequence
  source: /note="Description of Artificial Sequence: Synthetic peptide"
ALEYFMKQV

SEQ ID NO: 22982 - protein, 9 aa, Artificial Sequence
  source: /note="Description of Artificial Sequence: Synthetic peptide"
FMKQVNDAH

SEQ ID NO: 22983 - protein, 9 aa, Artificial Sequence
  source: /note="Description of Artificial Sequence: Synthetic peptide"
MKQVNDAHH

SEQ ID NO: 22984 - protein, 10 aa, Artificial Sequence
  source: /note="Description of Artificial Sequence: Synthetic peptide"
EALEYFMKQV

SEQ ID NO: 22985 - protein, 10 aa, Artificial Sequence
  source: /note="Description of Artificial Sequence: Synthetic peptide"
FMKQVNDAHH

SEQ ID NO: 22986 - protein, 9 aa, Artificial Sequence
  source: /note="Description of Artificial Sequence: Synthetic peptide"
FMKQINDAH

SEQ ID NO: 22987 - protein, 9 aa, Artificial Sequence
  source: /note="Description of Artificial Sequence: Synthetic peptide"
KQINDAHHG

SEQ ID NO: 22988 - protein, 10 aa, Artificial Sequence
  source: /note="Description of Artificial Sequence: Synthetic peptide"
EALEYFMKQI

SEQ ID NO: 22989 - protein, 10 aa, Artificial Sequence
  source: /note="Description of Artificial Sequence: Synthetic peptide"
FMKQINDAHH

SEQ ID NO: 22990 - protein, 10 aa, Artificial Sequence
  source: /note="Description of Artificial Sequence: Synthetic peptide"
KQINDAHHGG

SEQ ID NO: 22991 - protein, 9 aa, Artificial Sequence
  source: /note="Description of Artificial Sequence: Synthetic peptide"
MYDAHHGGW

SEQ ID NO: 22992 - protein, 9 aa, Artificial Sequence
  source: /note="Description of Artificial Sequence: Synthetic peptide"
FMKQMYDAH

SEQ ID NO: 22993 - protein, 9 aa, Artificial Sequence
  source: /note="Description of Artificial Sequence: Synthetic peptide"
LEYFMKQMY

SEQ ID NO: 22994 - protein, 9 aa, Artificial Sequence
  source: /note="Description of Artificial Sequence: Synthetic peptide"
MKQMYDAHH

SEQ ID NO: 22995 - protein, 9 aa, Artificial Sequence
  source: /note="Description of Artificial Sequence: Synthetic peptide"
KQMYDAHHG

SEQ ID NO: 22996 - protein, 10 aa, Artificial Sequence
  source: /note="Description of Artificial Sequence: Synthetic peptide"
ALEYFMKQMY

SEQ ID NO: 22997 - protein, 10 aa, Artificial Sequence
  source: /note="Description of Artificial Sequence: Synthetic peptide"
FMKQMYDAHH

SEQ ID NO: 22998 - protein, 10 aa, Artificial Sequence
  source: /note="Description of Artificial Sequence: Synthetic peptide"
QMYDAHHGGW

SEQ ID NO: 22999 - protein, 10 aa, Artificial Sequence
  source: /note="Description of Artificial Sequence: Synthetic peptide"
KQMYDAHHGG

SEQ ID NO: 23000 - protein, 9 aa, Artificial Sequence
  source: /note="Description of Artificial Sequence: Synthetic peptide"
FMKQMKDAH

SEQ ID NO: 23001 - protein, 9 aa, Artificial Sequence
  source: /note="Description of Artificial Sequence: Synthetic peptide"
KQMKDAHHG

SEQ ID NO: 23002 - protein, 9 aa, Artificial Sequence
  source: /note="Description of Artificial Sequence: Synthetic peptide"
MKDAHHGGW

SEQ ID NO: 23003 - protein, 10 aa, Artificial Sequence
  source: /note="Description of Artificial Sequence: Synthetic peptide"
ALEYFMKQMK

SEQ ID NO: 23004 - protein, 10 aa, Artificial Sequence
  source: /note="Description of Artificial Sequence: Synthetic peptide"
FMKQMKDAHH

SEQ ID NO: 23005 - protein, 10 aa, Artificial Sequence
  source: /note="Description of Artificial Sequence: Synthetic peptide"
KQMKDAHHGG

SEQ ID NO: 23006 - protein, 10 aa, Artificial Sequence
  source: /note="Description of Artificial Sequence: Synthetic peptide"
QMKDAHHGGW

SEQ ID NO: 23007 - protein, 9 aa, Artificial Sequence
  source: /note="Description of Artificial Sequence: Synthetic peptide"
FMKQMNDAR

SEQ ID NO: 23008 - protein, 9 aa, Artificial Sequence
  source: /note="Description of Artificial Sequence: Synthetic peptide"
KQMNDARHG

SEQ ID NO: 23009 - protein, 9 aa, Artificial Sequence
  source: /note="Description of Artificial Sequence: Synthetic peptide"
RHGGWTTKM

SEQ ID NO: 23010 - protein, 10 aa, Artificial Sequence
  source: /note="Description of Artificial Sequence: Synthetic peptide"
YFMKQMNDAR

SEQ ID NO: 23011 - protein, 10 aa, Artificial Sequence
  source: /note="Description of Artificial Sequence: Synthetic peptide"
FMKQMNDARH

SEQ ID NO: 23012 - protein, 10 aa, Artificial Sequence
  source: /note="Description of Artificial Sequence: Synthetic peptide"
KQMNDARHGG

SEQ ID NO: 23013 - protein, 10 aa, Artificial Sequence
  source: /note="Description of Artificial Sequence: Synthetic peptide"
QMNDARHGGW

SEQ ID NO: 23014 - protein, 10 aa, Artificial Sequence
  source: /note="Description of Artificial Sequence: Synthetic peptide"
ARHGGWTTKM

SEQ ID NO: 23015 - protein, 9 aa, Artificial Sequence
  source: /note="Description of Artificial Sequence: Synthetic peptide"
FMKQMNDAL

SEQ ID NO: 23016 - protein, 9 aa, Artificial Sequence
  source: /note="Description of Artificial Sequence: Synthetic peptide"
ALHGGWTTK

SEQ ID NO: 23017 - protein, 9 aa, Artificial Sequence
  source: /note="Description of Artificial Sequence: Synthetic peptide"
KQMNDALHG

SEQ ID NO: 23018 - protein, 9 aa, Artificial Sequence
  source: /note="Description of Artificial Sequence: Synthetic peptide"
LHGGWTTKM

SEQ ID NO: 23019 - protein, 10 aa, Artificial Sequence
  source: /note="Description of Artificial Sequence: Synthetic peptide"
ALHGGWTTKM

SEQ ID NO: 23020 - protein, 10 aa, Artificial Sequence
  source: /note="Description of Artificial Sequence: Synthetic peptide"
YFMKQMNDAL

SEQ ID NO: 23021 - protein, 10 aa, Artificial Sequence
  source: /note="Description of Artificial Sequence: Synthetic peptide"
DALHGGWTTK

SEQ ID NO: 23022 - protein, 10 aa, Artificial Sequence
  source: /note="Description of Artificial Sequence: Synthetic peptide"
FMKQMNDALH

SEQ ID NO: 23023 - protein, 10 aa, Artificial Sequence
  source: /note="Description of Artificial Sequence: Synthetic peptide"
KQMNDALHGG

SEQ ID NO: 23024 - protein, 10 aa, Artificial Sequence
  source: /note="Description of Artificial Sequence: Synthetic peptide"
QMNDALHGGW

SEQ ID NO: 23025 - protein, 9 aa, Artificial Sequence
  source: /note="Description of Artificial Sequence: Synthetic peptide"
FLKVIEPVV

SEQ ID NO: 23026 - protein, 9 aa, Artificial Sequence
  source: /note="Description of Artificial Sequence: Synthetic peptide"
KVIEPVVNR

SEQ ID NO: 23027 - protein, 10 aa, Artificial Sequence
  source: /note="Description of Artificial Sequence: Synthetic peptide"
HEEKILNREI

SEQ ID NO: 23028 - protein, 9 aa, Artificial Sequence
  source: /note="Description of Artificial Sequence: Synthetic peptide"
REKILNREI

SEQ ID NO: 23029 - protein, 10 aa, Artificial Sequence
  source: /note="Description of Artificial Sequence: Synthetic peptide"
REEEILNREI

SEQ ID NO: 23030 - protein, 10 aa, Artificial Sequence
  source: /note="Description of Artificial Sequence: Synthetic peptide"
EEILNREIGF

SEQ ID NO: 23031 - protein, 9 aa, Artificial Sequence
  source: /note="Description of Artificial Sequence: Synthetic peptide"
REEILNREI

SEQ ID NO: 23032 - protein, 10 aa, Artificial Sequence
  source: /note="Description of Artificial Sequence: Synthetic peptide"
EEILNREIGF

SEQ ID NO: 23033 - protein, 9 aa, Artificial Sequence
  source: /note="Description of Artificial Sequence: Synthetic peptide"
KSKKADRPI

SEQ ID NO: 23034 - protein, 9 aa, Artificial Sequence
  source: /note="Description of Artificial Sequence: Synthetic peptide"
RPIAWANLM

SEQ ID NO: 23035 - protein, 9 aa, Artificial Sequence
  source: /note="Description of Artificial Sequence: Synthetic peptide"
KKADRPIAW

SEQ ID NO: 23036 - protein, 10 aa, Artificial Sequence
  source: /note="Description of Artificial Sequence: Synthetic peptide"
KSKKADRPIA

SEQ ID NO: 23037 - protein, 10 aa, Artificial Sequence
  source: /note="Description of Artificial Sequence: Synthetic peptide"
RPIAWANLML

SEQ ID NO: 23038 - protein, 10 aa, Artificial Sequence
  source: /note="Description of Artificial Sequence: Synthetic peptide"
KKSKKADRPI

SEQ ID NO: 23039 - protein, 10 aa, Artificial Sequence
  source: /note="Description of Artificial Sequence: Synthetic peptide"
SKKADRPIAW

SEQ ID NO: 23040 - protein, 10 aa, Artificial Sequence
  source: /note="Description of Artificial Sequence: Synthetic peptide"
ADRPIAWANL

SEQ ID NO: 23041 - protein, 9 aa, Artificial Sequence
  source: /note="Description of Artificial Sequence: Synthetic peptide"
LIGYDVTDI

SEQ ID NO: 23042 - protein, 10 aa, Artificial Sequence
  source: /note="Description of Artificial Sequence: Synthetic peptide"
ALIGYDVTDI

SEQ ID NO: 23043 - protein, 9 aa, Artificial Sequence
  source: /note="Description of Artificial Sequence: Synthetic peptide"
TLRKGRNNK

SEQ ID NO: 23044 - protein, 9 aa, Artificial Sequence
  source: /note="Description of Artificial Sequence: Synthetic peptide"
KGRNNKLIK

SEQ ID NO: 23045 - protein, 9 aa, Artificial Sequence
  source: /note="Description of Artificial Sequence: Synthetic peptide"
YTLTLRKGR

SEQ ID NO: 23046 - protein, 9 aa, Artificial Sequence
  source: /note="Description of Artificial Sequence: Synthetic peptide"
RNNKLIKIF

SEQ ID NO: 23047 - protein, 10 aa, Artificial Sequence
  source: /note="Description of Artificial Sequence: Synthetic peptide"
LTLRKGRNNK

SEQ ID NO: 23048 - protein, 10 aa, Artificial Sequence
  source: /note="Description of Artificial Sequence: Synthetic peptide"
TLRKGRNNKL

SEQ ID NO: 23049 - protein, 10 aa, Artificial Sequence
  source: /note="Description of Artificial Sequence: Synthetic peptide"
KGRNNKLIKI

SEQ ID NO: 23050 - protein, 10 aa, Artificial Sequence
  source: /note="Description of Artificial Sequence: Synthetic peptide"
GRNNKLIKIF

SEQ ID NO: 23051 - protein, 9 aa, Artificial Sequence
  source: /note="Description of Artificial Sequence: Synthetic peptide"
KGGNNNLIK

SEQ ID NO: 23052 - protein, 9 aa, Artificial Sequence
  source: /note="Description of Artificial Sequence: Synthetic peptide"
NNLIKIFHR

SEQ ID NO: 23053 - protein, 9 aa, Artificial Sequence
  source: /note="Description of Artificial Sequence: Synthetic peptide"
RKGGNNNLI

SEQ ID NO: 23054 - protein, 9 aa, Artificial Sequence
  source: /note="Description of Artificial Sequence: Synthetic peptide"
GNNNLIKIF

SEQ ID NO: 23055 - protein, 10 aa, Artificial Sequence
  source: /note="Description of Artificial Sequence: Synthetic peptide"
TLRKGGNNNL

SEQ ID NO: 23056 - protein, 10 aa, Artificial Sequence
  source: /note="Description of Artificial Sequence: Synthetic peptide"
NNNLIKIFHR

SEQ ID NO: 23057 - protein, 10 aa, Artificial Sequence
  source: /note="Description of Artificial Sequence: Synthetic peptide"
GGNNNLIKIF

SEQ ID NO: 23058 - protein, 9 aa, Artificial Sequence
  source: /note="Description of Artificial Sequence: Synthetic peptide"
RMNSIIQLR

SEQ ID NO: 23059 - protein, 9 aa, Artificial Sequence
  source: /note="Description of Artificial Sequence: Synthetic peptide"
MNSIIQLRK

SEQ ID NO: 23060 - protein, 9 aa, Artificial Sequence
  source: /note="Description of Artificial Sequence: Synthetic peptide"
SIIQLRKTR

SEQ ID NO: 23061 - protein, 9 aa, Artificial Sequence
  source: /note="Description of Artificial Sequence: Synthetic peptide"
KRMNSIIQL

SEQ ID NO: 23062 - protein, 10 aa, Artificial Sequence
  source: /note="Description of Artificial Sequence: Synthetic peptide"
RMNSIIQLRK

SEQ ID NO: 23063 - protein, 10 aa, Artificial Sequence
  source: /note="Description of Artificial Sequence: Synthetic peptide"
NSIIQLRKTR

SEQ ID NO: 23064 - protein, 9 aa, Artificial Sequence
  source: /note="Description of Artificial Sequence: Synthetic peptide"
SSQASGPAR

SEQ ID NO: 23065 - protein, 9 aa, Artificial Sequence
  source: /note="Description of Artificial Sequence: Synthetic peptide"
RSRHLLTSF

SEQ ID NO: 23066 - protein, 9 aa, Artificial Sequence
  source: /note="Description of Artificial Sequence: Synthetic peptide"
GPARSRHLL

SEQ ID NO: 23067 - protein, 10 aa, Artificial Sequence
  source: /note="Description of Artificial Sequence: Synthetic peptide"
ASSQASGPAR

SEQ ID NO: 23068 - protein, 10 aa, Artificial Sequence
  source: /note="Description of Artificial Sequence: Synthetic peptide"
RSRHLLTSFV

SEQ ID NO: 23069 - protein, 10 aa, Artificial Sequence
  source: /note="Description of Artificial Sequence: Synthetic peptide"
ARSRHLLTSF

SEQ ID NO: 23070 - protein, 9 aa, Artificial Sequence
  source: /note="Description of Artificial Sequence: Synthetic peptide"
SPPERDPVL

SEQ ID NO: 23071 - protein, 9 aa, Artificial Sequence
  source: /note="Description of Artificial Sequence: Synthetic peptide"
RHCHNCGVF

SEQ ID NO: 23072 - protein, 10 aa, Artificial Sequence
  source: /note="Description of Artificial Sequence: Synthetic peptide"
HCHNCGVFHR

SEQ ID NO: 23073 - protein, 10 aa, Artificial Sequence
  source: /note="Description of Artificial Sequence: Synthetic peptide"
VRHCHNCGVF

SEQ ID NO: 23074 - protein, 9 aa, Artificial Sequence
  source: /note="Description of Artificial Sequence: Synthetic peptide"
FIDFGSGAL

SEQ ID NO: 23075 - protein, 9 aa, Artificial Sequence
  source: /note="Description of Artificial Sequence: Synthetic peptide"
RGELKFIDF

SEQ ID NO: 23076 - protein, 10 aa, Artificial Sequence
  source: /note="Description of Artificial Sequence: Synthetic peptide"
FIDFGSGALL

SEQ ID NO: 23077 - protein, 10 aa, Artificial Sequence
  source: /note="Description of Artificial Sequence: Synthetic peptide"
IDLNRGELKF

SEQ ID NO: 23078 - protein, 10 aa, Artificial Sequence
  source: /note="Description of Artificial Sequence: Synthetic peptide"
LKFIDFGSGA

SEQ ID NO: 23079 - protein, 10 aa, Artificial Sequence
  source: /note="Description of Artificial Sequence: Synthetic peptide"
KFIDFGSGAL

SEQ ID NO: 23080 - protein, 10 aa, Artificial Sequence
  source: /note="Description of Artificial Sequence: Synthetic peptide"
GELKFIDFGS

SEQ ID NO: 23081 - protein, 9 aa, Artificial Sequence
  source: /note="Description of Artificial Sequence: Synthetic peptide"
TVAKEASDK

SEQ ID NO: 23082 - protein, 9 aa, Artificial Sequence
  source: /note="Description of Artificial Sequence: Synthetic peptide"
KEASDKEKA

SEQ ID NO: 23083 - protein, 10 aa, Artificial Sequence
  source: /note="Description of Artificial Sequence: Synthetic peptide"
STVAKEASDK

SEQ ID NO: 23084 - protein, 10 aa, Artificial Sequence
  source: /note="Description of Artificial Sequence: Synthetic peptide"
VAKEASDKEK

SEQ ID NO: 23085 - protein, 9 aa, Artificial Sequence
  source: /note="Description of Artificial Sequence: Synthetic peptide"
VMHNMFSHR

SEQ ID NO: 23086 - protein, 9 aa, Artificial Sequence
  source: /note="Description of Artificial Sequence: Synthetic peptide"
LVMHNMFSH

SEQ ID NO: 23087 - protein, 9 aa, Artificial Sequence
  source: /note="Description of Artificial Sequence: Synthetic peptide"
SYMLVMHNM

SEQ ID NO: 23088 - protein, 9 aa, Artificial Sequence
  source: /note="Description of Artificial Sequence: Synthetic peptide"
YMLVMHNMF

SEQ ID NO: 23089 - protein, 9 aa, Artificial Sequence
  source: /note="Description of Artificial Sequence: Synthetic peptide"
MHNMFSHRL

SEQ ID NO: 23090 - protein, 10 aa, Artificial Sequence
  source: /note="Description of Artificial Sequence: Synthetic peptide"
VMHNMFSHRL

SEQ ID NO: 23091 - protein, 10 aa, Artificial Sequence
  source: /note="Description of Artificial Sequence: Synthetic peptide"
LVMHNMFSHR

SEQ ID NO: 23092 - protein, 10 aa, Artificial Sequence
  source: /note="Description of Artificial Sequence: Synthetic peptide"
SYMLVMHNMF

SEQ ID NO: 23093 - protein, 10 aa, Artificial Sequence
  source: /note="Description of Artificial Sequence: Synthetic peptide"
DSYMLVMHNM

SEQ ID NO: 23094 - protein, 10 aa, Artificial Sequence
  source: /note="Description of Artificial Sequence: Synthetic peptide"
HNMFSHRLPV

SEQ ID NO: 23095 - protein, 10 aa, Artificial Sequence
  source: /note="Description of Artificial Sequence: Synthetic peptide"
MLVMHNMFSH

SEQ ID NO: 23096 - protein, 9 aa, Artificial Sequence
  source: /note="Description of Artificial Sequence: Synthetic peptide"
AQMPPPMPA

SEQ ID NO: 23097 - protein, 9 aa, Artificial Sequence
  source: /note="Description of Artificial Sequence: Synthetic peptide"
QMPPPMPAL

SEQ ID NO: 23098 - protein, 9 aa, Artificial Sequence
  source: /note="Description of Artificial Sequence: Synthetic peptide"
CLSGACRTL

SEQ ID NO: 23099 - protein, 9 aa, Artificial Sequence
  source: /note="Description of Artificial Sequence: Synthetic peptide"
TLPETLRTA

SEQ ID NO: 23100 - protein, 9 aa, Artificial Sequence
  source: /note="Description of Artificial Sequence: Synthetic peptide"
RTVRRSSPR

SEQ ID NO: 23101 - protein, 9 aa, Artificial Sequence
  source: /note="Description of Artificial Sequence: Synthetic peptide"
ETLRTAPRK

SEQ ID NO: 23102 - protein, 9 aa, Artificial Sequence
  source: /note="Description of Artificial Sequence: Synthetic peptide"
RTAPRKSSL

SEQ ID NO: 23103 - protein, 9 aa, Artificial Sequence
  source: /note="Description of Artificial Sequence: Synthetic peptide"
RKSSLMPTK

SEQ ID NO: 23104 - protein, 9 aa, Artificial Sequence
  source: /note="Description of Artificial Sequence: Synthetic peptide"
KSSLMPTKA

SEQ ID NO: 23105 - protein, 9 aa, Artificial Sequence
  source: /note="Description of Artificial Sequence: Synthetic peptide"
SLMPTKASR

SEQ ID NO: 23106 - protein, 9 aa, Artificial Sequence
  source: /note="Description of Artificial Sequence: Synthetic peptide"
ASRTVRRSS

SEQ ID NO: 23107 - protein, 9 aa, Artificial Sequence
  source: /note="Description of Artificial Sequence: Synthetic peptide"
TVRRSSPRR

SEQ ID NO: 23108 - protein, 9 aa, Artificial Sequence
  source: /note="Description of Artificial Sequence: Synthetic peptide"
NMEGLCLPR

SEQ ID NO: 23109 - protein, 9 aa, Artificial Sequence
  source: /note="Description of Artificial Sequence: Synthetic peptide"
GPEAPQAQM

SEQ ID NO: 23110 - protein, 9 aa, Artificial Sequence
  source: /note="Description of Artificial Sequence: Synthetic peptide"
HPNMEGLCL

SEQ ID NO: 23111 - protein, 9 aa, Artificial Sequence
  source: /note="Description of Artificial Sequence: Synthetic peptide"
LPRACLSGA

SEQ ID NO: 23112 - protein, 9 aa, Artificial Sequence
  source: /note="Description of Artificial Sequence: Synthetic peptide"
MPTKASRTV

SEQ ID NO: 23113 - protein, 9 aa, Artificial Sequence
  source: /note="Description of Artificial Sequence: Synthetic peptide"
PQAQMPPPM

SEQ ID NO: 23114 - protein, 9 aa, Artificial Sequence
  source: /note="Description of Artificial Sequence: Synthetic peptide"
MEGLCLPRA

SEQ ID NO: 23115 - protein, 10 aa, Artificial Sequence
  source: /note="Description of Artificial Sequence: Synthetic peptide"
AQMPPPMPAL

SEQ ID NO: 23116 - protein, 10 aa, Artificial Sequence
  source: /note="Description of Artificial Sequence: Synthetic peptide"
CLPRACLSGA

SEQ ID NO: 23117 - protein, 10 aa, Artificial Sequence
  source: /note="Description of Artificial Sequence: Synthetic peptide"
SLMPTKASRT

SEQ ID NO: 23118 - protein, 10 aa, Artificial Sequence
  source: /note="Description of Artificial Sequence: Synthetic peptide"
LMPTKASRTV

SEQ ID NO: 23119 - protein, 10 aa, Artificial Sequence
  source: /note="Description of Artificial Sequence: Synthetic peptide"
RTVRRSSPRR

SEQ ID NO: 23120 - protein, 10 aa, Artificial Sequence
  source: /note="Description of Artificial Sequence: Synthetic peptide"
SSLMPTKASR

SEQ ID NO: 23121 - protein, 10 aa, Artificial Sequence
  source: /note="Description of Artificial Sequence: Synthetic peptide"
RTLPETLRTA

SEQ ID NO: 23122 - protein, 10 aa, Artificial Sequence
  source: /note="Description of Artificial Sequence: Synthetic peptide"
RTAPRKSSLM

SEQ ID NO: 23123 - protein, 10 aa, Artificial Sequence
  source: /note="Description of Artificial Sequence: Synthetic peptide"
PTKASRTVRR

SEQ ID NO: 23124 - protein, 10 aa, Artificial Sequence
  source: /note="Description of Artificial Sequence: Synthetic peptide"
APQAQMPPPM

SEQ ID NO: 23125 - protein, 10 aa, Artificial Sequence
  source: /note="Description of Artificial Sequence: Synthetic peptide"
MPALGSSGPH

SEQ ID NO: 23126 - protein, 10 aa, Artificial Sequence
  source: /note="Description of Artificial Sequence: Synthetic peptide"
LPRACLSGAC

SEQ ID NO: 23127 - protein, 10 aa, Artificial Sequence
  source: /note="Description of Artificial Sequence: Synthetic peptide"
APRKSSLMPT

SEQ ID NO: 23128 - protein, 10 aa, Artificial Sequence
  source: /note="Description of Artificial Sequence: Synthetic peptide"
LRTAPRKSSL

SEQ ID NO: 23129 - protein, 10 aa, Artificial Sequence
  source: /note="Description of Artificial Sequence: Synthetic peptide"
RKSSLMPTKA

SEQ ID NO: 23130 - protein, 9 aa, Artificial Sequence
  source: /note="Description of Artificial Sequence: Synthetic peptide"
RIIMYRDGV

SEQ ID NO: 23131 - protein, 9 aa, Artificial Sequence
  source: /note="Description of Artificial Sequence: Synthetic peptide"
EYMPSRIIM

SEQ ID NO: 23132 - protein, 9 aa, Artificial Sequence
  source: /note="Description of Artificial Sequence: Synthetic peptide"
YMPSRIIMY

SEQ ID NO: 23133 - protein, 9 aa, Artificial Sequence
  source: /note="Description of Artificial Sequence: Synthetic peptide"
MPSRIIMYR

SEQ ID NO: 23134 - protein, 10 aa, Artificial Sequence
  source: /note="Description of Artificial Sequence: Synthetic peptide"
YMPSRIIMYR

SEQ ID NO: 23135 - protein, 10 aa, Artificial Sequence
  source: /note="Description of Artificial Sequence: Synthetic peptide"
NEYMPSRIIM

SEQ ID NO: 23136 - protein, 9 aa, Artificial Sequence
  source: /note="Description of Artificial Sequence: Synthetic peptide"
AMPSPEARV

SEQ ID NO: 23137 - protein, 9 aa, Artificial Sequence
  source: /note="Description of Artificial Sequence: Synthetic peptide"
RAMPSPEAR

SEQ ID NO: 23138 - protein, 9 aa, Artificial Sequence
  source: /note="Description of Artificial Sequence: Synthetic peptide"
EPICGLRAM

SEQ ID NO: 23139 - protein, 9 aa, Artificial Sequence
  source: /note="Description of Artificial Sequence: Synthetic peptide"
MPSPEARVL

SEQ ID NO: 23140 - protein, 10 aa, Artificial Sequence
  source: /note="Description of Artificial Sequence: Synthetic peptide"
GLRAMPSPEA

SEQ ID NO: 23141 - protein, 10 aa, Artificial Sequence
  source: /note="Description of Artificial Sequence: Synthetic peptide"
RAMPSPEARV

SEQ ID NO: 23142 - protein, 10 aa, Artificial Sequence
  source: /note="Description of Artificial Sequence: Synthetic peptide"
AMPSPEARVL

SEQ ID NO: 23143 - protein, 10 aa, Artificial Sequence
  source: /note="Description of Artificial Sequence: Synthetic peptide"
EEPICGLRAM

SEQ ID NO: 23144 - protein, 9 aa, Artificial Sequence
  source: /note="Description of Artificial Sequence: Synthetic peptide"
FCFFIFFYV

SEQ ID NO: 23145 - protein, 9 aa, Artificial Sequence
  source: /note="Description of Artificial Sequence: Synthetic peptide"
IIFCFFIFF

SEQ ID NO: 23146 - protein, 9 aa, Artificial Sequence
  source: /note="Description of Artificial Sequence: Synthetic peptide"
CFFIFFYVV

SEQ ID NO: 23147 - protein, 9 aa, Artificial Sequence
  source: /note="Description of Artificial Sequence: Synthetic peptide"
IFFYVVEEI

SEQ ID NO: 23148 - protein, 9 aa, Artificial Sequence
  source: /note="Description of Artificial Sequence: Synthetic peptide"
FFYVVEEIL

SEQ ID NO: 23149 - protein, 9 aa, Artificial Sequence
  source: /note="Description of Artificial Sequence: Synthetic peptide"
IFCFFIFFY

SEQ ID NO: 23150 - protein, 10 aa, Artificial Sequence
  source: /note="Description of Artificial Sequence: Synthetic peptide"
FCFFIFFYVV

SEQ ID NO: 23151 - protein, 10 aa, Artificial Sequence
  source: /note="Description of Artificial Sequence: Synthetic peptide"
FIFFYVVEEI

SEQ ID NO: 23152 - protein, 10 aa, Artificial Sequence
  source: /note="Description of Artificial Sequence: Synthetic peptide"
IIFCFFIFFY

SEQ ID NO: 23153 - protein, 10 aa, Artificial Sequence
  source: /note="Description of Artificial Sequence: Synthetic peptide"
IFCFFIFFYV

SEQ ID NO: 23154 - protein, 10 aa, Artificial Sequence
  source: /note="Description of Artificial Sequence: Synthetic peptide"
IFFYVVEEIL

SEQ ID NO: 23155 - protein, 10 aa, Artificial Sequence
  source: /note="Description of Artificial Sequence: Synthetic peptide"
FYVVEEILEI

SEQ ID NO: 23156 - protein, 10 aa, Artificial Sequence
  source: /note="Description of Artificial Sequence: Synthetic peptide"
EIIFCFFIFF

SEQ ID NO: 23157 - protein, 9 aa, Artificial Sequence
  source: /note="Description of Artificial Sequence: Synthetic peptide"
LVITGNGLY

SEQ ID NO: 23158 - protein, 9 aa, Artificial Sequence
  source: /note="Description of Artificial Sequence: Synthetic peptide"
GLYPGNTTV

SEQ ID NO: 23159 - protein, 9 aa, Artificial Sequence
  source: /note="Description of Artificial Sequence: Synthetic peptide"
TLVITGNGL

SEQ ID NO: 23160 - protein, 10 aa, Artificial Sequence
  source: /note="Description of Artificial Sequence: Synthetic peptide"
GLYPGNTTVT

SEQ ID NO: 23161 - protein, 10 aa, Artificial Sequence
  source: /note="Description of Artificial Sequence: Synthetic peptide"
LYPGNTTVTI

SEQ ID NO: 23162 - protein, 10 aa, Artificial Sequence
  source: /note="Description of Artificial Sequence: Synthetic peptide"
TLVITGNGLY

SEQ ID NO: 23163 - protein, 10 aa, Artificial Sequence
  source: /note="Description of Artificial Sequence: Synthetic peptide"
TTLVITGNGL

SEQ ID NO: 23164 - protein, 9 aa, Artificial Sequence
  source: /note="Description of Artificial Sequence: Synthetic peptide"
TTDKKVWLM

SEQ ID NO: 23165 - protein, 10 aa, Artificial Sequence
  source: /note="Description of Artificial Sequence: Synthetic peptide"
RKVTTDKKVW

SEQ ID NO: 23166 - protein, 9 aa, Artificial Sequence
  source: /note="Description of Artificial Sequence: Synthetic peptide"
WLQETTTGS

SEQ ID NO: 23167 - protein, 9 aa, Artificial Sequence
  source: /note="Description of Artificial Sequence: Synthetic peptide"
AWPRPCASW

SEQ ID NO: 23168 - protein, 9 aa, Artificial Sequence
  source: /note="Description of Artificial Sequence: Synthetic peptide"
GAPWGAWPR

SEQ ID NO: 23169 - protein, 9 aa, Artificial Sequence
  source: /note="Description of Artificial Sequence: Synthetic peptide"
WPRPCASWL

SEQ ID NO: 23170 - protein, 9 aa, Artificial Sequence
  source: /note="Description of Artificial Sequence: Synthetic peptide"
SLGAPWGAW

SEQ ID NO: 23171 - protein, 10 aa, Artificial Sequence
  source: /note="Description of Artificial Sequence: Synthetic peptide"
FVSLGAPWGA

SEQ ID NO: 23172 - protein, 10 aa, Artificial Sequence
  source: /note="Description of Artificial Sequence: Synthetic peptide"
LGAPWGAWPR

SEQ ID NO: 23173 - protein, 10 aa, Artificial Sequence
  source: /note="Description of Artificial Sequence: Synthetic peptide"
VSLGAPWGAW

SEQ ID NO: 23174 - protein, 10 aa, Artificial Sequence
  source: /note="Description of Artificial Sequence: Synthetic peptide"
GAWPRPCASW

SEQ ID NO: 23175 - protein, 9 aa, Artificial Sequence
  source: /note="Description of Artificial Sequence: Synthetic peptide"
ALARQSPVA

SEQ ID NO: 23176 - protein, 9 aa, Artificial Sequence
  source: /note="Description of Artificial Sequence: Synthetic peptide"
SVRPSFATA

SEQ ID NO: 23177 - protein, 9 aa, Artificial Sequence
  source: /note="Description of Artificial Sequence: Synthetic peptide"
TLPSAFQKL

SEQ ID NO: 23178 - protein, 9 aa, Artificial Sequence
  source: /note="Description of Artificial Sequence: Synthetic peptide"
PLSASSHTV

SEQ ID NO: 23179 - protein, 9 aa, Artificial Sequence
  source: /note="Description of Artificial Sequence: Synthetic peptide"
ATLPSAFQK

SEQ ID NO: 23180 - protein, 9 aa, Artificial Sequence
  source: /note="Description of Artificial Sequence: Synthetic peptide"
SSHTVLSNK

SEQ ID NO: 23181 - protein, 9 aa, Artificial Sequence
  source: /note="Description of Artificial Sequence: Synthetic peptide"
MTTAMTRPR

SEQ ID NO: 23182 - protein, 9 aa, Artificial Sequence
  source: /note="Description of Artificial Sequence: Synthetic peptide"
AVNFCWTTR

SEQ ID NO: 23183 - protein, 9 aa, Artificial Sequence
  source: /note="Description of Artificial Sequence: Synthetic peptide"
NYGCYCGLW

SEQ ID NO: 23184 - protein, 9 aa, Artificial Sequence
  source: /note="Description of Artificial Sequence: Synthetic peptide"
LWGAQAPPW

SEQ ID NO: 23185 - protein, 9 aa, Artificial Sequence
  source: /note="Description of Artificial Sequence: Synthetic peptide"
SWTAVNFCW

SEQ ID NO: 23186 - protein, 9 aa, Artificial Sequence
  source: /note="Description of Artificial Sequence: Synthetic peptide"
SFATATATL

SEQ ID NO: 23187 - protein, 9 aa, Artificial Sequence
  source: /note="Description of Artificial Sequence: Synthetic peptide"
AARHMTTAM

SEQ ID NO: 23188 - protein, 9 aa, Artificial Sequence
  source: /note="Description of Artificial Sequence: Synthetic peptide"
RHMTTAMTR

SEQ ID NO: 23189 - protein, 9 aa, Artificial Sequence
  source: /note="Description of Artificial Sequence: Synthetic peptide"
MTRPRSWTA

SEQ ID NO: 23190 - protein, 9 aa, Artificial Sequence
  source: /note="Description of Artificial Sequence: Synthetic peptide"
RSWTAVNFC

SEQ ID NO: 23191 - protein, 9 aa, Artificial Sequence
  source: /note="Description of Artificial Sequence: Synthetic peptide"
TTRTPTPIH

SEQ ID NO: 23192 - protein, 9 aa, Artificial Sequence
  source: /note="Description of Artificial Sequence: Synthetic peptide"
RTPTPIHTR

SEQ ID NO: 23193 - protein, 9 aa, Artificial Sequence
  source: /note="Description of Artificial Sequence: Synthetic peptide"
HTRALARQS

SEQ ID NO: 23194 - protein, 9 aa, Artificial Sequence
  source: /note="Description of Artificial Sequence: Synthetic peptide"
RALARQSPV

SEQ ID NO: 23195 - protein, 9 aa, Artificial Sequence
  source: /note="Description of Artificial Sequence: Synthetic peptide"
LARQSPVAA

SEQ ID NO: 23196 - protein, 9 aa, Artificial Sequence
  source: /note="Description of Artificial Sequence: Synthetic peptide"
KTKSVRPSF

SEQ ID NO: 23197 - protein, 9 aa, Artificial Sequence
  source: /note="Description of Artificial Sequence: Synthetic peptide"
KLHITRHTR

SEQ ID NO: 23198 - protein, 9 aa, Artificial Sequence
  source: /note="Description of Artificial Sequence: Synthetic peptide"
ITRHTRTWT

SEQ ID NO: 23199 - protein, 9 aa, Artificial Sequence
  source: /note="Description of Artificial Sequence: Synthetic peptide"
HTRTWTPRS

SEQ ID NO: 23200 - protein, 9 aa, Artificial Sequence
  source: /note="Description of Artificial Sequence: Synthetic peptide"
RTWTPRSIV

SEQ ID NO: 23201 - protein, 9 aa, Artificial Sequence
  source: /note="Description of Artificial Sequence: Synthetic peptide"
RSIVRVEYH

SEQ ID NO: 23202 - protein, 9 aa, Artificial Sequence
  source: /note="Description of Artificial Sequence: Synthetic peptide"
RVEYHLSKA

SEQ ID NO: 23203 - protein, 9 aa, Artificial Sequence
  source: /note="Description of Artificial Sequence: Synthetic peptide"
LSKASPLSA

SEQ ID NO: 23204 - protein, 9 aa, Artificial Sequence
  source: /note="Description of Artificial Sequence: Synthetic peptide"
WMNWTSAAR

SEQ ID NO: 23205 - protein, 9 aa, Artificial Sequence
  source: /note="Description of Artificial Sequence: Synthetic peptide"
AFQKLHITR

SEQ ID NO: 23206 - protein, 9 aa, Artificial Sequence
  source: /note="Description of Artificial Sequence: Synthetic peptide"
TWTPRSIVR

SEQ ID NO: 23207 - protein, 9 aa, Artificial Sequence
  source: /note="Description of Artificial Sequence: Synthetic peptide"
WTSAARHMT

SEQ ID NO: 23208 - protein, 9 aa, Artificial Sequence
  source: /note="Description of Artificial Sequence: Synthetic peptide"
WTAVNFCWT

SEQ ID NO: 23209 - protein, 9 aa, Artificial Sequence
  source: /note="Description of Artificial Sequence: Synthetic peptide"
WTTRTPTPI

SEQ ID NO: 23210 - protein, 9 aa, Artificial Sequence
  source: /note="Description of Artificial Sequence: Synthetic peptide"
WTPRSIVRV

SEQ ID NO: 23211 - protein, 9 aa, Artificial Sequence
  source: /note="Description of Artificial Sequence: Synthetic peptide"
RPRSWTAVN

SEQ ID NO: 23212 - protein, 9 aa, Artificial Sequence
  source: /note="Description of Artificial Sequence: Synthetic peptide"
TPIHTRALA

SEQ ID NO: 23213 - protein, 9 aa, Artificial Sequence
  source: /note="Description of Artificial Sequence: Synthetic peptide"
RPSFATATA

SEQ ID NO: 23214 - protein, 9 aa, Artificial Sequence
  source: /note="Description of Artificial Sequence: Synthetic peptide"
YHLSKASPL

SEQ ID NO: 23215 - protein, 9 aa, Artificial Sequence
  source: /note="Description of Artificial Sequence: Synthetic peptide"
ATATLPSAF

SEQ ID NO: 23216 - protein, 9 aa, Artificial Sequence
  source: /note="Description of Artificial Sequence: Synthetic peptide"
AQAPPWMNW

SEQ ID NO: 23217 - protein, 9 aa, Artificial Sequence
  source: /note="Description of Artificial Sequence: Synthetic peptide"
TAMTRPRSW

SEQ ID NO: 23218 - protein, 9 aa, Artificial Sequence
  source: /note="Description of Artificial Sequence: Synthetic peptide"
RQSPVAAKT

SEQ ID NO: 23219 - protein, 9 aa, Artificial Sequence
  source: /note="Description of Artificial Sequence: Synthetic peptide"
FQKLHITRH

SEQ ID NO: 23220 - protein, 9 aa, Artificial Sequence
  source: /note="Description of Artificial Sequence: Synthetic peptide"
HITRHTRTW

SEQ ID NO: 23221 - protein, 9 aa, Artificial Sequence
  source: /note="Description of Artificial Sequence: Synthetic peptide"
SKASPLSAS

SEQ ID NO: 23222 - protein, 9 aa, Artificial Sequence
  source: /note="Description of Artificial Sequence: Synthetic peptide"
LSASSHTVL

SEQ ID NO: 23223 - protein, 9 aa, Artificial Sequence
  source: /note="Description of Artificial Sequence: Synthetic peptide"
VEYHLSKAS

SEQ ID NO: 23224 - protein, 10 aa, Artificial Sequence
  source: /note="Description of Artificial Sequence: Synthetic peptide"
AMTRPRSWTA

SEQ ID NO: 23225 - protein, 10 aa, Artificial Sequence
  source: /note="Description of Artificial Sequence: Synthetic peptide"
MTRPRSWTAV

SEQ ID NO: 23226 - protein, 10 aa, Artificial Sequence
  source: /note="Description of Artificial Sequence: Synthetic peptide"
ALARQSPVAA

SEQ ID NO: 23227 - protein, 10 aa, Artificial Sequence
  source: /note="Description of Artificial Sequence: Synthetic peptide"
ATATATLPSA

SEQ ID NO: 23228 - protein, 10 aa, Artificial Sequence
  source: /note="Description of Artificial Sequence: Synthetic peptide"
HLSKASPLSA

SEQ ID NO: 23229 - protein, 10 aa, Artificial Sequence
  source: /note="Description of Artificial Sequence: Synthetic peptide"
RTWTPRSIVR

SEQ ID NO: 23230 - protein, 10 aa, Artificial Sequence
  source: /note="Description of Artificial Sequence: Synthetic peptide"
IVRVEYHLSK

SEQ ID NO: 23231 - protein, 10 aa, Artificial Sequence
  source: /note="Description of Artificial Sequence: Synthetic peptide"
ASSHTVLSNK

SEQ ID NO: 23232 - protein, 10 aa, Artificial Sequence
  source: /note="Description of Artificial Sequence: Synthetic peptide"
TAVNFCWTTR

SEQ ID NO: 23233 - protein, 10 aa, Artificial Sequence
  source: /note="Description of Artificial Sequence: Synthetic peptide"
TATLPSAFQK

SEQ ID NO: 23234 - protein, 10 aa, Artificial Sequence
  source: /note="Description of Artificial Sequence: Synthetic peptide"
SAFQKLHITR

SEQ ID NO: 23235 - protein, 10 aa, Artificial Sequence
  source: /note="Description of Artificial Sequence: Synthetic peptide"
RSWTAVNFCW

SEQ ID NO: 23236 - protein, 10 aa, Artificial Sequence
  source: /note="Description of Artificial Sequence: Synthetic peptide"
CWTTRTPTPI

SEQ ID NO: 23237 - protein, 10 aa, Artificial Sequence
  source: /note="Description of Artificial Sequence: Synthetic peptide"
AARHMTTAMT

SEQ ID NO: 23238 - protein, 10 aa, Artificial Sequence
  source: /note="Description of Artificial Sequence: Synthetic peptide"
TTRTPTPIHT

SEQ ID NO: 23239 - protein, 10 aa, Artificial Sequence
  source: /note="Description of Artificial Sequence: Synthetic peptide"
RTPTPIHTRA

SEQ ID NO: 23240 - protein, 10 aa, Artificial Sequence
  source: /note="Description of Artificial Sequence: Synthetic peptide"
HTRALARQSP

SEQ ID NO: 23241 - protein, 10 aa, Artificial Sequence
  source: /note="Description of Artificial Sequence: Synthetic peptide"
RALARQSPVA

SEQ ID NO: 23242 - protein, 10 aa, Artificial Sequence
  source: /note="Description of Artificial Sequence: Synthetic peptide"
LARQSPVAAK

SEQ ID NO: 23243 - protein, 10 aa, Artificial Sequence
  source: /note="Description of Artificial Sequence: Synthetic peptide"
RQSPVAAKTK

SEQ ID NO: 23244 - protein, 10 aa, Artificial Sequence
  source: /note="Description of Artificial Sequence: Synthetic peptide"
KTKSVRPSFA

SEQ ID NO: 23245 - protein, 10 aa, Artificial Sequence
  source: /note="Description of Artificial Sequence: Synthetic peptide"
KSVRPSFATA

SEQ ID NO: 23246 - protein, 10 aa, Artificial Sequence
  source: /note="Description of Artificial Sequence: Synthetic peptide"
SVRPSFATAT

SEQ ID NO: 23247 - protein, 10 aa, Artificial Sequence
  source: /note="Description of Artificial Sequence: Synthetic peptide"
KLHITRHTRT

SEQ ID NO: 23248 - protein, 10 aa, Artificial Sequence
  source: /note="Description of Artificial Sequence: Synthetic peptide"
ITRHTRTWTP

SEQ ID NO: 23249 - protein, 10 aa, Artificial Sequence
  source: /note="Description of Artificial Sequence: Synthetic peptide"
HTRTWTPRSI

SEQ ID NO: 23250 - protein, 10 aa, Artificial Sequence
  source: /note="Description of Artificial Sequence: Synthetic peptide"
RSIVRVEYHL

SEQ ID NO: 23251 - protein, 10 aa, Artificial Sequence
  source: /note="Description of Artificial Sequence: Synthetic peptide"
SSHTVLSNKA

SEQ ID NO: 23252 - protein, 10 aa, Artificial Sequence
  source: /note="Description of Artificial Sequence: Synthetic peptide"
PWMNWTSAAR

SEQ ID NO: 23253 - protein, 10 aa, Artificial Sequence
  source: /note="Description of Artificial Sequence: Synthetic peptide"
HMTTAMTRPR

SEQ ID NO: 23254 - protein, 10 aa, Artificial Sequence
  source: /note="Description of Artificial Sequence: Synthetic peptide"
TPIHTRALAR

SEQ ID NO: 23255 - protein, 10 aa, Artificial Sequence
  source: /note="Description of Artificial Sequence: Synthetic peptide"
TSAARHMTTA

SEQ ID NO: 23256 - protein, 10 aa, Artificial Sequence
  source: /note="Description of Artificial Sequence: Synthetic peptide"
WTAVNFCWTT

SEQ ID NO: 23257 - protein, 10 aa, Artificial Sequence
  source: /note="Description of Artificial Sequence: Synthetic peptide"
APPWMNWTSA

SEQ ID NO: 23258 - protein, 10 aa, Artificial Sequence
  source: /note="Description of Artificial Sequence: Synthetic peptide"
SAARHMTTAM

SEQ ID NO: 23259 - protein, 10 aa, Artificial Sequence
  source: /note="Description of Artificial Sequence: Synthetic peptide"
RPRSWTAVNF

SEQ ID NO: 23260 - protein, 10 aa, Artificial Sequence
  source: /note="Description of Artificial Sequence: Synthetic peptide"
TPTPIHTRAL

SEQ ID NO: 23261 - protein, 10 aa, Artificial Sequence
  source: /note="Description of Artificial Sequence: Synthetic peptide"
SPVAAKTKSV

SEQ ID NO: 23262 - protein, 10 aa, Artificial Sequence
  source: /note="Description of Artificial Sequence: Synthetic peptide"
RPSFATATAT

SEQ ID NO: 23263 - protein, 10 aa, Artificial Sequence
  source: /note="Description of Artificial Sequence: Synthetic peptide"
LPSAFQKLHI

SEQ ID NO: 23264 - protein, 10 aa, Artificial Sequence
  source: /note="Description of Artificial Sequence: Synthetic peptide"
SPLSASSHTV

SEQ ID NO: 23265 - protein, 10 aa, Artificial Sequence
  source: /note="Description of Artificial Sequence: Synthetic peptide"
MNWTSAARHM

SEQ ID NO: 23266 - protein, 10 aa, Artificial Sequence
  source: /note="Description of Artificial Sequence: Synthetic peptide"
TATATLPSAF

SEQ ID NO: 23267 - protein, 10 aa, Artificial Sequence
  source: /note="Description of Artificial Sequence: Synthetic peptide"
GLWGAQAPPW

SEQ ID NO: 23268 - protein, 10 aa, Artificial Sequence
  source: /note="Description of Artificial Sequence: Synthetic peptide"
WMNWTSAARH

SEQ ID NO: 23269 - protein, 10 aa, Artificial Sequence
  source: /note="Description of Artificial Sequence: Synthetic peptide"
AKTKSVRPSF

SEQ ID NO: 23270 - protein, 10 aa, Artificial Sequence
  source: /note="Description of Artificial Sequence: Synthetic peptide"
PSFATATATL

SEQ ID NO: 23271 - protein, 10 aa, Artificial Sequence
  source: /note="Description of Artificial Sequence: Synthetic peptide"
FQKLHITRHT

SEQ ID NO: 23272 - protein, 10 aa, Artificial Sequence
  source: /note="Description of Artificial Sequence: Synthetic peptide"
LHITRHTRTW

SEQ ID NO: 23273 - protein, 10 aa, Artificial Sequence
  source: /note="Description of Artificial Sequence: Synthetic peptide"
KASPLSASSH

SEQ ID NO: 23274 - protein, 10 aa, Artificial Sequence
  source: /note="Description of Artificial Sequence: Synthetic peptide"
TPRSIVRVEY

SEQ ID NO: 23275 - protein, 9 aa, Artificial Sequence
  source: /note="Description of Artificial Sequence: Synthetic peptide"
IQNYRFHTI

SEQ ID NO: 23276 - protein, 9 aa, Artificial Sequence
  source: /note="Description of Artificial Sequence: Synthetic peptide"
NYGIQNYRF

SEQ ID NO: 23277 - protein, 9 aa, Artificial Sequence
  source: /note="Description of Artificial Sequence: Synthetic peptide"
QYNYGIQNY

SEQ ID NO: 23278 - protein, 9 aa, Artificial Sequence
  source: /note="Description of Artificial Sequence: Synthetic peptide"
YNYGIQNYR

SEQ ID NO: 23279 - protein, 9 aa, Artificial Sequence
  source: /note="Description of Artificial Sequence: Synthetic peptide"
LQYNYGIQN

SEQ ID NO: 23280 - protein, 10 aa, Artificial Sequence
  source: /note="Description of Artificial Sequence: Synthetic peptide"
YNYGIQNYRF

SEQ ID NO: 23281 - protein, 10 aa, Artificial Sequence
  source: /note="Description of Artificial Sequence: Synthetic peptide"
LQYNYGIQNY

SEQ ID NO: 23282 - protein, 10 aa, Artificial Sequence
  source: /note="Description of Artificial Sequence: Synthetic peptide"
QYNYGIQNYR

SEQ ID NO: 23283 - protein, 10 aa, Artificial Sequence
  source: /note="Description of Artificial Sequence: Synthetic peptide"
IQNYRFHTIS

SEQ ID NO: 23284 - protein, 10 aa, Artificial Sequence
  source: /note="Description of Artificial Sequence: Synthetic peptide"
QNYRFHTISH

SEQ ID NO: 23285 - protein, 9 aa, Artificial Sequence
  source: /note="Description of Artificial Sequence: Synthetic peptide"
RMSGDTWWC

SEQ ID NO: 23286 - protein, 9 aa, Artificial Sequence
  source: /note="Description of Artificial Sequence: Synthetic peptide"
TLEERTSSV

SEQ ID NO: 23287 - protein, 9 aa, Artificial Sequence
  source: /note="Description of Artificial Sequence: Synthetic peptide"
VIAGSTPER

SEQ ID NO: 23288 - protein, 9 aa, Artificial Sequence
  source: /note="Description of Artificial Sequence: Synthetic peptide"
RTSSVSIVH

SEQ ID NO: 23289 - protein, 9 aa, Artificial Sequence
  source: /note="Description of Artificial Sequence: Synthetic peptide"
TSSVSIVHR

SEQ ID NO: 23290 - protein, 9 aa, Artificial Sequence
  source: /note="Description of Artificial Sequence: Synthetic peptide"
GVKEKSTSA

SEQ ID NO: 23291 - protein, 9 aa, Artificial Sequence
  source: /note="Description of Artificial Sequence: Synthetic peptide"
KSTSANIVI

SEQ ID NO: 23292 - protein, 9 aa, Artificial Sequence
  source: /note="Description of Artificial Sequence: Synthetic peptide"
TWWCTLEER

SEQ ID NO: 23293 - protein, 9 aa, Artificial Sequence
  source: /note="Description of Artificial Sequence: Synthetic peptide"
IVHRDLGER

SEQ ID NO: 23294 - protein, 9 aa, Artificial Sequence
  source: /note="Description of Artificial Sequence: Synthetic peptide"
STSANIVIA

SEQ ID NO: 23295 - protein, 9 aa, Artificial Sequence
  source: /note="Description of Artificial Sequence: Synthetic peptide"
KEKSTSANI

SEQ ID NO: 23296 - protein, 9 aa, Artificial Sequence
  source: /note="Description of Artificial Sequence: Synthetic peptide"
EERTSSVSI

SEQ ID NO: 23297 - protein, 10 aa, Artificial Sequence
  source: /note="Description of Artificial Sequence: Synthetic peptide"
RMSGDTWWCT

SEQ ID NO: 23298 - protein, 10 aa, Artificial Sequence
  source: /note="Description of Artificial Sequence: Synthetic peptide"
CTLEERTSSV

SEQ ID NO: 23299 - protein, 10 aa, Artificial Sequence
  source: /note="Description of Artificial Sequence: Synthetic peptide"
IVIAGSTPER

SEQ ID NO: 23300 - protein, 10 aa, Artificial Sequence
  source: /note="Description of Artificial Sequence: Synthetic peptide"
RTSSVSIVHR

SEQ ID NO: 23301 - protein, 10 aa, Artificial Sequence
  source: /note="Description of Artificial Sequence: Synthetic peptide"
KSTSANIVIA

SEQ ID NO: 23302 - protein, 10 aa, Artificial Sequence
  source: /note="Description of Artificial Sequence: Synthetic peptide"
DTWWCTLEER

SEQ ID NO: 23303 - protein, 10 aa, Artificial Sequence
  source: /note="Description of Artificial Sequence: Synthetic peptide"
SIVHRDLGER

SEQ ID NO: 23304 - protein, 10 aa, Artificial Sequence
  source: /note="Description of Artificial Sequence: Synthetic peptide"
KEKSTSANIV

SEQ ID NO: 23305 - protein, 10 aa, Artificial Sequence
  source: /note="Description of Artificial Sequence: Synthetic peptide"
MSGDTWWCTL

SEQ ID NO: 23306 - protein, 10 aa, Artificial Sequence
  source: /note="Description of Artificial Sequence: Synthetic peptide"
LEERTSSVSI

SEQ ID NO: 23307 - protein, 10 aa, Artificial Sequence
  source: /note="Description of Artificial Sequence: Synthetic peptide"
EERTSSVSIV

SEQ ID NO: 23308 - protein, 10 aa, Artificial Sequence
  source: /note="Description of Artificial Sequence: Synthetic peptide"
TPERMSGDTW

SEQ ID NO: 23309 - protein, 9 aa, Artificial Sequence
  source: /note="Description of Artificial Sequence: Synthetic peptide"
FTSVPPGFK

SEQ ID NO: 23310 - protein, 9 aa, Artificial Sequence
  source: /note="Description of Artificial Sequence: Synthetic peptide"
FFTSVPPGF

SEQ ID NO: 23311 - protein, 9 aa, Artificial Sequence
  source: /note="Description of Artificial Sequence: Synthetic peptide"
TSVPPGFKM

SEQ ID NO: 23312 - protein, 9 aa, Artificial Sequence
  source: /note="Description of Artificial Sequence: Synthetic peptide"
KMQSRRRKW

SEQ ID NO: 23313 - protein, 10 aa, Artificial Sequence
  source: /note="Description of Artificial Sequence: Synthetic peptide"
FFTSVPPGFK

SEQ ID NO: 23314 - protein, 10 aa, Artificial Sequence
  source: /note="Description of Artificial Sequence: Synthetic peptide"
TFFTSVPPGF

SEQ ID NO: 23315 - protein, 10 aa, Artificial Sequence
  source: /note="Description of Artificial Sequence: Synthetic peptide"
GFKMQSRRRK

SEQ ID NO: 23316 - protein, 10 aa, Artificial Sequence
  source: /note="Description of Artificial Sequence: Synthetic peptide"
KMQSRRRKWA

SEQ ID NO: 23317 - protein, 10 aa, Artificial Sequence
  source: /note="Description of Artificial Sequence: Synthetic peptide"
FTSVPPGFKM

SEQ ID NO: 23318 - protein, 10 aa, Artificial Sequence
  source: /note="Description of Artificial Sequence: Synthetic peptide"
FKMQSRRRKW

SEQ ID NO: 23319 - protein, 9 aa, Artificial Sequence
  source: /note="Description of Artificial Sequence: Synthetic peptide"
LLGDQRHTL

SEQ ID NO: 23320 - protein, 9 aa, Artificial Sequence
  source: /note="Description of Artificial Sequence: Synthetic peptide"
VWRQPHQPL

SEQ ID NO: 23321 - protein, 9 aa, Artificial Sequence
  source: /note="Description of Artificial Sequence: Synthetic peptide"
HLRVWRQPH

SEQ ID NO: 23322 - protein, 9 aa, Artificial Sequence
  source: /note="Description of Artificial Sequence: Synthetic peptide"
GLCHLRVWR

SEQ ID NO: 23323 - protein, 9 aa, Artificial Sequence
  source: /note="Description of Artificial Sequence: Synthetic peptide"
RHRGGLCHL

SEQ ID NO: 23324 - protein, 9 aa, Artificial Sequence
  source: /note="Description of Artificial Sequence: Synthetic peptide"
WRQPHQPLL

SEQ ID NO: 23325 - protein, 10 aa, Artificial Sequence
  source: /note="Description of Artificial Sequence: Synthetic peptide"
LLGDQRHTLL

SEQ ID NO: 23326 - protein, 10 aa, Artificial Sequence
  source: /note="Description of Artificial Sequence: Synthetic peptide"
VWRQPHQPLL

SEQ ID NO: 23327 - protein, 10 aa, Artificial Sequence
  source: /note="Description of Artificial Sequence: Synthetic peptide"
AIYRRHRGGL

SEQ ID NO: 23328 - protein, 10 aa, Artificial Sequence
  source: /note="Description of Artificial Sequence: Synthetic peptide"
RHRGGLCHLR

SEQ ID NO: 23329 - protein, 10 aa, Artificial Sequence
  source: /note="Description of Artificial Sequence: Synthetic peptide"
HLRVWRQPHQ

SEQ ID NO: 23330 - protein, 10 aa, Artificial Sequence
  source: /note="Description of Artificial Sequence: Synthetic peptide"
RVWRQPHQPL

SEQ ID NO: 23331 - protein, 10 aa, Artificial Sequence
  source: /note="Description of Artificial Sequence: Synthetic peptide"
RRHRGGLCHL

SEQ ID NO: 23332 - protein, 10 aa, Artificial Sequence
  source: /note="Description of Artificial Sequence: Synthetic peptide"
RGGLCHLRVW

SEQ ID NO: 23333 - protein, 9 aa, Artificial Sequence
  source: /note="Description of Artificial Sequence: Synthetic peptide"
WLCTATPPA

SEQ ID NO: 23334 - protein, 9 aa, Artificial Sequence
  source: /note="Description of Artificial Sequence: Synthetic peptide"
RALSDRRRR

SEQ ID NO: 23335 - protein, 9 aa, Artificial Sequence
  source: /note="Description of Artificial Sequence: Synthetic peptide"
RRRRRRMTR

SEQ ID NO: 23336 - protein, 9 aa, Artificial Sequence
  source: /note="Description of Artificial Sequence: Synthetic peptide"
RRRRRMTRR

SEQ ID NO: 23337 - protein, 9 aa, Artificial Sequence
  source: /note="Description of Artificial Sequence: Synthetic peptide"
RRRRMTRRK

SEQ ID NO: 23338 - protein, 9 aa, Artificial Sequence
  source: /note="Description of Artificial Sequence: Synthetic peptide"
RRRMTRRKK

SEQ ID NO: 23339 - protein, 9 aa, Artificial Sequence
  source: /note="Description of Artificial Sequence: Synthetic peptide"
RMTRRKKRR

SEQ ID NO: 23340 - protein, 9 aa, Artificial Sequence
  source: /note="Description of Artificial Sequence: Synthetic peptide"
KKRRWRLQR

SEQ ID NO: 23341 - protein, 9 aa, Artificial Sequence
  source: /note="Description of Artificial Sequence: Synthetic peptide"
KRRWRLQRR

SEQ ID NO: 23342 - protein, 9 aa, Artificial Sequence
  source: /note="Description of Artificial Sequence: Synthetic peptide"
RWRLQRRGG

SEQ ID NO: 23343 - protein, 9 aa, Artificial Sequence
  source: /note="Description of Artificial Sequence: Synthetic peptide"
GGWPSRSPR

SEQ ID NO: 23344 - protein, 9 aa, Artificial Sequence
  source: /note="Description of Artificial Sequence: Synthetic peptide"
WPSRSPRSC

SEQ ID NO: 23345 - protein, 9 aa, Artificial Sequence
  source: /note="Description of Artificial Sequence: Synthetic peptide"
SPRSCRPWL

SEQ ID NO: 23346 - protein, 9 aa, Artificial Sequence
  source: /note="Description of Artificial Sequence: Synthetic peptide"
RRKKRRWRL

SEQ ID NO: 23347 - protein, 9 aa, Artificial Sequence
  source: /note="Description of Artificial Sequence: Synthetic peptide"
LQRRGGWPS

SEQ ID NO: 23348 - protein, 9 aa, Artificial Sequence
  source: /note="Description of Artificial Sequence: Synthetic peptide"
RSPRSCRPW

SEQ ID NO: 23349 - protein, 10 aa, Artificial Sequence
  source: /note="Description of Artificial Sequence: Synthetic peptide"
RALSDRRRRR

SEQ ID NO: 23350 - protein, 10 aa, Artificial Sequence
  source: /note="Description of Artificial Sequence: Synthetic peptide"
ALSDRRRRRR

SEQ ID NO: 23351 - protein, 10 aa, Artificial Sequence
  source: /note="Description of Artificial Sequence: Synthetic peptide"
RRRRRRMTRR

SEQ ID NO: 23352 - protein, 10 aa, Artificial Sequence
  source: /note="Description of Artificial Sequence: Synthetic peptide"
RRRRRMTRRK

SEQ ID NO: 23353 - protein, 10 aa, Artificial Sequence
  source: /note="Description of Artificial Sequence: Synthetic peptide"
RRRRMTRRKK

SEQ ID NO: 23354 - protein, 10 aa, Artificial Sequence
  source: /note="Description of Artificial Sequence: Synthetic peptide"
MTRRKKRRWR

SEQ ID NO: 23355 - protein, 10 aa, Artificial Sequence
  source: /note="Description of Artificial Sequence: Synthetic peptide"
RKKRRWRLQR

SEQ ID NO: 23356 - protein, 10 aa, Artificial Sequence
  source: /note="Description of Artificial Sequence: Synthetic peptide"
KKRRWRLQRR

SEQ ID NO: 23357 - protein, 10 aa, Artificial Sequence
  source: /note="Description of Artificial Sequence: Synthetic peptide"
RWRLQRRGGW

SEQ ID NO: 23358 - protein, 10 aa, Artificial Sequence
  source: /note="Description of Artificial Sequence: Synthetic peptide"
LQRRGGWPSR

SEQ ID NO: 23359 - protein, 10 aa, Artificial Sequence
  source: /note="Description of Artificial Sequence: Synthetic peptide"
RGGWPSRSPR

SEQ ID NO: 23360 - protein, 10 aa, Artificial Sequence
  source: /note="Description of Artificial Sequence: Synthetic peptide"
RSPRSCRPWL

SEQ ID NO: 23361 - protein, 10 aa, Artificial Sequence
  source: /note="Description of Artificial Sequence: Synthetic peptide"
RSCRPWLCTA

SEQ ID NO: 23362 - protein, 10 aa, Artificial Sequence
  source: /note="Description of Artificial Sequence: Synthetic peptide"
RPWLCTATPP

SEQ ID NO: 23363 - protein, 10 aa, Artificial Sequence
  source: /note="Description of Artificial Sequence: Synthetic peptide"
TRRKKRRWRL

SEQ ID NO: 23364 - protein, 10 aa, Artificial Sequence
  source: /note="Description of Artificial Sequence: Synthetic peptide"
RMTRRKKRRW

SEQ ID NO: 23365 - protein, 10 aa, Artificial Sequence
  source: /note="Description of Artificial Sequence: Synthetic peptide"
SRSPRSCRPW

SEQ ID NO: 23366 - protein, 9 aa, Artificial Sequence
  source: /note="Description of Artificial Sequence: Synthetic peptide"
RISVCPCLK

SEQ ID NO: 23367 - protein, 9 aa, Artificial Sequence
  source: /note="Description of Artificial Sequence: Synthetic peptide"
GRISVCPCL

SEQ ID NO: 23368 - protein, 10 aa, Artificial Sequence
  source: /note="Description of Artificial Sequence: Synthetic peptide"
HGRISVCPCL

SEQ ID NO: 23369 - protein, 9 aa, Artificial Sequence
  source: /note="Description of Artificial Sequence: Synthetic peptide"
CTPECQSSL

SEQ ID NO: 23370 - protein, 9 aa, Artificial Sequence
  source: /note="Description of Artificial Sequence: Synthetic peptide"
ISRRMSVDY

SEQ ID NO: 23371 - protein, 9 aa, Artificial Sequence
  source: /note="Description of Artificial Sequence: Synthetic peptide"
AEISRRMSV

SEQ ID NO: 23372 - protein, 9 aa, Artificial Sequence
  source: /note="Description of Artificial Sequence: Synthetic peptide"
EEAEISRRM

SEQ ID NO: 23373 - protein, 10 aa, Artificial Sequence
  source: /note="Description of Artificial Sequence: Synthetic peptide"
EISRRMSVDY

SEQ ID NO: 23374 - protein, 10 aa, Artificial Sequence
  source: /note="Description of Artificial Sequence: Synthetic peptide"
DEEAEISRRM

SEQ ID NO: 23375 - protein, 9 aa, Artificial Sequence
  source: /note="Description of Artificial Sequence: Synthetic peptide"
EQLQQEQAL

SEQ ID NO: 23376 - protein, 9 aa, Artificial Sequence
  source: /note="Description of Artificial Sequence: Synthetic peptide"
REQLQQEQA

SEQ ID NO: 23377 - protein, 10 aa, Artificial Sequence
  source: /note="Description of Artificial Sequence: Synthetic peptide"
REQLQQEQAL

SEQ ID NO: 23378 - protein, 10 aa, Artificial Sequence
  source: /note="Description of Artificial Sequence: Synthetic peptide"
EQLQQEQALL

SEQ ID NO: 23379 - protein, 10 aa, Artificial Sequence
  source: /note="Description of Artificial Sequence: Synthetic peptide"
QQEQALLEEI

SEQ ID NO: 23380 - protein, 9 aa, Artificial Sequence
  source: /note="Description of Artificial Sequence: Synthetic peptide"
SIPLLSFLV

SEQ ID NO: 23381 - protein, 9 aa, Artificial Sequence
  source: /note="Description of Artificial Sequence: Synthetic peptide"
LLSFLVAAV

SEQ ID NO: 23382 - protein, 9 aa, Artificial Sequence
  source: /note="Description of Artificial Sequence: Synthetic peptide"
FLVAAVQPS

SEQ ID NO: 23383 - protein, 9 aa, Artificial Sequence
  source: /note="Description of Artificial Sequence: Synthetic peptide"
IPLLSFLVA

SEQ ID NO: 23384 - protein, 9 aa, Artificial Sequence
  source: /note="Description of Artificial Sequence: Synthetic peptide"
GSIPLLSFL

SEQ ID NO: 23385 - protein, 10 aa, Artificial Sequence
  source: /note="Description of Artificial Sequence: Synthetic peptide"
GSIPLLSFLV

SEQ ID NO: 23386 - protein, 10 aa, Artificial Sequence
  source: /note="Description of Artificial Sequence: Synthetic peptide"
PLLSFLVAAV

SEQ ID NO: 23387 - protein, 10 aa, Artificial Sequence
  source: /note="Description of Artificial Sequence: Synthetic peptide"
IPLLSFLVAA

SEQ ID NO: 23388 - protein, 9 aa, Artificial Sequence
  source: /note="Description of Artificial Sequence: Synthetic peptide"
RLKTFGVPL

SEQ ID NO: 23389 - protein, 9 aa, Artificial Sequence
  source: /note="Description of Artificial Sequence: Synthetic peptide"
CLAGSLSTM

SEQ ID NO: 23390 - protein, 9 aa, Artificial Sequence
  source: /note="Description of Artificial Sequence: Synthetic peptide"
SAMPSAMGV

SEQ ID NO: 23391 - protein, 9 aa, Artificial Sequence
  source: /note="Description of Artificial Sequence: Synthetic peptide"
IMMSWMPPL

SEQ ID NO: 23392 - protein, 9 aa, Artificial Sequence
  source: /note="Description of Artificial Sequence: Synthetic peptide"
MMSWMPPLA

SEQ ID NO: 23393 - protein, 9 aa, Artificial Sequence
  source: /note="Description of Artificial Sequence: Synthetic peptide"
WMPPLAPCA

SEQ ID NO: 23394 - protein, 9 aa, Artificial Sequence
  source: /note="Description of Artificial Sequence: Synthetic peptide"
FTPLSAHPV

SEQ ID NO: 23395 - protein, 9 aa, Artificial Sequence
  source: /note="Description of Artificial Sequence: Synthetic peptide"
PLSAHPVPV

SEQ ID NO: 23396 - protein, 9 aa, Artificial Sequence
  source: /note="Description of Artificial Sequence: Synthetic peptide"
VLSGCHLAV

SEQ ID NO: 23397 - protein, 9 aa, Artificial Sequence
  source: /note="Description of Artificial Sequence: Synthetic peptide"
NLRRGYPRL

SEQ ID NO: 23398 - protein, 9 aa, Artificial Sequence
  source: /note="Description of Artificial Sequence: Synthetic peptide"
TMAPTPPST

SEQ ID NO: 23399 - protein, 9 aa, Artificial Sequence
  source: /note="Description of Artificial Sequence: Synthetic peptide"
AMPSAMGVA

SEQ ID NO: 23400 - protein, 9 aa, Artificial Sequence
  source: /note="Description of Artificial Sequence: Synthetic peptide"
RMPPSGSQA

SEQ ID NO: 23401 - protein, 9 aa, Artificial Sequence
  source: /note="Description of Artificial Sequence: Synthetic peptide"
HLAVRTSML

SEQ ID NO: 23402 - protein, 9 aa, Artificial Sequence
  source: /note="Description of Artificial Sequence: Synthetic peptide"
RGYPRLKTF

SEQ ID NO: 23403 - protein, 9 aa, Artificial Sequence
  source: /note="Description of Artificial Sequence: Synthetic peptide"
RAPTAVPAF

SEQ ID NO: 23404 - protein, 9 aa, Artificial Sequence
  source: /note="Description of Artificial Sequence: Synthetic peptide"
LRRGYPRLK

SEQ ID NO: 23405 - protein, 9 aa, Artificial Sequence
  source: /note="Description of Artificial Sequence: Synthetic peptide"
STMAPTPPS

SEQ ID NO: 23406 - protein, 9 aa, Artificial Sequence
  source: /note="Description of Artificial Sequence: Synthetic peptide"
RASVPCRPM

SEQ ID NO: 23407 - protein, 9 aa, Artificial Sequence
  source: /note="Description of Artificial Sequence: Synthetic peptide"
SARPGPWRT

SEQ ID NO: 23408 - protein, 9 aa, Artificial Sequence
  source: /note="Description of Artificial Sequence: Synthetic peptide"
RTSAMPSAM

SEQ ID NO: 23409 - protein, 9 aa, Artificial Sequence
  source: /note="Description of Artificial Sequence: Synthetic peptide"
AVRTSMLTL

SEQ ID NO: 23410 - protein, 9 aa, Artificial Sequence
  source: /note="Description of Artificial Sequence: Synthetic peptide"
QWVNLRRGY

SEQ ID NO: 23411 - protein, 9 aa, Artificial Sequence
  source: /note="Description of Artificial Sequence: Synthetic peptide"
VNLRRGYPR

SEQ ID NO: 23412 - protein, 9 aa, Artificial Sequence
  source: /note="Description of Artificial Sequence: Synthetic peptide"
TPMIISTTR

SEQ ID NO: 23413 - protein, 9 aa, Artificial Sequence
  source: /note="Description of Artificial Sequence: Synthetic peptide"
STTRQECGR

SEQ ID NO: 23414 - protein, 9 aa, Artificial Sequence
  source: /note="Description of Artificial Sequence: Synthetic peptide"
TLCPAHPAR

SEQ ID NO: 23415 - protein, 9 aa, Artificial Sequence
  source: /note="Description of Artificial Sequence: Synthetic peptide"
CAACPCSPA

SEQ ID NO: 23416 - protein, 9 aa, Artificial Sequence
  source: /note="Description of Artificial Sequence: Synthetic peptide"
TAVPAFTPL

SEQ ID NO: 23417 - protein, 9 aa, Artificial Sequence
  source: /note="Description of Artificial Sequence: Synthetic peptide"
YPRLKTFGV

SEQ ID NO: 23418 - protein, 9 aa, Artificial Sequence
  source: /note="Description of Artificial Sequence: Synthetic peptide"
APTPPSTPM

SEQ ID NO: 23419 - protein, 9 aa, Artificial Sequence
  source: /note="Description of Artificial Sequence: Synthetic peptide"
RPGPWRTSA

SEQ ID NO: 23420 - protein, 9 aa, Artificial Sequence
  source: /note="Description of Artificial Sequence: Synthetic peptide"
MPSAMGVAL

SEQ ID NO: 23421 - protein, 9 aa, Artificial Sequence
  source: /note="Description of Artificial Sequence: Synthetic peptide"
SPPATGGRM

SEQ ID NO: 23422 - protein, 9 aa, Artificial Sequence
  source: /note="Description of Artificial Sequence: Synthetic peptide"
APPGSQSIM

SEQ ID NO: 23423 - protein, 9 aa, Artificial Sequence
  source: /note="Description of Artificial Sequence: Synthetic peptide"
MPPLAPCAA

SEQ ID NO: 23424 - protein, 9 aa, Artificial Sequence
  source: /note="Description of Artificial Sequence: Synthetic peptide"
CPCSPAPTL

SEQ ID NO: 23425 - protein, 9 aa, Artificial Sequence
  source: /note="Description of Artificial Sequence: Synthetic peptide"
SPAPTLCPA

SEQ ID NO: 23426 - protein, 9 aa, Artificial Sequence
  source: /note="Description of Artificial Sequence: Synthetic peptide"
HPARAPTAV

SEQ ID NO: 23427 - protein, 9 aa, Artificial Sequence
  source: /note="Description of Artificial Sequence: Synthetic peptide"
VPAFTPLSA

SEQ ID NO: 23428 - protein, 9 aa, Artificial Sequence
  source: /note="Description of Artificial Sequence: Synthetic peptide"
VPVLSGCHL

SEQ ID NO: 23429 - protein, 9 aa, Artificial Sequence
  source: /note="Description of Artificial Sequence: Synthetic peptide"
SQSIMMSWM

SEQ ID NO: 23430 - protein, 9 aa, Artificial Sequence
  source: /note="Description of Artificial Sequence: Synthetic peptide"
TSMLTLLPM

SEQ ID NO: 23431 - protein, 9 aa, Artificial Sequence
  source: /note="Description of Artificial Sequence: Synthetic peptide"
FGVPLGSIL

SEQ ID NO: 23432 - protein, 9 aa, Artificial Sequence
  source: /note="Description of Artificial Sequence: Synthetic peptide"
RQECGRRAS

SEQ ID NO: 23433 - protein, 9 aa, Artificial Sequence
  source: /note="Description of Artificial Sequence: Synthetic peptide"
IGSARPGPW

SEQ ID NO: 23434 - protein, 9 aa, Artificial Sequence
  source: /note="Description of Artificial Sequence: Synthetic peptide"
WRTSAMPSA

SEQ ID NO: 23435 - protein, 9 aa, Artificial Sequence
  source: /note="Description of Artificial Sequence: Synthetic peptide"
SAMGVALPT

SEQ ID NO: 23436 - protein, 9 aa, Artificial Sequence
  source: /note="Description of Artificial Sequence: Synthetic peptide"
CESGRSPPA

SEQ ID NO: 23437 - protein, 9 aa, Artificial Sequence
  source: /note="Description of Artificial Sequence: Synthetic peptide"
SQAPPGSQS

SEQ ID NO: 23438 - protein, 9 aa, Artificial Sequence
  source: /note="Description of Artificial Sequence: Synthetic peptide"
GSQSIMMSW

SEQ ID NO: 23439 - protein, 9 aa, Artificial Sequence
  source: /note="Description of Artificial Sequence: Synthetic peptide"
MSWMPPLAP

SEQ ID NO: 23440 - protein, 9 aa, Artificial Sequence
  source: /note="Description of Artificial Sequence: Synthetic peptide"
ARAPTAVPA

SEQ ID NO: 23441 - protein, 9 aa, Artificial Sequence
  source: /note="Description of Artificial Sequence: Synthetic peptide"
LSAHPVPVL

SEQ ID NO: 23442 - protein, 9 aa, Artificial Sequence
  source: /note="Description of Artificial Sequence: Synthetic peptide"
CHLAVRTSM

SEQ ID NO: 23443 - protein, 9 aa, Artificial Sequence
  source: /note="Description of Artificial Sequence: Synthetic peptide"
VRTSMLTLL

SEQ ID NO: 23444 - protein, 9 aa, Artificial Sequence
  source: /note="Description of Artificial Sequence: Synthetic peptide"
VPLGSILCL

SEQ ID NO: 23445 - protein, 9 aa, Artificial Sequence
  source: /note="Description of Artificial Sequence: Synthetic peptide"
QECGRRASV

SEQ ID NO: 23446 - protein, 9 aa, Artificial Sequence
  source: /note="Description of Artificial Sequence: Synthetic peptide"
TPPSTPMII

SEQ ID NO: 23447 - protein, 10 aa, Artificial Sequence
  source: /note="Description of Artificial Sequence: Synthetic peptide"
RTSMLTLLPM

SEQ ID NO: 23448 - protein, 10 aa, Artificial Sequence
  source: /note="Description of Artificial Sequence: Synthetic peptide"
CLAGSLSTMA

SEQ ID NO: 23449 - protein, 10 aa, Artificial Sequence
  source: /note="Description of Artificial Sequence: Synthetic peptide"
AMPSAMGVAL

SEQ ID NO: 23450 - protein, 10 aa, Artificial Sequence
  source: /note="Description of Artificial Sequence: Synthetic peptide"
SIMMSWMPPL

SEQ ID NO: 23451 - protein, 10 aa, Artificial Sequence
  source: /note="Description of Artificial Sequence: Synthetic peptide"
IMMSWMPPLA

SEQ ID NO: 23452 - protein, 10 aa, Artificial Sequence
  source: /note="Description of Artificial Sequence: Synthetic peptide"
WMPPLAPCAA

SEQ ID NO: 23453 - protein, 10 aa, Artificial Sequence
  source: /note="Description of Artificial Sequence: Synthetic peptide"
KTFGVPLGSI

SEQ ID NO: 23454 - protein, 10 aa, Artificial Sequence
  source: /note="Description of Artificial Sequence: Synthetic peptide"
SQAPPGSQSI

SEQ ID NO: 23455 - protein, 10 aa, Artificial Sequence
  source: /note="Description of Artificial Sequence: Synthetic peptide"
TLCPAHPARA

SEQ ID NO: 23456 - protein, 10 aa, Artificial Sequence
  source: /note="Description of Artificial Sequence: Synthetic peptide"
HLAVRTSMLT

SEQ ID NO: 23457 - protein, 10 aa, Artificial Sequence
  source: /note="Description of Artificial Sequence: Synthetic peptide"
AVRTSMLTLL

SEQ ID NO: 23458 - protein, 10 aa, Artificial Sequence
  source: /note="Description of Artificial Sequence: Synthetic peptide"
NLRRGYPRLK

SEQ ID NO: 23459 - protein, 10 aa, Artificial Sequence
  source: /note="Description of Artificial Sequence: Synthetic peptide"
WVNLRRGYPR

SEQ ID NO: 23460 - protein, 10 aa, Artificial Sequence
  source: /note="Description of Artificial Sequence: Synthetic peptide"
STPMIISTTR

SEQ ID NO: 23461 - protein, 10 aa, Artificial Sequence
  source: /note="Description of Artificial Sequence: Synthetic peptide"
RGYPRLKTFG

SEQ ID NO: 23462 - protein, 10 aa, Artificial Sequence
  source: /note="Description of Artificial Sequence: Synthetic peptide"
RLKTFGVPLG

SEQ ID NO: 23463 - protein, 10 aa, Artificial Sequence
  source: /note="Description of Artificial Sequence: Synthetic peptide"
STMAPTPPST

SEQ ID NO: 23464 - protein, 10 aa, Artificial Sequence
  source: /note="Description of Artificial Sequence: Synthetic peptide"
CGRRASVPCR

SEQ ID NO: 23465 - protein, 10 aa, Artificial Sequence
  source: /note="Description of Artificial Sequence: Synthetic peptide"
RASVPCRPMI

SEQ ID NO: 23466 - protein, 10 aa, Artificial Sequence
  source: /note="Description of Artificial Sequence: Synthetic peptide"
SARPGPWRTS

SEQ ID NO: 23467 - protein, 10 aa, Artificial Sequence
  source: /note="Description of Artificial Sequence: Synthetic peptide"
PWRTSAMPSA

SEQ ID NO: 23468 - protein, 10 aa, Artificial Sequence
  source: /note="Description of Artificial Sequence: Synthetic peptide"
RTSAMPSAMG

SEQ ID NO: 23469 - protein, 10 aa, Artificial Sequence
  source: /note="Description of Artificial Sequence: Synthetic peptide"
SWMPPLAPCA

SEQ ID NO: 23470 - protein, 10 aa, Artificial Sequence
  source: /note="Description of Artificial Sequence: Synthetic peptide"
QQWVNLRRGY

SEQ ID NO: 23471 - protein, 10 aa, Artificial Sequence
  source: /note="Description of Artificial Sequence: Synthetic peptide"
PTLCPAHPAR

SEQ ID NO: 23472 - protein, 10 aa, Artificial Sequence
  source: /note="Description of Artificial Sequence: Synthetic peptide"
VLSGCHLAVR

SEQ ID NO: 23473 - protein, 10 aa, Artificial Sequence
  source: /note="Description of Artificial Sequence: Synthetic peptide"
MAPTPPSTPM

SEQ ID NO: 23474 - protein, 10 aa, Artificial Sequence
  source: /note="Description of Artificial Sequence: Synthetic peptide"
TSAMPSAMGV

SEQ ID NO: 23475 - protein, 10 aa, Artificial Sequence
  source: /note="Description of Artificial Sequence: Synthetic peptide"
YPRLKTFGVP

SEQ ID NO: 23476 - protein, 10 aa, Artificial Sequence
  source: /note="Description of Artificial Sequence: Synthetic peptide"
APTPPSTPMI

SEQ ID NO: 23477 - protein, 10 aa, Artificial Sequence
  source: /note="Description of Artificial Sequence: Synthetic peptide"
RPMIGSARPG

SEQ ID NO: 23478 - protein, 10 aa, Artificial Sequence
  source: /note="Description of Artificial Sequence: Synthetic peptide"
RPGPWRTSAM

SEQ ID NO: 23479 - protein, 10 aa, Artificial Sequence
  source: /note="Description of Artificial Sequence: Synthetic peptide"
APPGSQSIMM

SEQ ID NO: 23480 - protein, 10 aa, Artificial Sequence
  source: /note="Description of Artificial Sequence: Synthetic peptide"
APTLCPAHPA

SEQ ID NO: 23481 - protein, 10 aa, Artificial Sequence
  source: /note="Description of Artificial Sequence: Synthetic peptide"
CPAHPARAPT

SEQ ID NO: 23482 - protein, 10 aa, Artificial Sequence
  source: /note="Description of Artificial Sequence: Synthetic peptide"
TPLSAHPVPV

SEQ ID NO: 23483 - protein, 10 aa, Artificial Sequence
  source: /note="Description of Artificial Sequence: Synthetic peptide"
RRGYPRLKTF

SEQ ID NO: 23484 - protein, 10 aa, Artificial Sequence
  source: /note="Description of Artificial Sequence: Synthetic peptide"
LCLAGSLSTM

SEQ ID NO: 23485 - protein, 10 aa, Artificial Sequence
  source: /note="Description of Artificial Sequence: Synthetic peptide"
RQECGRRASV

SEQ ID NO: 23486 - protein, 10 aa, Artificial Sequence
  source: /note="Description of Artificial Sequence: Synthetic peptide"
RRASVPCRPM

SEQ ID NO: 23487 - protein, 10 aa, Artificial Sequence
  source: /note="Description of Artificial Sequence: Synthetic peptide"
MIGSARPGPW

SEQ ID NO: 23488 - protein, 10 aa, Artificial Sequence
  source: /note="Description of Artificial Sequence: Synthetic peptide"
WRTSAMPSAM

SEQ ID NO: 23489 - protein, 10 aa, Artificial Sequence
  source: /note="Description of Artificial Sequence: Synthetic peptide"
SAMPSAMGVA

SEQ ID NO: 23490 - protein, 10 aa, Artificial Sequence
  source: /note="Description of Artificial Sequence: Synthetic peptide"
RMPPSGSQAP

SEQ ID NO: 23491 - protein, 10 aa, Artificial Sequence
  source: /note="Description of Artificial Sequence: Synthetic peptide"
MMSWMPPLAP

SEQ ID NO: 23492 - protein, 10 aa, Artificial Sequence
  source: /note="Description of Artificial Sequence: Synthetic peptide"
ARAPTAVPAF

SEQ ID NO: 23493 - protein, 10 aa, Artificial Sequence
  source: /note="Description of Artificial Sequence: Synthetic peptide"
GCHLAVRTSM

SEQ ID NO: 23494 - protein, 10 aa, Artificial Sequence
  source: /note="Description of Artificial Sequence: Synthetic peptide"
CHLAVRTSML

SEQ ID NO: 23495 - protein, 10 aa, Artificial Sequence
  source: /note="Description of Artificial Sequence: Synthetic peptide"
LAVRTSMLTL

SEQ ID NO: 23496 - protein, 10 aa, Artificial Sequence
  source: /note="Description of Artificial Sequence: Synthetic peptide"
MPSAMGVALP

SEQ ID NO: 23497 - protein, 10 aa, Artificial Sequence
  source: /note="Description of Artificial Sequence: Synthetic peptide"
MPPLAPCAAC

SEQ ID NO: 23498 - protein, 10 aa, Artificial Sequence
  source: /note="Description of Artificial Sequence: Synthetic peptide"
SPAPTLCPAH

SEQ ID NO: 23499 - protein, 10 aa, Artificial Sequence
  source: /note="Description of Artificial Sequence: Synthetic peptide"
VPAFTPLSAH

SEQ ID NO: 23500 - protein, 10 aa, Artificial Sequence
  source: /note="Description of Artificial Sequence: Synthetic peptide"
HPVPVLSGCH

SEQ ID NO: 23501 - protein, 10 aa, Artificial Sequence
  source: /note="Description of Artificial Sequence: Synthetic peptide"
CESGRSPPAT

SEQ ID NO: 23502 - protein, 10 aa, Artificial Sequence
  source: /note="Description of Artificial Sequence: Synthetic peptide"
VPLGSILCLA

SEQ ID NO: 23503 - protein, 10 aa, Artificial Sequence
  source: /note="Description of Artificial Sequence: Synthetic peptide"
VPVLSGCHLA

SEQ ID NO: 23504 - protein, 9 aa, Artificial Sequence
  source: /note="Description of Artificial Sequence: Synthetic peptide"
RSRRVCPKV

SEQ ID NO: 23505 - protein, 9 aa, Artificial Sequence
  source: /note="Description of Artificial Sequence: Synthetic peptide"
RVCPKVRCV

SEQ ID NO: 23506 - protein, 9 aa, Artificial Sequence
  source: /note="Description of Artificial Sequence: Synthetic peptide"
CPKVRCVTR

SEQ ID NO: 23507 - protein, 10 aa, Artificial Sequence
  source: /note="Description of Artificial Sequence: Synthetic peptide"
RSRRVCPKVR

SEQ ID NO: 23508 - protein, 9 aa, Artificial Sequence
  source: /note="Description of Artificial Sequence: Synthetic peptide"
KLIDQHETM

SEQ ID NO: 23509 - protein, 9 aa, Artificial Sequence
  source: /note="Description of Artificial Sequence: Synthetic peptide"
RTAQEVAKL

SEQ ID NO: 23510 - protein, 10 aa, Artificial Sequence
  source: /note="Description of Artificial Sequence: Synthetic peptide"
KLIDQHETMM

SEQ ID NO: 23511 - protein, 10 aa, Artificial Sequence
  source: /note="Description of Artificial Sequence: Synthetic peptide"
AKLIDQHETM

SEQ ID NO: 23512 - protein, 9 aa, Artificial Sequence
  source: /note="Description of Artificial Sequence: Synthetic peptide"
TQIRVQPLI

SEQ ID NO: 23513 - protein, 9 aa, Artificial Sequence
  source: /note="Description of Artificial Sequence: Synthetic peptide"
LTQIRVQPL

SEQ ID NO: 23514 - protein, 9 aa, Artificial Sequence
  source: /note="Description of Artificial Sequence: Synthetic peptide"
LKFLTQIRV

SEQ ID NO: 23515 - protein, 9 aa, Artificial Sequence
  source: /note="Description of Artificial Sequence: Synthetic peptide"
IRVQPLINL

SEQ ID NO: 23516 - protein, 9 aa, Artificial Sequence
  source: /note="Description of Artificial Sequence: Synthetic peptide"
VQPLINLQM

SEQ ID NO: 23517 - protein, 10 aa, Artificial Sequence
  source: /note="Description of Artificial Sequence: Synthetic peptide"
FLTQIRVQPL

SEQ ID NO: 23518 - protein, 10 aa, Artificial Sequence
  source: /note="Description of Artificial Sequence: Synthetic peptide"
ALKFLTQIRV

SEQ ID NO: 23519 - protein, 10 aa, Artificial Sequence
  source: /note="Description of Artificial Sequence: Synthetic peptide"
QIRVQPLINL

SEQ ID NO: 23520 - protein, 10 aa, Artificial Sequence
  source: /note="Description of Artificial Sequence: Synthetic peptide"
RVQPLINLQM

SEQ ID NO: 23521 - protein, 9 aa, Artificial Sequence
  source: /note="Description of Artificial Sequence: Synthetic peptide"
LLAPMDFYR

SEQ ID NO: 23522 - protein, 9 aa, Artificial Sequence
  source: /note="Description of Artificial Sequence: Synthetic peptide"
LAPMDFYRF

SEQ ID NO: 23523 - protein, 9 aa, Artificial Sequence
  source: /note="Description of Artificial Sequence: Synthetic peptide"
GLLAPMDFY

SEQ ID NO: 23524 - protein, 9 aa, Artificial Sequence
  source: /note="Description of Artificial Sequence: Synthetic peptide"
FSEGLLAPM

SEQ ID NO: 23525 - protein, 10 aa, Artificial Sequence
  source: /note="Description of Artificial Sequence: Synthetic peptide"
LLAPMDFYRF

SEQ ID NO: 23526 - protein, 10 aa, Artificial Sequence
  source: /note="Description of Artificial Sequence: Synthetic peptide"
GLLAPMDFYR

SEQ ID NO: 23527 - protein, 10 aa, Artificial Sequence
  source: /note="Description of Artificial Sequence: Synthetic peptide"
SEGLLAPMDF

SEQ ID NO: 23528 - protein, 10 aa, Artificial Sequence
  source: /note="Description of Artificial Sequence: Synthetic peptide"
DFSEGLLAPM

SEQ ID NO: 23529 - protein, 9 aa, Artificial Sequence
  source: /note="Description of Artificial Sequence: Synthetic peptide"
ATYTPRHPR

SEQ ID NO: 23530 - protein, 10 aa, Artificial Sequence
  source: /note="Description of Artificial Sequence: Synthetic peptide"
ATYTPRHPRS

SEQ ID NO: 23531 - protein, 10 aa, Artificial Sequence
  source: /note="Description of Artificial Sequence: Synthetic peptide"
GATYTPRHPR

SEQ ID NO: 23532 - protein, 9 aa, Artificial Sequence
  source: /note="Description of Artificial Sequence: Synthetic peptide"
GMDDSPQPA

SEQ ID NO: 23533 - protein, 10 aa, Artificial Sequence
  source: /note="Description of Artificial Sequence: Synthetic peptide"
GMDDSPQPAK

SEQ ID NO: 23534 - protein, 10 aa, Artificial Sequence
  source: /note="Description of Artificial Sequence: Synthetic peptide"
SPQPAKPSQA

SEQ ID NO: 23535 - protein, 9 aa, Artificial Sequence
  source: /note="Description of Artificial Sequence: Synthetic peptide"
ALESSVWGL

SEQ ID NO: 23536 - protein, 9 aa, Artificial Sequence
  source: /note="Description of Artificial Sequence: Synthetic peptide"
ESSVWGLPA

SEQ ID NO: 23537 - protein, 9 aa, Artificial Sequence
  source: /note="Description of Artificial Sequence: Synthetic peptide"
SVWGLPAGA

SEQ ID NO: 23538 - protein, 9 aa, Artificial Sequence
  source: /note="Description of Artificial Sequence: Synthetic peptide"
VEALESSVW

SEQ ID NO: 23539 - protein, 10 aa, Artificial Sequence
  source: /note="Description of Artificial Sequence: Synthetic peptide"
EALESSVWGL

SEQ ID NO: 23540 - protein, 10 aa, Artificial Sequence
  source: /note="Description of Artificial Sequence: Synthetic peptide"
SSVWGLPAGA

SEQ ID NO: 23541 - protein, 10 aa, Artificial Sequence
  source: /note="Description of Artificial Sequence: Synthetic peptide"
LESSVWGLPA

SEQ ID NO: 23542 - protein, 9 aa, Artificial Sequence
  source: /note="Description of Artificial Sequence: Synthetic peptide"
SFEVGVWSI

SEQ ID NO: 23543 - protein, 9 aa, Artificial Sequence
  source: /note="Description of Artificial Sequence: Synthetic peptide"
KGHSFEVGV

SEQ ID NO: 23544 - protein, 9 aa, Artificial Sequence
  source: /note="Description of Artificial Sequence: Synthetic peptide"
GVWSIGCIM

SEQ ID NO: 23545 - protein, 9 aa, Artificial Sequence
  source: /note="Description of Artificial Sequence: Synthetic peptide"
FEVGVWSIG

SEQ ID NO: 23546 - protein, 10 aa, Artificial Sequence
  source: /note="Description of Artificial Sequence: Synthetic peptide"
GVWSIGCIMY

SEQ ID NO: 23547 - protein, 10 aa, Artificial Sequence
  source: /note="Description of Artificial Sequence: Synthetic peptide"
HSFEVGVWSI

SEQ ID NO: 23548 - protein, 10 aa, Artificial Sequence
  source: /note="Description of Artificial Sequence: Synthetic peptide"
EVGVWSIGCI

SEQ ID NO: 23549 - protein, 10 aa, Artificial Sequence
  source: /note="Description of Artificial Sequence: Synthetic peptide"
KGHSFEVGVW

SEQ ID NO: 23550 - protein, 10 aa, Artificial Sequence
  source: /note="Description of Artificial Sequence: Synthetic peptide"
VGVWSIGCIM

SEQ ID NO: 23551 - protein, 10 aa, Artificial Sequence
  source: /note="Description of Artificial Sequence: Synthetic peptide"
FEVGVWSIGC

SEQ ID NO: 23552 - protein, 9 aa, Artificial Sequence
  source: /note="Description of Artificial Sequence: Synthetic peptide"
RVCGTAYSV

SEQ ID NO: 23553 - protein, 9 aa, Artificial Sequence
  source: /note="Description of Artificial Sequence: Synthetic peptide"
SVSAPLPAA

SEQ ID NO: 23554 - protein, 9 aa, Artificial Sequence
  source: /note="Description of Artificial Sequence: Synthetic peptide"
SGRVCGTAY

SEQ ID NO: 23555 - protein, 9 aa, Artificial Sequence
  source: /note="Description of Artificial Sequence: Synthetic peptide"
AATPGLSPR

SEQ ID NO: 23556 - protein, 9 aa, Artificial Sequence
  source: /note="Description of Artificial Sequence: Synthetic peptide"
TAYSVSAPL

SEQ ID NO: 23557 - protein, 9 aa, Artificial Sequence
  source: /note="Description of Artificial Sequence: Synthetic peptide"
YSVSAPLPA

SEQ ID NO: 23558 - protein, 9 aa, Artificial Sequence
  source: /note="Description of Artificial Sequence: Synthetic peptide"
APLPAAAAT

SEQ ID NO: 23559 - protein, 9 aa, Artificial Sequence
  source: /note="Description of Artificial Sequence: Synthetic peptide"
LPAAAATPG

SEQ ID NO: 23560 - protein, 9 aa, Artificial Sequence
  source: /note="Description of Artificial Sequence: Synthetic peptide"
LSPRQGHPF

SEQ ID NO: 23561 - protein, 9 aa, Artificial Sequence
  source: /note="Description of Artificial Sequence: Synthetic peptide"
RQGHPFPAQ

SEQ ID NO: 23562 - protein, 10 aa, Artificial Sequence
  source: /note="Description of Artificial Sequence: Synthetic peptide"
VSGRVCGTAY

SEQ ID NO: 23563 - protein, 10 aa, Artificial Sequence
  source: /note="Description of Artificial Sequence: Synthetic peptide"
GTAYSVSAPL

SEQ ID NO: 23564 - protein, 10 aa, Artificial Sequence
  source: /note="Description of Artificial Sequence: Synthetic peptide"
SVSAPLPAAA

SEQ ID NO: 23565 - protein, 10 aa, Artificial Sequence
  source: /note="Description of Artificial Sequence: Synthetic peptide"
AAATPGLSPR

SEQ ID NO: 23566 - protein, 10 aa, Artificial Sequence
  source: /note="Description of Artificial Sequence: Synthetic peptide"
YSVSAPLPAA

SEQ ID NO: 23567 - protein, 10 aa, Artificial Sequence
  source: /note="Description of Artificial Sequence: Synthetic peptide"
LPAAAATPGL

SEQ ID NO: 23568 - protein, 10 aa, Artificial Sequence
  source: /note="Description of Artificial Sequence: Synthetic peptide"
SPRQGHPFPA

SEQ ID NO: 23569 - protein, 10 aa, Artificial Sequence
  source: /note="Description of Artificial Sequence: Synthetic peptide"
HPFPAQQRGL

SEQ ID NO: 23570 - protein, 10 aa, Artificial Sequence
  source: /note="Description of Artificial Sequence: Synthetic peptide"
GLSPRQGHPF

SEQ ID NO: 23571 - protein, 10 aa, Artificial Sequence
  source: /note="Description of Artificial Sequence: Synthetic peptide"
GRVCGTAYSV

SEQ ID NO: 23572 - protein, 9 aa, Artificial Sequence
  source: /note="Description of Artificial Sequence: Synthetic peptide"
FWPCLWNSL

SEQ ID NO: 23573 - protein, 9 aa, Artificial Sequence
  source: /note="Description of Artificial Sequence: Synthetic peptide"
CLWNSLLRF

SEQ ID NO: 23574 - protein, 9 aa, Artificial Sequence
  source: /note="Description of Artificial Sequence: Synthetic peptide"
NSLLRFCPA

SEQ ID NO: 23575 - protein, 9 aa, Artificial Sequence
  source: /note="Description of Artificial Sequence: Synthetic peptide"
TTRSSMNPT

SEQ ID NO: 23576 - protein, 9 aa, Artificial Sequence
  source: /note="Description of Artificial Sequence: Synthetic peptide"
RSSMNPTSL

SEQ ID NO: 23577 - protein, 9 aa, Artificial Sequence
  source: /note="Description of Artificial Sequence: Synthetic peptide"
RSSRTTSQL

SEQ ID NO: 23578 - protein, 9 aa, Artificial Sequence
  source: /note="Description of Artificial Sequence: Synthetic peptide"
SPFSCTTTR

SEQ ID NO: 23579 - protein, 9 aa, Artificial Sequence
  source: /note="Description of Artificial Sequence: Synthetic peptide"
SLTPGRSSR

SEQ ID NO: 23580 - protein, 9 aa, Artificial Sequence
  source: /note="Description of Artificial Sequence: Synthetic peptide"
TIPPTGSPF

SEQ ID NO: 23581 - protein, 9 aa, Artificial Sequence
  source: /note="Description of Artificial Sequence: Synthetic peptide"
CPASCSGCY

SEQ ID NO: 23582 - protein, 9 aa, Artificial Sequence
  source: /note="Description of Artificial Sequence: Synthetic peptide"
ASCSGCYSW

SEQ ID NO: 23583 - protein, 9 aa, Artificial Sequence
  source: /note="Description of Artificial Sequence: Synthetic peptide"
SCTTTRSSM

SEQ ID NO: 23584 - protein, 9 aa, Artificial Sequence
  source: /note="Description of Artificial Sequence: Synthetic peptide"
SMNPTSLTP

SEQ ID NO: 23585 - protein, 9 aa, Artificial Sequence
  source: /note="Description of Artificial Sequence: Synthetic peptide"
WPCLWNSLL

SEQ ID NO: 23586 - protein, 10 aa, Artificial Sequence
  source: /note="Description of Artificial Sequence: Synthetic peptide"
CFWPCLWNSL

SEQ ID NO: 23587 - protein, 10 aa, Artificial Sequence
  source: /note="Description of Artificial Sequence: Synthetic peptide"
FWPCLWNSLL

SEQ ID NO: 23588 - protein, 10 aa, Artificial Sequence
  source: /note="Description of Artificial Sequence: Synthetic peptide"
WTIPPTGSPF

SEQ ID NO: 23589 - protein, 10 aa, Artificial Sequence
  source: /note="Description of Artificial Sequence: Synthetic peptide"
TTRSSMNPTS

SEQ ID NO: 23590 - protein, 10 aa, Artificial Sequence
  source: /note="Description of Artificial Sequence: Synthetic peptide"
RSSMNPTSLT

SEQ ID NO: 23591 - protein, 10 aa, Artificial Sequence
  source: /note="Description of Artificial Sequence: Synthetic peptide"
TSLTPGRSSR

SEQ ID NO: 23592 - protein, 10 aa, Artificial Sequence
  source: /note="Description of Artificial Sequence: Synthetic peptide"
MNPTSLTPGR

SEQ ID NO: 23593 - protein, 10 aa, Artificial Sequence
  source: /note="Description of Artificial Sequence: Synthetic peptide"
FSCTTTRSSM

SEQ ID NO: 23594 - protein, 10 aa, Artificial Sequence
  source: /note="Description of Artificial Sequence: Synthetic peptide"
TRSSMNPTSL

SEQ ID NO: 23595 - protein, 10 aa, Artificial Sequence
  source: /note="Description of Artificial Sequence: Synthetic peptide"
SMNPTSLTPG

SEQ ID NO: 23596 - protein, 10 aa, Artificial Sequence
  source: /note="Description of Artificial Sequence: Synthetic peptide"
GRSSRTTSQL

SEQ ID NO: 23597 - protein, 9 aa, Artificial Sequence
  source: /note="Description of Artificial Sequence: Synthetic peptide"
KFLVQIDQI

SEQ ID NO: 23598 - protein, 9 aa, Artificial Sequence
  source: /note="Description of Artificial Sequence: Synthetic peptide"
VPSGLKFLV

SEQ ID NO: 23599 - protein, 10 aa, Artificial Sequence
  source: /note="Description of Artificial Sequence: Synthetic peptide"
GVPSGLKFLV

SEQ ID NO: 23600 - protein, 10 aa, Artificial Sequence
  source: /note="Description of Artificial Sequence: Synthetic peptide"
KFLVQIDQIL

SEQ ID NO: 23601 - protein, 10 aa, Artificial Sequence
  source: /note="Description of Artificial Sequence: Synthetic peptide"
LPGVPSGLKF

SEQ ID NO: 23602 - protein, 10 aa, Artificial Sequence
  source: /note="Description of Artificial Sequence: Synthetic peptide"
LKFLVQIDQI

SEQ ID NO: 23603 - protein, 10 aa, Artificial Sequence
  source: /note="Description of Artificial Sequence: Synthetic peptide"
INRAQLTNPR

SEQ ID NO: 23604 - protein, 9 aa, Artificial Sequence
  source: /note="Description of Artificial Sequence: Synthetic peptide"
ASIPFLDYR

SEQ ID NO: 23605 - protein, 9 aa, Artificial Sequence
  source: /note="Description of Artificial Sequence: Synthetic peptide"
GASIPFLDY

SEQ ID NO: 23606 - protein, 9 aa, Artificial Sequence
  source: /note="Description of Artificial Sequence: Synthetic peptide"
DLDGASIPF

SEQ ID NO: 23607 - protein, 10 aa, Artificial Sequence
  source: /note="Description of Artificial Sequence: Synthetic peptide"
GASIPFLDYR

SEQ ID NO: 23608 - protein, 10 aa, Artificial Sequence
  source: /note="Description of Artificial Sequence: Synthetic peptide"
SIPFLDYRTY

SEQ ID NO: 23609 - protein, 10 aa, Artificial Sequence
  source: /note="Description of Artificial Sequence: Synthetic peptide"
LTNDLDGASI

SEQ ID NO: 23610 - protein, 10 aa, Artificial Sequence
  source: /note="Description of Artificial Sequence: Synthetic peptide"
NDLDGASIPF

SEQ ID NO: 23611 - protein, 9 aa, Artificial Sequence
  source: /note="Description of Artificial Sequence: Synthetic peptide"
STRWSLCSR

SEQ ID NO: 23612 - protein, 9 aa, Artificial Sequence
  source: /note="Description of Artificial Sequence: Synthetic peptide"
KIRADGPPP

SEQ ID NO: 23613 - protein, 9 aa, Artificial Sequence
  source: /note="Description of Artificial Sequence: Synthetic peptide"
SATCTSCLR

SEQ ID NO: 23614 - protein, 9 aa, Artificial Sequence
  source: /note="Description of Artificial Sequence: Synthetic peptide"
WPSPLISAT

SEQ ID NO: 23615 - protein, 9 aa, Artificial Sequence
  source: /note="Description of Artificial Sequence: Synthetic peptide"
SPWSHVSSI

SEQ ID NO: 23616 - protein, 9 aa, Artificial Sequence
  source: /note="Description of Artificial Sequence: Synthetic peptide"
IRADGPPPM

SEQ ID NO: 23617 - protein, 9 aa, Artificial Sequence
  source: /note="Description of Artificial Sequence: Synthetic peptide"
PMVGSSTRW

SEQ ID NO: 23618 - protein, 9 aa, Artificial Sequence
  source: /note="Description of Artificial Sequence: Synthetic peptide"
VGSSTRWSL

SEQ ID NO: 23619 - protein, 9 aa, Artificial Sequence
  source: /note="Description of Artificial Sequence: Synthetic peptide"
TEAPSSGTW

SEQ ID NO: 23620 - protein, 9 aa, Artificial Sequence
  source: /note="Description of Artificial Sequence: Synthetic peptide"
ISATCTSCL

SEQ ID NO: 23621 - protein, 9 aa, Artificial Sequence
  source: /note="Description of Artificial Sequence: Synthetic peptide"
RDRSPGSPW

SEQ ID NO: 23622 - protein, 9 aa, Artificial Sequence
  source: /note="Description of Artificial Sequence: Synthetic peptide"
WSHVSSIRL

SEQ ID NO: 23623 - protein, 9 aa, Artificial Sequence
  source: /note="Description of Artificial Sequence: Synthetic peptide"
SPGSPWSHV

SEQ ID NO: 23624 - protein, 10 aa, Artificial Sequence
  source: /note="Description of Artificial Sequence: Synthetic peptide"
LISATCTSCL

SEQ ID NO: 23625 - protein, 10 aa, Artificial Sequence
  source: /note="Description of Artificial Sequence: Synthetic peptide"
SSTRWSLCSR

SEQ ID NO: 23626 - protein, 10 aa, Artificial Sequence
  source: /note="Description of Artificial Sequence: Synthetic peptide"
ISATCTSCLR

SEQ ID NO: 23627 - protein, 10 aa, Artificial Sequence
  source: /note="Description of Artificial Sequence: Synthetic peptide"
KIRADGPPPM

SEQ ID NO: 23628 - protein, 10 aa, Artificial Sequence
  source: /note="Description of Artificial Sequence: Synthetic peptide"
STRWSLCSRT

SEQ ID NO: 23629 - protein, 10 aa, Artificial Sequence
  source: /note="Description of Artificial Sequence: Synthetic peptide"
RWSLCSRTEA

SEQ ID NO: 23630 - protein, 10 aa, Artificial Sequence
  source: /note="Description of Artificial Sequence: Synthetic peptide"
MVGSSTRWSL

SEQ ID NO: 23631 - protein, 10 aa, Artificial Sequence
  source: /note="Description of Artificial Sequence: Synthetic peptide"
RTEAPSSGTW

SEQ ID NO: 23632 - protein, 10 aa, Artificial Sequence
  source: /note="Description of Artificial Sequence: Synthetic peptide"
WPSPLISATC

SEQ ID NO: 23633 - protein, 10 aa, Artificial Sequence
  source: /note="Description of Artificial Sequence: Synthetic peptide"
PPMVGSSTRW

SEQ ID NO: 23634 - protein, 9 aa, Artificial Sequence
  source: /note="Description of Artificial Sequence: Synthetic peptide"
KLASNLTEL

SEQ ID NO: 23635 - protein, 9 aa, Artificial Sequence
  source: /note="Description of Artificial Sequence: Synthetic peptide"
RVFKLASNL

SEQ ID NO: 23636 - protein, 9 aa, Artificial Sequence
  source: /note="Description of Artificial Sequence: Synthetic peptide"
LASNLTELR

SEQ ID NO: 23637 - protein, 10 aa, Artificial Sequence
  source: /note="Description of Artificial Sequence: Synthetic peptide"
KLASNLTELR

SEQ ID NO: 23638 - protein, 10 aa, Artificial Sequence
  source: /note="Description of Artificial Sequence: Synthetic peptide"
RVFKLASNLT

SEQ ID NO: 23639 - protein, 10 aa, Artificial Sequence
  source: /note="Description of Artificial Sequence: Synthetic peptide"
FKLASNLTEL

SEQ ID NO: 23640 - protein, 10 aa, Artificial Sequence
  source: /note="Description of Artificial Sequence: Synthetic peptide"
NKHKSCLECL

SEQ ID NO: 23641 - protein, 9 aa, Artificial Sequence
  source: /note="Description of Artificial Sequence: Synthetic peptide"
KVCTNVTVK

SEQ ID NO: 23642 - protein, 9 aa, Artificial Sequence
  source: /note="Description of Artificial Sequence: Synthetic peptide"
CTNVTVKLR

SEQ ID NO: 23643 - protein, 9 aa, Artificial Sequence
  source: /note="Description of Artificial Sequence: Synthetic peptide"
KSSKVCTNV

SEQ ID NO: 23644 - protein, 9 aa, Artificial Sequence
  source: /note="Description of Artificial Sequence: Synthetic peptide"
SKVCTNVTV

SEQ ID NO: 23645 - protein, 10 aa, Artificial Sequence
  source: /note="Description of Artificial Sequence: Synthetic peptide"
SSKVCTNVTV

SEQ ID NO: 23646 - protein, 9 aa, Artificial Sequence
  source: /note="Description of Artificial Sequence: Synthetic peptide"
VFPARELLF

SEQ ID NO: 23647 - protein, 9 aa, Artificial Sequence
  source: /note="Description of Artificial Sequence: Synthetic peptide"
SVFPARELL

SEQ ID NO: 23648 - protein, 9 aa, Artificial Sequence
  source: /note="Description of Artificial Sequence: Synthetic peptide"
ELLFAVFER

SEQ ID NO: 23649 - protein, 9 aa, Artificial Sequence
  source: /note="Description of Artificial Sequence: Synthetic peptide"
ARELLFAVF

SEQ ID NO: 23650 - protein, 9 aa, Artificial Sequence
  source: /note="Description of Artificial Sequence: Synthetic peptide"
FPARELLFA

SEQ ID NO: 23651 - protein, 9 aa, Artificial Sequence
  source: /note="Description of Artificial Sequence: Synthetic peptide"
RELLFAVFE

SEQ ID NO: 23652 - protein, 10 aa, Artificial Sequence
  source: /note="Description of Artificial Sequence: Synthetic peptide"
SVFPARELLF

SEQ ID NO: 23653 - protein, 10 aa, Artificial Sequence
  source: /note="Description of Artificial Sequence: Synthetic peptide"
FPARELLFAV

SEQ ID NO: 23654 - protein, 10 aa, Artificial Sequence
  source: /note="Description of Artificial Sequence: Synthetic peptide"
PARELLFAVF

SEQ ID NO: 23655 - protein, 9 aa, Artificial Sequence
  source: /note="Description of Artificial Sequence: Synthetic peptide"
RLGGPCPPA

SEQ ID NO: 23656 - protein, 9 aa, Artificial Sequence
  source: /note="Description of Artificial Sequence: Synthetic peptide"
AVTRASAPR

SEQ ID NO: 23657 - protein, 9 aa, Artificial Sequence
  source: /note="Description of Artificial Sequence: Synthetic peptide"
ATAAAGAWR

SEQ ID NO: 23658 - protein, 9 aa, Artificial Sequence
  source: /note="Description of Artificial Sequence: Synthetic peptide"
SSTSRAVGR

SEQ ID NO: 23659 - protein, 9 aa, Artificial Sequence
  source: /note="Description of Artificial Sequence: Synthetic peptide"
AVGRPPCWR

SEQ ID NO: 23660 - protein, 9 aa, Artificial Sequence
  source: /note="Description of Artificial Sequence: Synthetic peptide"
VTRASAPRA

SEQ ID NO: 23661 - protein, 9 aa, Artificial Sequence
  source: /note="Description of Artificial Sequence: Synthetic peptide"
RASAPRATA

SEQ ID NO: 23662 - protein, 9 aa, Artificial Sequence
  source: /note="Description of Artificial Sequence: Synthetic peptide"
AWRGRRPPT

SEQ ID NO: 23663 - protein, 9 aa, Artificial Sequence
  source: /note="Description of Artificial Sequence: Synthetic peptide"
RGRRPPTAR

SEQ ID NO: 23664 - protein, 9 aa, Artificial Sequence
  source: /note="Description of Artificial Sequence: Synthetic peptide"
TARSSATTR

SEQ ID NO: 23665 - protein, 9 aa, Artificial Sequence
  source: /note="Description of Artificial Sequence: Synthetic peptide"
AAGAWRGRR

SEQ ID NO: 23666 - protein, 9 aa, Artificial Sequence
  source: /note="Description of Artificial Sequence: Synthetic peptide"
SAPRATAAA

SEQ ID NO: 23667 - protein, 9 aa, Artificial Sequence
  source: /note="Description of Artificial Sequence: Synthetic peptide"
APRATAAAG

SEQ ID NO: 23668 - protein, 9 aa, Artificial Sequence
  source: /note="Description of Artificial Sequence: Synthetic peptide"
RPPTARSSA

SEQ ID NO: 23669 - protein, 9 aa, Artificial Sequence
  source: /note="Description of Artificial Sequence: Synthetic peptide"
RPPCWRGPG

SEQ ID NO: 23670 - protein, 9 aa, Artificial Sequence
  source: /note="Description of Artificial Sequence: Synthetic peptide"
RATAAAGAW

SEQ ID NO: 23671 - protein, 9 aa, Artificial Sequence
  source: /note="Description of Artificial Sequence: Synthetic peptide"
RAVGRPPCW

SEQ ID NO: 23672 - protein, 10 aa, Artificial Sequence
  source: /note="Description of Artificial Sequence: Synthetic peptide"
RLGGPCPPAV

SEQ ID NO: 23673 - protein, 10 aa, Artificial Sequence
  source: /note="Description of Artificial Sequence: Synthetic peptide"
VTRASAPRAT

SEQ ID NO: 23674 - protein, 10 aa, Artificial Sequence
  source: /note="Description of Artificial Sequence: Synthetic peptide"
RASAPRATAA

SEQ ID NO: 23675 - protein, 10 aa, Artificial Sequence
  source: /note="Description of Artificial Sequence: Synthetic peptide"
ASAPRATAAA

SEQ ID NO: 23676 - protein, 10 aa, Artificial Sequence
  source: /note="Description of Artificial Sequence: Synthetic peptide"
RATAAAGAWR

SEQ ID NO: 23677 - protein, 10 aa, Artificial Sequence
  source: /note="Description of Artificial Sequence: Synthetic peptide"
AWRGRRPPTA

SEQ ID NO: 23678 - protein, 10 aa, Artificial Sequence
  source: /note="Description of Artificial Sequence: Synthetic peptide"
RGRRPPTARS

SEQ ID NO: 23679 - protein, 10 aa, Artificial Sequence
  source: /note="Description of Artificial Sequence: Synthetic peptide"
TSRAVGRPPC

SEQ ID NO: 23680 - protein, 10 aa, Artificial Sequence
  source: /note="Description of Artificial Sequence: Synthetic peptide"
RAVGRPPCWR

SEQ ID NO: 23681 - protein, 10 aa, Artificial Sequence
  source: /note="Description of Artificial Sequence: Synthetic peptide"
TAAAGAWRGR

SEQ ID NO: 23682 - protein, 10 aa, Artificial Sequence
  source: /note="Description of Artificial Sequence: Synthetic peptide"
AAAGAWRGRR

SEQ ID NO: 23683 - protein, 10 aa, Artificial Sequence
  source: /note="Description of Artificial Sequence: Synthetic peptide"
CPPAVTRASA

SEQ ID NO: 23684 - protein, 10 aa, Artificial Sequence
  source: /note="Description of Artificial Sequence: Synthetic peptide"
APRATAAAGA

SEQ ID NO: 23685 - protein, 10 aa, Artificial Sequence
  source: /note="Description of Artificial Sequence: Synthetic peptide"
RPPTARSSAT

SEQ ID NO: 23686 - protein, 10 aa, Artificial Sequence
  source: /note="Description of Artificial Sequence: Synthetic peptide"
GPPSSTSRAV

SEQ ID NO: 23687 - protein, 10 aa, Artificial Sequence
  source: /note="Description of Artificial Sequence: Synthetic peptide"
ARLGGPCPPA

SEQ ID NO: 23688 - protein, 9 aa, Artificial Sequence
  source: /note="Description of Artificial Sequence: Synthetic peptide"
NYRKFRARI

SEQ ID NO: 23689 - protein, 9 aa, Artificial Sequence
  source: /note="Description of Artificial Sequence: Synthetic peptide"
KFRARICPG

SEQ ID NO: 23690 - protein, 9 aa, Artificial Sequence
  source: /note="Description of Artificial Sequence: Synthetic peptide"
RARICPGEN

SEQ ID NO: 23691 - protein, 9 aa, Artificial Sequence
  source: /note="Description of Artificial Sequence: Synthetic peptide"
QNYRKFRAR

SEQ ID NO: 23692 - protein, 10 aa, Artificial Sequence
  source: /note="Description of Artificial Sequence: Synthetic peptide"
KFRARICPGE

SEQ ID NO: 23693 - protein, 10 aa, Artificial Sequence
  source: /note="Description of Artificial Sequence: Synthetic peptide"
RARICPGENQ

SEQ ID NO: 23694 - protein, 10 aa, Artificial Sequence
  source: /note="Description of Artificial Sequence: Synthetic peptide"
EQNYRKFRAR

SEQ ID NO: 23695 - protein, 10 aa, Artificial Sequence
  source: /note="Description of Artificial Sequence: Synthetic peptide"
RKFRARICPG

SEQ ID NO: 23696 - protein, 9 aa, Artificial Sequence
  source: /note="Description of Artificial Sequence: Synthetic peptide"
AGFDLDWTL

SEQ ID NO: 23697 - protein, 10 aa, Artificial Sequence
  source: /note="Description of Artificial Sequence: Synthetic peptide"
WTLITTRSGK

SEQ ID NO: 23698 - protein, 10 aa, Artificial Sequence
  source: /note="Description of Artificial Sequence: Synthetic peptide"
DLDWTLITTR

SEQ ID NO: 23699 - protein, 10 aa, Artificial Sequence
  source: /note="Description of Artificial Sequence: Synthetic peptide"
GKVAGFDLDW

SEQ ID NO: 23700 - protein, 9 aa, Artificial Sequence
  source: /note="Description of Artificial Sequence: Synthetic peptide"
GIMERPLHI

SEQ ID NO: 23701 - protein, 9 aa, Artificial Sequence
  source: /note="Description of Artificial Sequence: Synthetic peptide"
SPWSGIMER

SEQ ID NO: 23702 - protein, 9 aa, Artificial Sequence
  source: /note="Description of Artificial Sequence: Synthetic peptide"
IMERPLHIL

SEQ ID NO: 23703 - protein, 10 aa, Artificial Sequence
  source: /note="Description of Artificial Sequence: Synthetic peptide"
GIMERPLHIL

SEQ ID NO: 23704 - protein, 10 aa, Artificial Sequence
  source: /note="Description of Artificial Sequence: Synthetic peptide"
DSPWSGIMER

SEQ ID NO: 23705 - protein, 10 aa, Artificial Sequence
  source: /note="Description of Artificial Sequence: Synthetic peptide"
MERPLHILPW

SEQ ID NO: 23706 - protein, 9 aa, Artificial Sequence
  source: /note="Description of Artificial Sequence: Synthetic peptide"
NQAPFPPSK

SEQ ID NO: 23707 - protein, 9 aa, Artificial Sequence
  source: /note="Description of Artificial Sequence: Synthetic peptide"
LVRLNQAPF

SEQ ID NO: 23708 - protein, 10 aa, Artificial Sequence
  source: /note="Description of Artificial Sequence: Synthetic peptide"
LNQAPFPPSK

SEQ ID NO: 23709 - protein, 10 aa, Artificial Sequence
  source: /note="Description of Artificial Sequence: Synthetic peptide"
NQAPFPPSKR

SEQ ID NO: 23710 - protein, 10 aa, Artificial Sequence
  source: /note="Description of Artificial Sequence: Synthetic peptide"
APFPPSKRKM

SEQ ID NO: 23711 - protein, 10 aa, Artificial Sequence
  source: /note="Description of Artificial Sequence: Synthetic peptide"
NLVRLNQAPF

SEQ ID NO: 23712 - protein, 10 aa, Artificial Sequence
  source: /note="Description of Artificial Sequence: Synthetic peptide"
RLNQAPFPPS

SEQ ID NO: 23713 - protein, 9 aa, Artificial Sequence
  source: /note="Description of Artificial Sequence: Synthetic peptide"
YLRPPSTAT

SEQ ID NO: 23714 - protein, 9 aa, Artificial Sequence
  source: /note="Description of Artificial Sequence: Synthetic peptide"
CLTSGAAAA

SEQ ID NO: 23715 - protein, 9 aa, Artificial Sequence
  source: /note="Description of Artificial Sequence: Synthetic peptide"
TLPKLCLAL

SEQ ID NO: 23716 - protein, 9 aa, Artificial Sequence
  source: /note="Description of Artificial Sequence: Synthetic peptide"
GMHTQTSRA

SEQ ID NO: 23717 - protein, 9 aa, Artificial Sequence
  source: /note="Description of Artificial Sequence: Synthetic peptide"
WLSQNCLRA

SEQ ID NO: 23718 - protein, 9 aa, Artificial Sequence
  source: /note="Description of Artificial Sequence: Synthetic peptide"
SQNCLRAPL

SEQ ID NO: 23719 - protein, 9 aa, Artificial Sequence
  source: /note="Description of Artificial Sequence: Synthetic peptide"
SASSTRSAK

SEQ ID NO: 23720 - protein, 9 aa, Artificial Sequence
  source: /note="Description of Artificial Sequence: Synthetic peptide"
STRSAKWAT

SEQ ID NO: 23721 - protein, 9 aa, Artificial Sequence
  source: /note="Description of Artificial Sequence: Synthetic peptide"
KWATSTGAR

SEQ ID NO: 23722 - protein, 9 aa, Artificial Sequence
  source: /note="Description of Artificial Sequence: Synthetic peptide"
GARCLTSGA

SEQ ID NO: 23723 - protein, 9 aa, Artificial Sequence
  source: /note="Description of Artificial Sequence: Synthetic peptide"
AACWRRCSA

SEQ ID NO: 23724 - protein, 9 aa, Artificial Sequence
  source: /note="Description of Artificial Sequence: Synthetic peptide"
RGRARSPRV

SEQ ID NO: 23725 - protein, 9 aa, Artificial Sequence
  source: /note="Description of Artificial Sequence: Synthetic peptide"
RARSPRVRS

SEQ ID NO: 23726 - protein, 9 aa, Artificial Sequence
  source: /note="Description of Artificial Sequence: Synthetic peptide"
RVRSSPVPT

SEQ ID NO: 23727 - protein, 9 aa, Artificial Sequence
  source: /note="Description of Artificial Sequence: Synthetic peptide"
RTLPKLCLA

SEQ ID NO: 23728 - protein, 9 aa, Artificial Sequence
  source: /note="Description of Artificial Sequence: Synthetic peptide"
TTRRSTRRS

SEQ ID NO: 23729 - protein, 9 aa, Artificial Sequence
  source: /note="Description of Artificial Sequence: Synthetic peptide"
STRRSCWTS

SEQ ID NO: 23730 - protein, 9 aa, Artificial Sequence
  source: /note="Description of Artificial Sequence: Synthetic peptide"
RSCWTSPGM

SEQ ID NO: 23731 - protein, 9 aa, Artificial Sequence
  source: /note="Description of Artificial Sequence: Synthetic peptide"
TSRAPQPSR

SEQ ID NO: 23732 - protein, 9 aa, Artificial Sequence
  source: /note="Description of Artificial Sequence: Synthetic peptide"
LTRTGRGLC

SEQ ID NO: 23733 - protein, 9 aa, Artificial Sequence
  source: /note="Description of Artificial Sequence: Synthetic peptide"
SATSRGRAR

SEQ ID NO: 23734 - protein, 9 aa, Artificial Sequence
  source: /note="Description of Artificial Sequence: Synthetic peptide"
WWMTNLTTR

SEQ ID NO: 23735 - protein, 9 aa, Artificial Sequence
  source: /note="Description of Artificial Sequence: Synthetic peptide"
WMTNLTTRR

SEQ ID NO: 23736 - protein, 9 aa, Artificial Sequence
  source: /note="Description of Artificial Sequence: Synthetic peptide"
NLTTRRSTR

SEQ ID NO: 23737 - protein, 9 aa, Artificial Sequence
  source: /note="Description of Artificial Sequence: Synthetic peptide"
LTTRRSTRR

SEQ ID NO: 23738 - protein, 9 aa, Artificial Sequence
  source: /note="Description of Artificial Sequence: Synthetic peptide"
VWLSQNCLR

SEQ ID NO: 23739 - protein, 9 aa, Artificial Sequence
  source: /note="Description of Artificial Sequence: Synthetic peptide"
RAPLTRTGR

SEQ ID NO: 23740 - protein, 9 aa, Artificial Sequence
  source: /note="Description of Artificial Sequence: Synthetic peptide"
TATAPWTSA

SEQ ID NO: 23741 - protein, 9 aa, Artificial Sequence
  source: /note="Description of Artificial Sequence: Synthetic peptide"
ATAPWTSAS

SEQ ID NO: 23742 - protein, 9 aa, Artificial Sequence
  source: /note="Description of Artificial Sequence: Synthetic peptide"
APWTSASST

SEQ ID NO: 23743 - protein, 9 aa, Artificial Sequence
  source: /note="Description of Artificial Sequence: Synthetic peptide"
SPRVRSSPV

SEQ ID NO: 23744 - protein, 9 aa, Artificial Sequence
  source: /note="Description of Artificial Sequence: Synthetic peptide"
VPTPPSRTL

SEQ ID NO: 23745 - protein, 9 aa, Artificial Sequence
  source: /note="Description of Artificial Sequence: Synthetic peptide"
SPPWWMTNL

SEQ ID NO: 23746 - protein, 9 aa, Artificial Sequence
  source: /note="Description of Artificial Sequence: Synthetic peptide"
APQPSRAQT

SEQ ID NO: 23747 - protein, 9 aa, Artificial Sequence
  source: /note="Description of Artificial Sequence: Synthetic peptide"
RSAKWATST

SEQ ID NO: 23748 - protein, 9 aa, Artificial Sequence
  source: /note="Description of Artificial Sequence: Synthetic peptide"
AKWATSTGA

SEQ ID NO: 23749 - protein, 9 aa, Artificial Sequence
  source: /note="Description of Artificial Sequence: Synthetic peptide"
ALSPPSPPW

SEQ ID NO: 23750 - protein, 9 aa, Artificial Sequence
  source: /note="Description of Artificial Sequence: Synthetic peptide"
AQTWRTSPH

SEQ ID NO: 23751 - protein, 9 aa, Artificial Sequence
  source: /note="Description of Artificial Sequence: Synthetic peptide"
PPSTATAPW

SEQ ID NO: 23752 - protein, 9 aa, Artificial Sequence
  source: /note="Description of Artificial Sequence: Synthetic peptide"
CEYLRPPST

SEQ ID NO: 23753 - protein, 10 aa, Artificial Sequence
  source: /note="Description of Artificial Sequence: Synthetic peptide"
YLRPPSTATA

SEQ ID NO: 23754 - protein, 10 aa, Artificial Sequence
  source: /note="Description of Artificial Sequence: Synthetic peptide"
TSASSTRSAK

SEQ ID NO: 23755 - protein, 10 aa, Artificial Sequence
  source: /note="Description of Artificial Sequence: Synthetic peptide"
RTLPKLCLAL

SEQ ID NO: 23756 - protein, 10 aa, Artificial Sequence
  source: /note="Description of Artificial Sequence: Synthetic peptide"
STATAPWTSA

SEQ ID NO: 23757 - protein, 10 aa, Artificial Sequence
  source: /note="Description of Artificial Sequence: Synthetic peptide"
STRSAKWATS

SEQ ID NO: 23758 - protein, 10 aa, Artificial Sequence
  source: /note="Description of Artificial Sequence: Synthetic peptide"
SAKWATSTGA

SEQ ID NO: 23759 - protein, 10 aa, Artificial Sequence
  source: /note="Description of Artificial Sequence: Synthetic peptide"
GARCLTSGAA

SEQ ID NO: 23760 - protein, 10 aa, Artificial Sequence
  source: /note="Description of Artificial Sequence: Synthetic peptide"
AAACWRRCSA

SEQ ID NO: 23761 - protein, 10 aa, Artificial Sequence
  source: /note="Description of Artificial Sequence: Synthetic peptide"
CWRRCSATSR

SEQ ID NO: 23762 - protein, 10 aa, Artificial Sequence
  source: /note="Description of Artificial Sequence: Synthetic peptide"
TSRGRARSPR

SEQ ID NO: 23763 - protein, 10 aa, Artificial Sequence
  source: /note="Description of Artificial Sequence: Synthetic peptide"
RGRARSPRVR

SEQ ID NO: 23764 - protein, 10 aa, Artificial Sequence
  source: /note="Description of Artificial Sequence: Synthetic peptide"
RARSPRVRSS

SEQ ID NO: 23765 - protein, 10 aa, Artificial Sequence
  source: /note="Description of Artificial Sequence: Synthetic peptide"
RSPRVRSSPV

SEQ ID NO: 23766 - protein, 10 aa, Artificial Sequence
  source: /note="Description of Artificial Sequence: Synthetic peptide"
RVRSSPVPTP

SEQ ID NO: 23767 - protein, 10 aa, Artificial Sequence
  source: /note="Description of Artificial Sequence: Synthetic peptide"
RSSPVPTPPS

SEQ ID NO: 23768 - protein, 10 aa, Artificial Sequence
  source: /note="Description of Artificial Sequence: Synthetic peptide"
TTRRSTRRSC

SEQ ID NO: 23769 - protein, 10 aa, Artificial Sequence
  source: /note="Description of Artificial Sequence: Synthetic peptide"
STRRSCWTSP

SEQ ID NO: 23770 - protein, 10 aa, Artificial Sequence
  source: /note="Description of Artificial Sequence: Synthetic peptide"
TSRAPQPSRA

SEQ ID NO: 23771 - protein, 10 aa, Artificial Sequence
  source: /note="Description of Artificial Sequence: Synthetic peptide"
RAQTWRTSPH

SEQ ID NO: 23772 - protein, 10 aa, Artificial Sequence
  source: /note="Description of Artificial Sequence: Synthetic peptide"
TWRTSPHCGI

SEQ ID NO: 23773 - protein, 10 aa, Artificial Sequence
  source: /note="Description of Artificial Sequence: Synthetic peptide"
CSATSRGRAR

SEQ ID NO: 23774 - protein, 10 aa, Artificial Sequence
  source: /note="Description of Artificial Sequence: Synthetic peptide"
WWMTNLTTRR

SEQ ID NO: 23775 - protein, 10 aa, Artificial Sequence
  source: /note="Description of Artificial Sequence: Synthetic peptide"
TNLTTRRSTR

SEQ ID NO: 23776 - protein, 10 aa, Artificial Sequence
  source: /note="Description of Artificial Sequence: Synthetic peptide"
NLTTRRSTRR

SEQ ID NO: 23777 - protein, 10 aa, Artificial Sequence
  source: /note="Description of Artificial Sequence: Synthetic peptide"
QTSRAPQPSR

SEQ ID NO: 23778 - protein, 10 aa, Artificial Sequence
  source: /note="Description of Artificial Sequence: Synthetic peptide"
PVWLSQNCLR

SEQ ID NO: 23779 - protein, 10 aa, Artificial Sequence
  source: /note="Description of Artificial Sequence: Synthetic peptide"
WTSASSTRSA

SEQ ID NO: 23780 - protein, 10 aa, Artificial Sequence
  source: /note="Description of Artificial Sequence: Synthetic peptide"
RPPSTATAPW

SEQ ID NO: 23781 - protein, 10 aa, Artificial Sequence
  source: /note="Description of Artificial Sequence: Synthetic peptide"
TPPSRTLPKL

SEQ ID NO: 23782 - protein, 10 aa, Artificial Sequence
  source: /note="Description of Artificial Sequence: Synthetic peptide"
APQPSRAQTW

SEQ ID NO: 23783 - protein, 10 aa, Artificial Sequence
  source: /note="Description of Artificial Sequence: Synthetic peptide"
SPHCGIDTPV

SEQ ID NO: 23784 - protein, 10 aa, Artificial Sequence
  source: /note="Description of Artificial Sequence: Synthetic peptide"
TPVWLSQNCL

SEQ ID NO: 23785 - protein, 10 aa, Artificial Sequence
  source: /note="Description of Artificial Sequence: Synthetic peptide"
APLTRTGRGL

SEQ ID NO: 23786 - protein, 10 aa, Artificial Sequence
  source: /note="Description of Artificial Sequence: Synthetic peptide"
CEYLRPPSTA

SEQ ID NO: 23787 - protein, 10 aa, Artificial Sequence
  source: /note="Description of Artificial Sequence: Synthetic peptide"
SASSTRSAKW

SEQ ID NO: 23788 - protein, 10 aa, Artificial Sequence
  source: /note="Description of Artificial Sequence: Synthetic peptide"
WATSTGARCL

SEQ ID NO: 23789 - protein, 10 aa, Artificial Sequence
  source: /note="Description of Artificial Sequence: Synthetic peptide"
LALSPPSPPW

SEQ ID NO: 23790 - protein, 10 aa, Artificial Sequence
  source: /note="Description of Artificial Sequence: Synthetic peptide"
ALSPPSPPWW

SEQ ID NO: 23791 - protein, 10 aa, Artificial Sequence
  source: /note="Description of Artificial Sequence: Synthetic peptide"
RRSCWTSPGM

SEQ ID NO: 23792 - protein, 10 aa, Artificial Sequence
  source: /note="Description of Artificial Sequence: Synthetic peptide"
AQTWRTSPHC

SEQ ID NO: 23793 - protein, 10 aa, Artificial Sequence
  source: /note="Description of Artificial Sequence: Synthetic peptide"
LSQNCLRAPL

SEQ ID NO: 23794 - protein, 10 aa, Artificial Sequence
  source: /note="Description of Artificial Sequence: Synthetic peptide"
SQNCLRAPLT

SEQ ID NO: 23795 - protein, 10 aa, Artificial Sequence
  source: /note="Description of Artificial Sequence: Synthetic peptide"
LTSGAAAACW

SEQ ID NO: 23796 - protein, 9 aa, Artificial Sequence
  source: /note="Description of Artificial Sequence: Synthetic peptide"
LTPQPCAPA

SEQ ID NO: 23797 - protein, 9 aa, Artificial Sequence
  source: /note="Description of Artificial Sequence: Synthetic peptide"
TPQPCAPAA

SEQ ID NO: 23798 - protein, 10 aa, Artificial Sequence
  source: /note="Description of Artificial Sequence: Synthetic peptide"
CLTPQPCAPA

SEQ ID NO: 23799 - protein, 10 aa, Artificial Sequence
  source: /note="Description of Artificial Sequence: Synthetic peptide"
TPQPCAPAAL

SEQ ID NO: 23800 - protein, 10 aa, Artificial Sequence
  source: /note="Description of Artificial Sequence: Synthetic peptide"
LEKIPRGPSA

SEQ ID NO: 23801 - protein, 9 aa, Artificial Sequence
  source: /note="Description of Artificial Sequence: Synthetic peptide"
FLPRSLRVV

SEQ ID NO: 23802 - protein, 9 aa, Artificial Sequence
  source: /note="Description of Artificial Sequence: Synthetic peptide"
RSLRVVDLA

SEQ ID NO: 23803 - protein, 9 aa, Artificial Sequence
  source: /note="Description of Artificial Sequence: Synthetic peptide"
VDLAANQVM

SEQ ID NO: 23804 - protein, 10 aa, Artificial Sequence
  source: /note="Description of Artificial Sequence: Synthetic peptide"
RVVDLAANQV

SEQ ID NO: 23805 - protein, 10 aa, Artificial Sequence
  source: /note="Description of Artificial Sequence: Synthetic peptide"
RSLRVVDLAA

SEQ ID NO: 23806 - protein, 10 aa, Artificial Sequence
  source: /note="Description of Artificial Sequence: Synthetic peptide"
LPRSLRVVDL

SEQ ID NO: 23807 - protein, 10 aa, Artificial Sequence
  source: /note="Description of Artificial Sequence: Synthetic peptide"
QPQCDHRPHI

SEQ ID NO: 23808 - protein, 10 aa, Artificial Sequence
  source: /note="Description of Artificial Sequence: Synthetic peptide"
SQPQCDHRPH

SEQ ID NO: 23809 - protein, 9 aa, Artificial Sequence
  source: /note="Description of Artificial Sequence: Synthetic peptide"
TSTTVSSSW

SEQ ID NO: 23810 - protein, 10 aa, Artificial Sequence
  source: /note="Description of Artificial Sequence: Synthetic peptide"
STSTTVSSSW

SEQ ID NO: 23811 - protein, 9 aa, Artificial Sequence
  source: /note="Description of Artificial Sequence: Synthetic peptide"
YAFKEVIDK

SEQ ID NO: 23812 - protein, 9 aa, Artificial Sequence
  source: /note="Description of Artificial Sequence: Synthetic peptide"
AFKEVIDKK

SEQ ID NO: 23813 - protein, 10 aa, Artificial Sequence
  source: /note="Description of Artificial Sequence: Synthetic peptide"
YAFKEVIDKK

SEQ ID NO: 23814 - protein, 10 aa, Artificial Sequence
  source: /note="Description of Artificial Sequence: Synthetic peptide"
EVIDKKNVKV

SEQ ID NO: 23815 - protein, 9 aa, Artificial Sequence
  source: /note="Description of Artificial Sequence: Synthetic peptide"
HMDCLRWLK

SEQ ID NO: 23816 - protein, 9 aa, Artificial Sequence
  source: /note="Description of Artificial Sequence: Synthetic peptide"
RWLKRDSYL

SEQ ID NO: 23817 - protein, 9 aa, Artificial Sequence
  source: /note="Description of Artificial Sequence: Synthetic peptide"
IHMDCLRWL

SEQ ID NO: 23818 - protein, 9 aa, Artificial Sequence
  source: /note="Description of Artificial Sequence: Synthetic peptide"
LRWLKRDSY

SEQ ID NO: 23819 - protein, 9 aa, Artificial Sequence
  source: /note="Description of Artificial Sequence: Synthetic peptide"
LKRDSYLPV

SEQ ID NO: 23820 - protein, 10 aa, Artificial Sequence
  source: /note="Description of Artificial Sequence: Synthetic peptide"
WLKRDSYLPV

SEQ ID NO: 23821 - protein, 10 aa, Artificial Sequence
  source: /note="Description of Artificial Sequence: Synthetic peptide"
IHMDCLRWLK

SEQ ID NO: 23822 - protein, 10 aa, Artificial Sequence
  source: /note="Description of Artificial Sequence: Synthetic peptide"
CLRWLKRDSY

SEQ ID NO: 23823 - protein, 10 aa, Artificial Sequence
  source: /note="Description of Artificial Sequence: Synthetic peptide"
HMDCLRWLKR

SEQ ID NO: 23824 - protein, 10 aa, Artificial Sequence
  source: /note="Description of Artificial Sequence: Synthetic peptide"
LRWLKRDSYL

SEQ ID NO: 23825 - protein, 9 aa, Artificial Sequence
  source: /note="Description of Artificial Sequence: Synthetic peptide"
FVSDAVATY

SEQ ID NO: 23826 - protein, 9 aa, Artificial Sequence
  source: /note="Description of Artificial Sequence: Synthetic peptide"
ATYFVSDAV

SEQ ID NO: 23827 - protein, 9 aa, Artificial Sequence
  source: /note="Description of Artificial Sequence: Synthetic peptide"
QPQTLATYF

SEQ ID NO: 23828 - protein, 10 aa, Artificial Sequence
  source: /note="Description of Artificial Sequence: Synthetic peptide"
FVSDAVATYY

SEQ ID NO: 23829 - protein, 10 aa, Artificial Sequence
  source: /note="Description of Artificial Sequence: Synthetic peptide"
TLATYFVSDA

SEQ ID NO: 23830 - protein, 10 aa, Artificial Sequence
  source: /note="Description of Artificial Sequence: Synthetic peptide"
ATYFVSDAVA

SEQ ID NO: 23831 - protein, 10 aa, Artificial Sequence
  source: /note="Description of Artificial Sequence: Synthetic peptide"
YFVSDAVATY

SEQ ID NO: 23832 - protein, 10 aa, Artificial Sequence
  source: /note="Description of Artificial Sequence: Synthetic peptide"
LATYFVSDAV

SEQ ID NO: 23833 - protein, 10 aa, Artificial Sequence
  source: /note="Description of Artificial Sequence: Synthetic peptide"
EQPQTLATYF

SEQ ID NO: 23834 - protein, 10 aa, Artificial Sequence
  source: /note="Description of Artificial Sequence: Synthetic peptide"
QPQTLATYFV

SEQ ID NO: 23835 - protein, 9 aa, Artificial Sequence
  source: /note="Description of Artificial Sequence: Synthetic peptide"
FLLQLVEKT

SEQ ID NO: 23836 - protein, 9 aa, Artificial Sequence
  source: /note="Description of Artificial Sequence: Synthetic peptide"
DFLLQLVEK

SEQ ID NO: 23837 - protein, 9 aa, Artificial Sequence
  source: /note="Description of Artificial Sequence: Synthetic peptide"
AAFDFLLQL

SEQ ID NO: 23838 - protein, 10 aa, Artificial Sequence
  source: /note="Description of Artificial Sequence: Synthetic peptide"
AAFDFLLQLV

SEQ ID NO: 23839 - protein, 10 aa, Artificial Sequence
  source: /note="Description of Artificial Sequence: Synthetic peptide"
FLLQLVEKTL

SEQ ID NO: 23840 - protein, 10 aa, Artificial Sequence
  source: /note="Description of Artificial Sequence: Synthetic peptide"
QLVEKTLRHA

SEQ ID NO: 23841 - protein, 10 aa, Artificial Sequence
  source: /note="Description of Artificial Sequence: Synthetic peptide"
LQLVEKTLRH

SEQ ID NO: 23842 - protein, 9 aa, Artificial Sequence
  source: /note="Description of Artificial Sequence: Synthetic peptide"
TTKLPLKFR

SEQ ID NO: 23843 - protein, 9 aa, Artificial Sequence
  source: /note="Description of Artificial Sequence: Synthetic peptide"
RDAETDQIM

SEQ ID NO: 23844 - protein, 10 aa, Artificial Sequence
  source: /note="Description of Artificial Sequence: Synthetic peptide"
KFRDAETDQI

SEQ ID NO: 23845 - protein, 10 aa, Artificial Sequence
  source: /note="Description of Artificial Sequence: Synthetic peptide"
ETTKLPLKFR

SEQ ID NO: 23846 - protein, 10 aa, Artificial Sequence
  source: /note="Description of Artificial Sequence: Synthetic peptide"
RDAETDQIMM

SEQ ID NO: 23847 - protein, 9 aa, Artificial Sequence
  source: /note="Description of Artificial Sequence: Synthetic peptide"
APPGCTPQL

SEQ ID NO: 23848 - protein, 9 aa, Artificial Sequence
  source: /note="Description of Artificial Sequence: Synthetic peptide"
QTIWVTGRK

SEQ ID NO: 23849 - protein, 9 aa, Artificial Sequence
  source: /note="Description of Artificial Sequence: Synthetic peptide"
MQTIWVTGR

SEQ ID NO: 23850 - protein, 9 aa, Artificial Sequence
  source: /note="Description of Artificial Sequence: Synthetic peptide"
RNMQTIWVT

SEQ ID NO: 23851 - protein, 10 aa, Artificial Sequence
  source: /note="Description of Artificial Sequence: Synthetic peptide"
MQTIWVTGRK

SEQ ID NO: 23852 - protein, 10 aa, Artificial Sequence
  source: /note="Description of Artificial Sequence: Synthetic peptide"
NMQTIWVTGR

SEQ ID NO: 23853 - protein, 10 aa, Artificial Sequence
  source: /note="Description of Artificial Sequence: Synthetic peptide"
RNMQTIWVTG

SEQ ID NO: 23854 - protein, 10 aa, Artificial Sequence
  source: /note="Description of Artificial Sequence: Synthetic peptide"
EERRNMQTIW

SEQ ID NO: 23855 - protein, 9 aa, Artificial Sequence
  source: /note="Description of Artificial Sequence: Synthetic peptide"
KVLMGQCRR

SEQ ID NO: 23856 - protein, 9 aa, Artificial Sequence
  source: /note="Description of Artificial Sequence: Synthetic peptide"
VLMGQCRRF

SEQ ID NO: 23857 - protein, 9 aa, Artificial Sequence
  source: /note="Description of Artificial Sequence: Synthetic peptide"
LMGQCRRFL

SEQ ID NO: 23858 - protein, 10 aa, Artificial Sequence
  source: /note="Description of Artificial Sequence: Synthetic peptide"
VLMGQCRRFL

SEQ ID NO: 23859 - protein, 10 aa, Artificial Sequence
  source: /note="Description of Artificial Sequence: Synthetic peptide"
AIKVLMGQCR

SEQ ID NO: 23860 - protein, 10 aa, Artificial Sequence
  source: /note="Description of Artificial Sequence: Synthetic peptide"
KVLMGQCRRF

SEQ ID NO: 23861 - protein, 10 aa, Artificial Sequence
  source: /note="Description of Artificial Sequence: Synthetic peptide"
GQCRRFLDEL

SEQ ID NO: 23862 - protein, 9 aa, Artificial Sequence
  source: /note="Description of Artificial Sequence: Synthetic peptide"
LLSLFFEDL

SEQ ID NO: 23863 - protein, 9 aa, Artificial Sequence
  source: /note="Description of Artificial Sequence: Synthetic peptide"
SLFFEDLFK

SEQ ID NO: 23864 - protein, 9 aa, Artificial Sequence
  source: /note="Description of Artificial Sequence: Synthetic peptide"
LFFEDLFKK

SEQ ID NO: 23865 - protein, 9 aa, Artificial Sequence
  source: /note="Description of Artificial Sequence: Synthetic peptide"
LSLFFEDLF

SEQ ID NO: 23866 - protein, 9 aa, Artificial Sequence
  source: /note="Description of Artificial Sequence: Synthetic peptide"
FFEDLFKKF

SEQ ID NO: 23867 - protein, 9 aa, Artificial Sequence
  source: /note="Description of Artificial Sequence: Synthetic peptide"
LAGQLLSLF

SEQ ID NO: 23868 - protein, 9 aa, Artificial Sequence
  source: /note="Description of Artificial Sequence: Synthetic peptide"
AGQLLSLFF

SEQ ID NO: 23869 - protein, 10 aa, Artificial Sequence
  source: /note="Description of Artificial Sequence: Synthetic peptide"
QLLSLFFEDL

SEQ ID NO: 23870 - protein, 10 aa, Artificial Sequence
  source: /note="Description of Artificial Sequence: Synthetic peptide"
LSLFFEDLFK

SEQ ID NO: 23871 - protein, 10 aa, Artificial Sequence
  source: /note="Description of Artificial Sequence: Synthetic peptide"
SLFFEDLFKK

SEQ ID NO: 23872 - protein, 10 aa, Artificial Sequence
  source: /note="Description of Artificial Sequence: Synthetic peptide"
LFFEDLFKKF

SEQ ID NO: 23873 - protein, 10 aa, Artificial Sequence
  source: /note="Description of Artificial Sequence: Synthetic peptide"
ELAGQLLSLF

SEQ ID NO: 23874 - protein, 10 aa, Artificial Sequence
  source: /note="Description of Artificial Sequence: Synthetic peptide"
LAGQLLSLFF

SEQ ID NO: 23875 - protein, 10 aa, Artificial Sequence
  source: /note="Description of Artificial Sequence: Synthetic peptide"
LLSLFFEDLF

SEQ ID NO: 23876 - protein, 9 aa, Artificial Sequence
  source: /note="Description of Artificial Sequence: Synthetic peptide"
FVTRPGPLK

SEQ ID NO: 23877 - protein, 9 aa, Artificial Sequence
  source: /note="Description of Artificial Sequence: Synthetic peptide"
GAVASFVTR

SEQ ID NO: 23878 - protein, 9 aa, Artificial Sequence
  source: /note="Description of Artificial Sequence: Synthetic peptide"
SFVTRPGPL

SEQ ID NO: 23879 - protein, 10 aa, Artificial Sequence
  source: /note="Description of Artificial Sequence: Synthetic peptide"
SFVTRPGPLK

SEQ ID NO: 23880 - protein, 10 aa, Artificial Sequence
  source: /note="Description of Artificial Sequence: Synthetic peptide"
ASFVTRPGPL

SEQ ID NO: 23881 - protein, 10 aa, Artificial Sequence
  source: /note="Description of Artificial Sequence: Synthetic peptide"
NGAVASFVTR

SEQ ID NO: 23882 - protein, 9 aa, Artificial Sequence
  source: /note="Description of Artificial Sequence: Synthetic peptide"
SLGHWSLSF

SEQ ID NO: 23883 - protein, 9 aa, Artificial Sequence
  source: /note="Description of Artificial Sequence: Synthetic peptide"
KPSLGHWSL

SEQ ID NO: 23884 - protein, 10 aa, Artificial Sequence
  source: /note="Description of Artificial Sequence: Synthetic peptide"
PSLGHWSLSF

SEQ ID NO: 23885 - protein, 10 aa, Artificial Sequence
  source: /note="Description of Artificial Sequence: Synthetic peptide"
LKPSLGHWSL

SEQ ID NO: 23886 - protein, 10 aa, Artificial Sequence
  source: /note="Description of Artificial Sequence: Synthetic peptide"
GPLKPSLGHW

SEQ ID NO: 23887 - protein, 9 aa, Artificial Sequence
  source: /note="Description of Artificial Sequence: Synthetic peptide"
SEVLQIQNI

SEQ ID NO: 23888 - protein, 9 aa, Artificial Sequence
  source: /note="Description of Artificial Sequence: Synthetic peptide"
LQIQNILTE

SEQ ID NO: 23889 - protein, 9 aa, Artificial Sequence
  source: /note="Description of Artificial Sequence: Synthetic peptide"
PPASEVLQI

SEQ ID NO: 23890 - protein, 10 aa, Artificial Sequence
  source: /note="Description of Artificial Sequence: Synthetic peptide"
SEVLQIQNIL

SEQ ID NO: 23891 - protein, 10 aa, Artificial Sequence
  source: /note="Description of Artificial Sequence: Synthetic peptide"
NPPASEVLQI

SEQ ID NO: 23892 - protein, 9 aa, Artificial Sequence
  source: /note="Description of Artificial Sequence: Synthetic peptide"
LISHLMKWA

SEQ ID NO: 23893 - protein, 9 aa, Artificial Sequence
  source: /note="Description of Artificial Sequence: Synthetic peptide"
KLISHLMKW

SEQ ID NO: 23894 - protein, 9 aa, Artificial Sequence
  source: /note="Description of Artificial Sequence: Synthetic peptide"
KKLISHLMK

SEQ ID NO: 23895 - protein, 9 aa, Artificial Sequence
  source: /note="Description of Artificial Sequence: Synthetic peptide"
APMPKKLIS

SEQ ID NO: 23896 - protein, 9 aa, Artificial Sequence
  source: /note="Description of Artificial Sequence: Synthetic peptide"
MPKKLISHL

SEQ ID NO: 23897 - protein, 9 aa, Artificial Sequence
  source: /note="Description of Artificial Sequence: Synthetic peptide"
ISHLMKWAH

SEQ ID NO: 23898 - protein, 10 aa, Artificial Sequence
  source: /note="Description of Artificial Sequence: Synthetic peptide"
KLISHLMKWA

SEQ ID NO: 23899 - protein, 10 aa, Artificial Sequence
  source: /note="Description of Artificial Sequence: Synthetic peptide"
APMPKKLISH

SEQ ID NO: 23900 - protein, 10 aa, Artificial Sequence
  source: /note="Description of Artificial Sequence: Synthetic peptide"
MPKKLISHLM

SEQ ID NO: 23901 - protein, 10 aa, Artificial Sequence
  source: /note="Description of Artificial Sequence: Synthetic peptide"
KKLISHLMKW

SEQ ID NO: 23902 - protein, 9 aa, Artificial Sequence
  source: /note="Description of Artificial Sequence: Synthetic peptide"
KQDKCFSTF

SEQ ID NO: 23903 - protein, 9 aa, Artificial Sequence
  source: /note="Description of Artificial Sequence: Synthetic peptide"
CFSTFLSLL

SEQ ID NO: 23904 - protein, 9 aa, Artificial Sequence
  source: /note="Description of Artificial Sequence: Synthetic peptide"
KCFSTFLSL

SEQ ID NO: 23905 - protein, 10 aa, Artificial Sequence
  source: /note="Description of Artificial Sequence: Synthetic peptide"
KQDKCFSTFL

SEQ ID NO: 23906 - protein, 10 aa, Artificial Sequence
  source: /note="Description of Artificial Sequence: Synthetic peptide"
LKQDKCFSTF

SEQ ID NO: 23907 - protein, 10 aa, Artificial Sequence
  source: /note="Description of Artificial Sequence: Synthetic peptide"
KCFSTFLSLL

SEQ ID NO: 23908 - protein, 9 aa, Artificial Sequence
  source: /note="Description of Artificial Sequence: Synthetic peptide"
AEKEMNSEL

SEQ ID NO: 23909 - protein, 9 aa, Artificial Sequence
  source: /note="Description of Artificial Sequence: Synthetic peptide"
KEMNSELSL

SEQ ID NO: 23910 - protein, 10 aa, Artificial Sequence
  source: /note="Description of Artificial Sequence: Synthetic peptide"
KEMNSELSLS

SEQ ID NO: 23911 - protein, 10 aa, Artificial Sequence
  source: /note="Description of Artificial Sequence: Synthetic peptide"
AEKEMNSELS

SEQ ID NO: 23912 - protein, 10 aa, Artificial Sequence
  source: /note="Description of Artificial Sequence: Synthetic peptide"
MLRDTDMNKK

SEQ ID NO: 23913 - protein, 9 aa, Artificial Sequence
  source: /note="Description of Artificial Sequence: Synthetic peptide"
QVMKFLIKK

SEQ ID NO: 23914 - protein, 9 aa, Artificial Sequence
  source: /note="Description of Artificial Sequence: Synthetic peptide"
VMKFLIKKK

SEQ ID NO: 23915 - protein, 9 aa, Artificial Sequence
  source: /note="Description of Artificial Sequence: Synthetic peptide"
KQQVMKFLI

SEQ ID NO: 23916 - protein, 9 aa, Artificial Sequence
  source: /note="Description of Artificial Sequence: Synthetic peptide"
QQVMKFLIK

SEQ ID NO: 23917 - protein, 9 aa, Artificial Sequence
  source: /note="Description of Artificial Sequence: Synthetic peptide"
VHEQKQQVM

SEQ ID NO: 23918 - protein, 9 aa, Artificial Sequence
  source: /note="Description of Artificial Sequence: Synthetic peptide"
EQKQQVMKF

SEQ ID NO: 23919 - protein, 10 aa, Artificial Sequence
  source: /note="Description of Artificial Sequence: Synthetic peptide"
QVMKFLIKKK

SEQ ID NO: 23920 - protein, 10 aa, Artificial Sequence
  source: /note="Description of Artificial Sequence: Synthetic peptide"
KQQVMKFLIK

SEQ ID NO: 23921 - protein, 10 aa, Artificial Sequence
  source: /note="Description of Artificial Sequence: Synthetic peptide"
QQVMKFLIKK

SEQ ID NO: 23922 - protein, 10 aa, Artificial Sequence
  source: /note="Description of Artificial Sequence: Synthetic peptide"
GVHEQKQQVM

SEQ ID NO: 23923 - protein, 10 aa, Artificial Sequence
  source: /note="Description of Artificial Sequence: Synthetic peptide"
HEQKQQVMKF

SEQ ID NO: 23924 - protein, 9 aa, Artificial Sequence
  source: /note="Description of Artificial Sequence: Synthetic peptide"
IYGRTALIL

SEQ ID NO: 23925 - protein, 9 aa, Artificial Sequence
  source: /note="Description of Artificial Sequence: Synthetic peptide"
DIYGRTALI

SEQ ID NO: 23926 - protein, 9 aa, Artificial Sequence
  source: /note="Description of Artificial Sequence: Synthetic peptide"
KANLNALDI

SEQ ID NO: 23927 - protein, 9 aa, Artificial Sequence
  source: /note="Description of Artificial Sequence: Synthetic peptide"
ANLNALDIY

SEQ ID NO: 23928 - protein, 9 aa, Artificial Sequence
  source: /note="Description of Artificial Sequence: Synthetic peptide"
LDIYGRTAL

SEQ ID NO: 23929 - protein, 10 aa, Artificial Sequence
  source: /note="Description of Artificial Sequence: Synthetic peptide"
ALDIYGRTAL

SEQ ID NO: 23930 - protein, 10 aa, Artificial Sequence
  source: /note="Description of Artificial Sequence: Synthetic peptide"
IYGRTALILA

SEQ ID NO: 23931 - protein, 10 aa, Artificial Sequence
  source: /note="Description of Artificial Sequence: Synthetic peptide"
KANLNALDIY

SEQ ID NO: 23932 - protein, 10 aa, Artificial Sequence
  source: /note="Description of Artificial Sequence: Synthetic peptide"
NLNALDIYGR

SEQ ID NO: 23933 - protein, 10 aa, Artificial Sequence
  source: /note="Description of Artificial Sequence: Synthetic peptide"
KKANLNALDI

SEQ ID NO: 23934 - protein, 9 aa, Artificial Sequence
  source: /note="Description of Artificial Sequence: Synthetic peptide"
SQLRENKYL

SEQ ID NO: 23935 - protein, 9 aa, Artificial Sequence
  source: /note="Description of Artificial Sequence: Synthetic peptide"
RENKYLEDI

SEQ ID NO: 23936 - protein, 10 aa, Artificial Sequence
  source: /note="Description of Artificial Sequence: Synthetic peptide"
KHQSQLRENK

SEQ ID NO: 23937 - protein, 10 aa, Artificial Sequence
  source: /note="Description of Artificial Sequence: Synthetic peptide"
HQSQLRENKY

SEQ ID NO: 23938 - protein, 10 aa, Artificial Sequence
  source: /note="Description of Artificial Sequence: Synthetic peptide"
NKYLEDIESV

SEQ ID NO: 23939 - protein, 9 aa, Artificial Sequence
  source: /note="Description of Artificial Sequence: Synthetic peptide"
CCRGGSKSK

SEQ ID NO: 23940 - protein, 9 aa, Artificial Sequence
  source: /note="Description of Artificial Sequence: Synthetic peptide"
DNSAMKTLR

SEQ ID NO: 23941 - protein, 10 aa, Artificial Sequence
  source: /note="Description of Artificial Sequence: Synthetic peptide"
NSAMKTLRSK

SEQ ID NO: 23942 - protein, 9 aa, Artificial Sequence
  source: /note="Description of Artificial Sequence: Synthetic peptide"
HVHREDLDK

SEQ ID NO: 23943 - protein, 9 aa, Artificial Sequence
  source: /note="Description of Artificial Sequence: Synthetic peptide"
FMEPRYHVH

SEQ ID NO: 23944 - protein, 10 aa, Artificial Sequence
  source: /note="Description of Artificial Sequence: Synthetic peptide"
FMEPRYHVHR

SEQ ID NO: 23945 - protein, 9 aa, Artificial Sequence
  source: /note="Description of Artificial Sequence: Synthetic peptide"
ATISRFEAL

SEQ ID NO: 23946 - protein, 9 aa, Artificial Sequence
  source: /note="Description of Artificial Sequence: Synthetic peptide"
DFSQATISR

SEQ ID NO: 23947 - protein, 9 aa, Artificial Sequence
  source: /note="Description of Artificial Sequence: Synthetic peptide"
FSQATISRF

SEQ ID NO: 23948 - protein, 10 aa, Artificial Sequence
  source: /note="Description of Artificial Sequence: Synthetic peptide"
KLYGNDFSQA

SEQ ID NO: 23949 - protein, 10 aa, Artificial Sequence
  source: /note="Description of Artificial Sequence: Synthetic peptide"
SQATISRFEA

SEQ ID NO: 23950 - protein, 10 aa, Artificial Sequence
  source: /note="Description of Artificial Sequence: Synthetic peptide"
DFSQATISRF

SEQ ID NO: 23951 - protein, 10 aa, Artificial Sequence
  source: /note="Description of Artificial Sequence: Synthetic peptide"
YGNDFSQATI

SEQ ID NO: 23952 - protein, 9 aa, Artificial Sequence
  source: /note="Description of Artificial Sequence: Synthetic peptide"
STISRFEAL

SEQ ID NO: 23953 - protein, 9 aa, Artificial Sequence
  source: /note="Description of Artificial Sequence: Synthetic peptide"
FSQSTISRF

SEQ ID NO: 23954 - protein, 9 aa, Artificial Sequence
  source: /note="Description of Artificial Sequence: Synthetic peptide"
DFSQSTISR

SEQ ID NO: 23955 - protein, 10 aa, Artificial Sequence
  source: /note="Description of Artificial Sequence: Synthetic peptide"
DFSQSTISRF

SEQ ID NO: 23956 - protein, 10 aa, Artificial Sequence
  source: /note="Description of Artificial Sequence: Synthetic peptide"
YGNDFSQSTI

SEQ ID NO: 23957 - protein, 10 aa, Artificial Sequence
  source: /note="Description of Artificial Sequence: Synthetic peptide"
SQSTISRFEA

SEQ ID NO: 23958 - protein, 9 aa, Artificial Sequence
  source: /note="Description of Artificial Sequence: Synthetic peptide"
YLEQFAKQF

SEQ ID NO: 23959 - protein, 9 aa, Artificial Sequence
  source: /note="Description of Artificial Sequence: Synthetic peptide"
DEDTPTSDY

SEQ ID NO: 23960 - protein, 10 aa, Artificial Sequence
  source: /note="Description of Artificial Sequence: Synthetic peptide"
TSDYLEQFAK

SEQ ID NO: 23961 - protein, 10 aa, Artificial Sequence
  source: /note="Description of Artificial Sequence: Synthetic peptide"
DYLEQFAKQF

SEQ ID NO: 23962 - protein, 10 aa, Artificial Sequence
  source: /note="Description of Artificial Sequence: Synthetic peptide"
TPTSDYLEQF

SEQ ID NO: 23963 - protein, 9 aa, Artificial Sequence
  source: /note="Description of Artificial Sequence: Synthetic peptide"
KVNGLVLRR

SEQ ID NO: 23964 - protein, 9 aa, Artificial Sequence
  source: /note="Description of Artificial Sequence: Synthetic peptide"
LVLRRTAPK

SEQ ID NO: 23965 - protein, 9 aa, Artificial Sequence
  source: /note="Description of Artificial Sequence: Synthetic peptide"
SSAPPALPR

SEQ ID NO: 23966 - protein, 9 aa, Artificial Sequence
  source: /note="Description of Artificial Sequence: Synthetic peptide"
RSPRPQPLR

SEQ ID NO: 23967 - protein, 9 aa, Artificial Sequence
  source: /note="Description of Artificial Sequence: Synthetic peptide"
SSHCCRSSS

SEQ ID NO: 23968 - protein, 9 aa, Artificial Sequence
  source: /note="Description of Artificial Sequence: Synthetic peptide"
HQALTPRRK

SEQ ID NO: 23969 - protein, 9 aa, Artificial Sequence
  source: /note="Description of Artificial Sequence: Synthetic peptide"
GARQASDLK

SEQ ID NO: 23970 - protein, 9 aa, Artificial Sequence
  source: /note="Description of Artificial Sequence: Synthetic peptide"
RTAPKTRRL

SEQ ID NO: 23971 - protein, 9 aa, Artificial Sequence
  source: /note="Description of Artificial Sequence: Synthetic peptide"
PALPRRSPR

SEQ ID NO: 23972 - protein, 9 aa, Artificial Sequence
  source: /note="Description of Artificial Sequence: Synthetic peptide"
TQHQALTPR

SEQ ID NO: 23973 - protein, 9 aa, Artificial Sequence
  source: /note="Description of Artificial Sequence: Synthetic peptide"
APSSAPPAL

SEQ ID NO: 23974 - protein, 9 aa, Artificial Sequence
  source: /note="Description of Artificial Sequence: Synthetic peptide"
RPQPLRWTS

SEQ ID NO: 23975 - protein, 9 aa, Artificial Sequence
  source: /note="Description of Artificial Sequence: Synthetic peptide"
WPHPTQHQA

SEQ ID NO: 23976 - protein, 9 aa, Artificial Sequence
  source: /note="Description of Artificial Sequence: Synthetic peptide"
RRSPRPQPL

SEQ ID NO: 23977 - protein, 9 aa, Artificial Sequence
  source: /note="Description of Artificial Sequence: Synthetic peptide"
SHCCRSSSW

SEQ ID NO: 23978 - protein, 9 aa, Artificial Sequence
  source: /note="Description of Artificial Sequence: Synthetic peptide"
SPRPQPLRW

SEQ ID NO: 23979 - protein, 10 aa, Artificial Sequence
  source: /note="Description of Artificial Sequence: Synthetic peptide"
ASDLKVNGLV

SEQ ID NO: 23980 - protein, 10 aa, Artificial Sequence
  source: /note="Description of Artificial Sequence: Synthetic peptide"
GLVLRRTAPK

SEQ ID NO: 23981 - protein, 10 aa, Artificial Sequence
  source: /note="Description of Artificial Sequence: Synthetic peptide"
SSAPPALPRR

SEQ ID NO: 23982 - protein, 10 aa, Artificial Sequence
  source: /note="Description of Artificial Sequence: Synthetic peptide"
VLRRTAPKTR

SEQ ID NO: 23983 - protein, 10 aa, Artificial Sequence
  source: /note="Description of Artificial Sequence: Synthetic peptide"
RTAPKTRRLP

SEQ ID NO: 23984 - protein, 10 aa, Artificial Sequence
  source: /note="Description of Artificial Sequence: Synthetic peptide"
DLKVNGLVLR

SEQ ID NO: 23985 - protein, 10 aa, Artificial Sequence
  source: /note="Description of Artificial Sequence: Synthetic peptide"
SPAPSSAPPA

SEQ ID NO: 23986 - protein, 10 aa, Artificial Sequence
  source: /note="Description of Artificial Sequence: Synthetic peptide"
SPRPQPLRWT

SEQ ID NO: 23987 - protein, 10 aa, Artificial Sequence
  source: /note="Description of Artificial Sequence: Synthetic peptide"
RPQPLRWTSS

SEQ ID NO: 23988 - protein, 10 aa, Artificial Sequence
  source: /note="Description of Artificial Sequence: Synthetic peptide"
WPHPTQHQAL

SEQ ID NO: 23989 - protein, 10 aa, Artificial Sequence
  source: /note="Description of Artificial Sequence: Synthetic peptide"
TPRRKGPPGA

SEQ ID NO: 23990 - protein, 10 aa, Artificial Sequence
  source: /note="Description of Artificial Sequence: Synthetic peptide"
SSHCCRSSSW

SEQ ID NO: 23991 - protein, 10 aa, Artificial Sequence
  source: /note="Description of Artificial Sequence: Synthetic peptide"
SDLKVNGLVL

SEQ ID NO: 23992 - protein, 9 aa, Artificial Sequence
  source: /note="Description of Artificial Sequence: Synthetic peptide"
KSSHSHTRK

SEQ ID NO: 23993 - protein, 9 aa, Artificial Sequence
  source: /note="Description of Artificial Sequence: Synthetic peptide"
SSHSHTRKK

SEQ ID NO: 23994 - protein, 9 aa, Artificial Sequence
  source: /note="Description of Artificial Sequence: Synthetic peptide"
HSHTRKKHK

SEQ ID NO: 23995 - protein, 9 aa, Artificial Sequence
  source: /note="Description of Artificial Sequence: Synthetic peptide"
HTRKKHKKK

SEQ ID NO: 23996 - protein, 10 aa, Artificial Sequence
  source: /note="Description of Artificial Sequence: Synthetic peptide"
KSSHSHTRKK

SEQ ID NO: 23997 - protein, 10 aa, Artificial Sequence
  source: /note="Description of Artificial Sequence: Synthetic peptide"
HSHTRKKHKK

SEQ ID NO: 23998 - protein, 10 aa, Artificial Sequence
  source: /note="Description of Artificial Sequence: Synthetic peptide"
DSKSSHSHTR

SEQ ID NO: 23999 - protein, 9 aa, Artificial Sequence
  source: /note="Description of Artificial Sequence: Synthetic peptide"
TLRPWLWLT

SEQ ID NO: 24000 - protein, 9 aa, Artificial Sequence
  source: /note="Description of Artificial Sequence: Synthetic peptide"
WLWLTAWAA

SEQ ID NO: 24001 - protein, 9 aa, Artificial Sequence
  source: /note="Description of Artificial Sequence: Synthetic peptide"
WLTAWAAST

SEQ ID NO: 24002 - protein, 9 aa, Artificial Sequence
  source: /note="Description of Artificial Sequence: Synthetic peptide"
FVIPPQTLR

SEQ ID NO: 24003 - protein, 9 aa, Artificial Sequence
  source: /note="Description of Artificial Sequence: Synthetic peptide"
CFVIPPQTL

SEQ ID NO: 24004 - protein, 9 aa, Artificial Sequence
  source: /note="Description of Artificial Sequence: Synthetic peptide"
PQTLRPWLW

SEQ ID NO: 24005 - protein, 9 aa, Artificial Sequence
  source: /note="Description of Artificial Sequence: Synthetic peptide"
NARCSSGMR

SEQ ID NO: 24006 - protein, 9 aa, Artificial Sequence
  source: /note="Description of Artificial Sequence: Synthetic peptide"
TAWAASTGA

SEQ ID NO: 24007 - protein, 9 aa, Artificial Sequence
  source: /note="Description of Artificial Sequence: Synthetic peptide"
RPWLWLTAW

SEQ ID NO: 24008 - protein, 9 aa, Artificial Sequence
  source: /note="Description of Artificial Sequence: Synthetic peptide"
RQLGANARC

SEQ ID NO: 24009 - protein, 9 aa, Artificial Sequence
  source: /note="Description of Artificial Sequence: Synthetic peptide"
ANARCSSGM

SEQ ID NO: 24010 - protein, 9 aa, Artificial Sequence
  source: /note="Description of Artificial Sequence: Synthetic peptide"
IPPQTLRPW

SEQ ID NO: 24011 - protein, 10 aa, Artificial Sequence
  source: /note="Description of Artificial Sequence: Synthetic peptide"
TLRPWLWLTA

SEQ ID NO: 24012 - protein, 10 aa, Artificial Sequence
  source: /note="Description of Artificial Sequence: Synthetic peptide"
LTAWAASTGA

SEQ ID NO: 24013 - protein, 10 aa, Artificial Sequence
  source: /note="Description of Artificial Sequence: Synthetic peptide"
CGRRQLGANA

SEQ ID NO: 24014 - protein, 10 aa, Artificial Sequence
  source: /note="Description of Artificial Sequence: Synthetic peptide"
CFVIPPQTLR

SEQ ID NO: 24015 - protein, 10 aa, Artificial Sequence
  source: /note="Description of Artificial Sequence: Synthetic peptide"
WAASTGACGR

SEQ ID NO: 24016 - protein, 10 aa, Artificial Sequence
  source: /note="Description of Artificial Sequence: Synthetic peptide"
IPPQTLRPWL

SEQ ID NO: 24017 - protein, 10 aa, Artificial Sequence
  source: /note="Description of Artificial Sequence: Synthetic peptide"
RPWLWLTAWA

SEQ ID NO: 24018 - protein, 10 aa, Artificial Sequence
  source: /note="Description of Artificial Sequence: Synthetic peptide"
RQLGANARCS

SEQ ID NO: 24019 - protein, 10 aa, Artificial Sequence
  source: /note="Description of Artificial Sequence: Synthetic peptide"
GANARCSSGM

SEQ ID NO: 24020 - protein, 9 aa, Artificial Sequence
  source: /note="Description of Artificial Sequence: Synthetic peptide"
YMEDYHQFY

SEQ ID NO: 24021 - protein, 10 aa, Artificial Sequence
  source: /note="Description of Artificial Sequence: Synthetic peptide"
KYMEDYHQFY

SEQ ID NO: 24022 - protein, 10 aa, Artificial Sequence
  source: /note="Description of Artificial Sequence: Synthetic peptide"
HQFYEDVKDA

SEQ ID NO: 24023 - protein, 10 aa, Artificial Sequence
  source: /note="Description of Artificial Sequence: Synthetic peptide"
YEDVKDAQEL

SEQ ID NO: 24024 - protein, 9 aa, Artificial Sequence
  source: /note="Description of Artificial Sequence: Synthetic peptide"
RAFWVTDER

SEQ ID NO: 24025 - protein, 9 aa, Artificial Sequence
  source: /note="Description of Artificial Sequence: Synthetic peptide"
AFWVTDERF

SEQ ID NO: 24026 - protein, 9 aa, Artificial Sequence
  source: /note="Description of Artificial Sequence: Synthetic peptide"
EALCRAFWV

SEQ ID NO: 24027 - protein, 9 aa, Artificial Sequence
  source: /note="Description of Artificial Sequence: Synthetic peptide"
AEALCRAFW

SEQ ID NO: 24028 - protein, 10 aa, Artificial Sequence
  source: /note="Description of Artificial Sequence: Synthetic peptide"
WVTDERFVQK

SEQ ID NO: 24029 - protein, 10 aa, Artificial Sequence
  source: /note="Description of Artificial Sequence: Synthetic peptide"
RAFWVTDERF

SEQ ID NO: 24030 - protein, 10 aa, Artificial Sequence
  source: /note="Description of Artificial Sequence: Synthetic peptide"
AEALCRAFWV

SEQ ID NO: 24031 - protein, 9 aa, Artificial Sequence
  source: /note="Description of Artificial Sequence: Synthetic peptide"
SLPRRRFPM

SEQ ID NO: 24032 - protein, 9 aa, Artificial Sequence
  source: /note="Description of Artificial Sequence: Synthetic peptide"
SAWSSERLK

SEQ ID NO: 24033 - protein, 9 aa, Artificial Sequence
  source: /note="Description of Artificial Sequence: Synthetic peptide"
ASLPRRRFP

SEQ ID NO: 24034 - protein, 9 aa, Artificial Sequence
  source: /note="Description of Artificial Sequence: Synthetic peptide"
RLKVHSRKW

SEQ ID NO: 24035 - protein, 9 aa, Artificial Sequence
  source: /note="Description of Artificial Sequence: Synthetic peptide"
KVHSRKWTY

SEQ ID NO: 24036 - protein, 9 aa, Artificial Sequence
  source: /note="Description of Artificial Sequence: Synthetic peptide"
PMSAWSSER

SEQ ID NO: 24037 - protein, 9 aa, Artificial Sequence
  source: /note="Description of Artificial Sequence: Synthetic peptide"
MSAWSSERL

SEQ ID NO: 24038 - protein, 9 aa, Artificial Sequence
  source: /note="Description of Artificial Sequence: Synthetic peptide"
FPMSAWSSE

SEQ ID NO: 24039 - protein, 9 aa, Artificial Sequence
  source: /note="Description of Artificial Sequence: Synthetic peptide"
LPRRRFPMS

SEQ ID NO: 24040 - protein, 9 aa, Artificial Sequence
  source: /note="Description of Artificial Sequence: Synthetic peptide"
HASLPRRRF

SEQ ID NO: 24041 - protein, 9 aa, Artificial Sequence
  source: /note="Description of Artificial Sequence: Synthetic peptide"
RRRFPMSAW

SEQ ID NO: 24042 - protein, 10 aa, Artificial Sequence
  source: /note="Description of Artificial Sequence: Synthetic peptide"
MSAWSSERLK

SEQ ID NO: 24043 - protein, 10 aa, Artificial Sequence
  source: /note="Description of Artificial Sequence: Synthetic peptide"
KVHSRKWTYR

SEQ ID NO: 24044 - protein, 10 aa, Artificial Sequence
  source: /note="Description of Artificial Sequence: Synthetic peptide"
STPPHASLPR

SEQ ID NO: 24045 - protein, 10 aa, Artificial Sequence
  source: /note="Description of Artificial Sequence: Synthetic peptide"
ASLPRRRFPM

SEQ ID NO: 24046 - protein, 10 aa, Artificial Sequence
  source: /note="Description of Artificial Sequence: Synthetic peptide"
SERLKVHSRK

SEQ ID NO: 24047 - protein, 10 aa, Artificial Sequence
  source: /note="Description of Artificial Sequence: Synthetic peptide"
RLKVHSRKWT

SEQ ID NO: 24048 - protein, 10 aa, Artificial Sequence
  source: /note="Description of Artificial Sequence: Synthetic peptide"
FPMSAWSSER

SEQ ID NO: 24049 - protein, 10 aa, Artificial Sequence
  source: /note="Description of Artificial Sequence: Synthetic peptide"
SPSTPPHASL

SEQ ID NO: 24050 - protein, 10 aa, Artificial Sequence
  source: /note="Description of Artificial Sequence: Synthetic peptide"
LPRRRFPMSA

SEQ ID NO: 24051 - protein, 10 aa, Artificial Sequence
  source: /note="Description of Artificial Sequence: Synthetic peptide"
RRFPMSAWSS

SEQ ID NO: 24052 - protein, 10 aa, Artificial Sequence
  source: /note="Description of Artificial Sequence: Synthetic peptide"
LKVHSRKWTY

SEQ ID NO: 24053 - protein, 9 aa, Artificial Sequence
  source: /note="Description of Artificial Sequence: Synthetic peptide"
ALRVPCSLK

SEQ ID NO: 24054 - protein, 9 aa, Artificial Sequence
  source: /note="Description of Artificial Sequence: Synthetic peptide"
PSRTRMRGK

SEQ ID NO: 24055 - protein, 9 aa, Artificial Sequence
  source: /note="Description of Artificial Sequence: Synthetic peptide"
RTRMRGKKV

SEQ ID NO: 24056 - protein, 9 aa, Artificial Sequence
  source: /note="Description of Artificial Sequence: Synthetic peptide"
RMRGKKVPP

SEQ ID NO: 24057 - protein, 9 aa, Artificial Sequence
  source: /note="Description of Artificial Sequence: Synthetic peptide"
RGKKVPPNH

SEQ ID NO: 24058 - protein, 9 aa, Artificial Sequence
  source: /note="Description of Artificial Sequence: Synthetic peptide"
ASPPRRTPA

SEQ ID NO: 24059 - protein, 9 aa, Artificial Sequence
  source: /note="Description of Artificial Sequence: Synthetic peptide"
SLKRPPSPG

SEQ ID NO: 24060 - protein, 9 aa, Artificial Sequence
  source: /note="Description of Artificial Sequence: Synthetic peptide"
SPPRRTPAL

SEQ ID NO: 24061 - protein, 9 aa, Artificial Sequence
  source: /note="Description of Artificial Sequence: Synthetic peptide"
RPPSPGALA

SEQ ID NO: 24062 - protein, 9 aa, Artificial Sequence
  source: /note="Description of Artificial Sequence: Synthetic peptide"
KKVPPNHPL

SEQ ID NO: 24063 - protein, 9 aa, Artificial Sequence
  source: /note="Description of Artificial Sequence: Synthetic peptide"
LQNPEPSMA

SEQ ID NO: 24064 - protein, 10 aa, Artificial Sequence
  source: /note="Description of Artificial Sequence: Synthetic peptide"
SLKRPPSPGA

SEQ ID NO: 24065 - protein, 10 aa, Artificial Sequence
  source: /note="Description of Artificial Sequence: Synthetic peptide"
PSRTRMRGKK

SEQ ID NO: 24066 - protein, 10 aa, Artificial Sequence
  source: /note="Description of Artificial Sequence: Synthetic peptide"
RTRMRGKKVP

SEQ ID NO: 24067 - protein, 10 aa, Artificial Sequence
  source: /note="Description of Artificial Sequence: Synthetic peptide"
RMRGKKVPPN

SEQ ID NO: 24068 - protein, 10 aa, Artificial Sequence
  source: /note="Description of Artificial Sequence: Synthetic peptide"
MASPPRRTPA

SEQ ID NO: 24069 - protein, 10 aa, Artificial Sequence
  source: /note="Description of Artificial Sequence: Synthetic peptide"
ALRVPCSLKR

SEQ ID NO: 24070 - protein, 10 aa, Artificial Sequence
  source: /note="Description of Artificial Sequence: Synthetic peptide"
RPGGAGGPPS

SEQ ID NO: 24071 - protein, 10 aa, Artificial Sequence
  source: /note="Description of Artificial Sequence: Synthetic peptide"
HPLQNPEPSM

SEQ ID NO: 24072 - protein, 10 aa, Artificial Sequence
  source: /note="Description of Artificial Sequence: Synthetic peptide"
TPALRVPCSL

SEQ ID NO: 24073 - protein, 10 aa, Artificial Sequence
  source: /note="Description of Artificial Sequence: Synthetic peptide"
LKRPPSPGAL

SEQ ID NO: 24074 - protein, 10 aa, Artificial Sequence
  source: /note="Description of Artificial Sequence: Synthetic peptide"
GKKVPPNHPL

SEQ ID NO: 24075 - protein, 10 aa, Artificial Sequence
  source: /note="Description of Artificial Sequence: Synthetic peptide"
LQNPEPSMAS

SEQ ID NO: 24076 - protein, 9 aa, Artificial Sequence
  source: /note="Description of Artificial Sequence: Synthetic peptide"
TRMVRRAAA

SEQ ID NO: 24077 - protein, 9 aa, Artificial Sequence
  source: /note="Description of Artificial Sequence: Synthetic peptide"
RMVRRAAAS

SEQ ID NO: 24078 - protein, 10 aa, Artificial Sequence
  source: /note="Description of Artificial Sequence: Synthetic peptide"
NLCSDDTRMV

SEQ ID NO: 24079 - protein, 10 aa, Artificial Sequence
  source: /note="Description of Artificial Sequence: Synthetic peptide"
RMVRRAAASK

SEQ ID NO: 24080 - protein, 10 aa, Artificial Sequence
  source: /note="Description of Artificial Sequence: Synthetic peptide"
RNLCSDDTRM

SEQ ID NO: 24081 - protein, 9 aa, Artificial Sequence
  source: /note="Description of Artificial Sequence: Synthetic peptide"
MVRWAAASK

SEQ ID NO: 24082 - protein, 9 aa, Artificial Sequence
  source: /note="Description of Artificial Sequence: Synthetic peptide"
DTPMVRWAA

SEQ ID NO: 24083 - protein, 9 aa, Artificial Sequence
  source: /note="Description of Artificial Sequence: Synthetic peptide"
TPMVRWAAA

SEQ ID NO: 24084 - protein, 9 aa, Artificial Sequence
  source: /note="Description of Artificial Sequence: Synthetic peptide"
VRWAAASKL

SEQ ID NO: 24085 - protein, 10 aa, Artificial Sequence
  source: /note="Description of Artificial Sequence: Synthetic peptide"
CSDDTPMVRW

SEQ ID NO: 24086 - protein, 10 aa, Artificial Sequence
  source: /note="Description of Artificial Sequence: Synthetic peptide"
MVRWAAASKL

SEQ ID NO: 24087 - protein, 10 aa, Artificial Sequence
  source: /note="Description of Artificial Sequence: Synthetic peptide"
DTPMVRWAAA

SEQ ID NO: 24088 - protein, 10 aa, Artificial Sequence
  source: /note="Description of Artificial Sequence: Synthetic peptide"
TPMVRWAAAS

SEQ ID NO: 24089 - protein, 10 aa, Artificial Sequence
  source: /note="Description of Artificial Sequence: Synthetic peptide"
WAAASKLGEF

SEQ ID NO: 24090 - protein, 9 aa, Artificial Sequence
  source: /note="Description of Artificial Sequence: Synthetic peptide"
DEQDLVRLL

SEQ ID NO: 24091 - protein, 10 aa, Artificial Sequence
  source: /note="Description of Artificial Sequence: Synthetic peptide"
NLASDEQDLV

SEQ ID NO: 24092 - protein, 10 aa, Artificial Sequence
  source: /note="Description of Artificial Sequence: Synthetic peptide"
DEQDLVRLLA

SEQ ID NO: 24093 - protein, 9 aa, Artificial Sequence
  source: /note="Description of Artificial Sequence: Synthetic peptide"
KFWRVRYMV

SEQ ID NO: 24094 - protein, 9 aa, Artificial Sequence
  source: /note="Description of Artificial Sequence: Synthetic peptide"
FWRVRYMVA

SEQ ID NO: 24095 - protein, 9 aa, Artificial Sequence
  source: /note="Description of Artificial Sequence: Synthetic peptide"
QAAEDKFWR

SEQ ID NO: 24096 - protein, 9 aa, Artificial Sequence
  source: /note="Description of Artificial Sequence: Synthetic peptide"
RQAAEDKFW

SEQ ID NO: 24097 - protein, 9 aa, Artificial Sequence
  source: /note="Description of Artificial Sequence: Synthetic peptide"
DKFWRVRYM

SEQ ID NO: 24098 - protein, 10 aa, Artificial Sequence
  source: /note="Description of Artificial Sequence: Synthetic peptide"
KFWRVRYMVA

SEQ ID NO: 24099 - protein, 10 aa, Artificial Sequence
  source: /note="Description of Artificial Sequence: Synthetic peptide"
QAAEDKFWRV

SEQ ID NO: 24100 - protein, 10 aa, Artificial Sequence
  source: /note="Description of Artificial Sequence: Synthetic peptide"
TLRQAAEDKF

SEQ ID NO: 24101 - protein, 10 aa, Artificial Sequence
  source: /note="Description of Artificial Sequence: Synthetic peptide"
AEDKFWRVRY

SEQ ID NO: 24102 - protein, 9 aa, Artificial Sequence
  source: /note="Description of Artificial Sequence: Synthetic peptide"
RHTKFFEEL

SEQ ID NO: 24103 - protein, 9 aa, Artificial Sequence
  source: /note="Description of Artificial Sequence: Synthetic peptide"
LEDPSNRSF

SEQ ID NO: 24104 - protein, 10 aa, Artificial Sequence
  source: /note="Description of Artificial Sequence: Synthetic peptide"
ELEDPSNRSF

SEQ ID NO: 24105 - protein, 10 aa, Artificial Sequence
  source: /note="Description of Artificial Sequence: Synthetic peptide"
LEDPSNRSFF

SEQ ID NO: 24106 - protein, 9 aa, Artificial Sequence
  source: /note="Description of Artificial Sequence: Synthetic peptide"
WTWSSRGLK

SEQ ID NO: 24107 - protein, 9 aa, Artificial Sequence
  source: /note="Description of Artificial Sequence: Synthetic peptide"
CSSSSTSTR

SEQ ID NO: 24108 - protein, 9 aa, Artificial Sequence
  source: /note="Description of Artificial Sequence: Synthetic peptide"
STGSAAWTW

SEQ ID NO: 24109 - protein, 9 aa, Artificial Sequence
  source: /note="Description of Artificial Sequence: Synthetic peptide"
SSTSTRSSA

SEQ ID NO: 24110 - protein, 9 aa, Artificial Sequence
  source: /note="Description of Artificial Sequence: Synthetic peptide"
RTASARCWT

SEQ ID NO: 24111 - protein, 9 aa, Artificial Sequence
  source: /note="Description of Artificial Sequence: Synthetic peptide"
SARCWTWSS

SEQ ID NO: 24112 - protein, 9 aa, Artificial Sequence
  source: /note="Description of Artificial Sequence: Synthetic peptide"
EGWTAWPSR

SEQ ID NO: 24113 - protein, 9 aa, Artificial Sequence
  source: /note="Description of Artificial Sequence: Synthetic peptide"
WTWTGTAPC

SEQ ID NO: 24114 - protein, 9 aa, Artificial Sequence
  source: /note="Description of Artificial Sequence: Synthetic peptide"
WTAWPSRPC

SEQ ID NO: 24115 - protein, 9 aa, Artificial Sequence
  source: /note="Description of Artificial Sequence: Synthetic peptide"
RPASSTGSA

SEQ ID NO: 24116 - protein, 9 aa, Artificial Sequence
  source: /note="Description of Artificial Sequence: Synthetic peptide"
RPCPSRTAS

SEQ ID NO: 24117 - protein, 9 aa, Artificial Sequence
  source: /note="Description of Artificial Sequence: Synthetic peptide"
SSAEGWTAW

SEQ ID NO: 24118 - protein, 9 aa, Artificial Sequence
  source: /note="Description of Artificial Sequence: Synthetic peptide"
KKHRPASST

SEQ ID NO: 24119 - protein, 9 aa, Artificial Sequence
  source: /note="Description of Artificial Sequence: Synthetic peptide"
ASSTGSAAW

SEQ ID NO: 24120 - protein, 9 aa, Artificial Sequence
  source: /note="Description of Artificial Sequence: Synthetic peptide"
RSSAEGWTA

SEQ ID NO: 24121 - protein, 9 aa, Artificial Sequence
  source: /note="Description of Artificial Sequence: Synthetic peptide"
AEGWTAWPS

SEQ ID NO: 24122 - protein, 9 aa, Artificial Sequence
  source: /note="Description of Artificial Sequence: Synthetic peptide"
TASARCWTW

SEQ ID NO: 24123 - protein, 10 aa, Artificial Sequence
  source: /note="Description of Artificial Sequence: Synthetic peptide"
RTASARCWTW

SEQ ID NO: 24124 - protein, 10 aa, Artificial Sequence
  source: /note="Description of Artificial Sequence: Synthetic peptide"
SSSTSTRSSA

SEQ ID NO: 24125 - protein, 10 aa, Artificial Sequence
  source: /note="Description of Artificial Sequence: Synthetic peptide"
SARCWTWSSR

SEQ ID NO: 24126 - protein, 10 aa, Artificial Sequence
  source: /note="Description of Artificial Sequence: Synthetic peptide"
CWTWSSRGLK

SEQ ID NO: 24127 - protein, 10 aa, Artificial Sequence
  source: /note="Description of Artificial Sequence: Synthetic peptide"
SSRGLKGRSR

SEQ ID NO: 24128 - protein, 10 aa, Artificial Sequence
  source: /note="Description of Artificial Sequence: Synthetic peptide"
RGLKGRSRCR

SEQ ID NO: 24129 - protein, 10 aa, Artificial Sequence
  source: /note="Description of Artificial Sequence: Synthetic peptide"
TWSSRGLKGR

SEQ ID NO: 24130 - protein, 10 aa, Artificial Sequence
  source: /note="Description of Artificial Sequence: Synthetic peptide"
SAAWTWTGTA

SEQ ID NO: 24131 - protein, 10 aa, Artificial Sequence
  source: /note="Description of Artificial Sequence: Synthetic peptide"
RPASSTGSAA

SEQ ID NO: 24132 - protein, 10 aa, Artificial Sequence
  source: /note="Description of Artificial Sequence: Synthetic peptide"
RPCPSRTASA

SEQ ID NO: 24133 - protein, 10 aa, Artificial Sequence
  source: /note="Description of Artificial Sequence: Synthetic peptide"
SSTGSAAWTW

SEQ ID NO: 24134 - protein, 10 aa, Artificial Sequence
  source: /note="Description of Artificial Sequence: Synthetic peptide"
RSSAEGWTAW

SEQ ID NO: 24135 - protein, 10 aa, Artificial Sequence
  source: /note="Description of Artificial Sequence: Synthetic peptide"
RCWTWSSRGL

SEQ ID NO: 24136 - protein, 10 aa, Artificial Sequence
  source: /note="Description of Artificial Sequence: Synthetic peptide"
SEEDKKHRPA

SEQ ID NO: 24137 - protein, 9 aa, Artificial Sequence
  source: /note="Description of Artificial Sequence: Synthetic peptide"
LTELFSYEH

SEQ ID NO: 24138 - protein, 9 aa, Artificial Sequence
  source: /note="Description of Artificial Sequence: Synthetic peptide"
NQLTELFSY

SEQ ID NO: 24139 - protein, 9 aa, Artificial Sequence
  source: /note="Description of Artificial Sequence: Synthetic peptide"
ELFSYEHFY

SEQ ID NO: 24140 - protein, 9 aa, Artificial Sequence
  source: /note="Description of Artificial Sequence: Synthetic peptide"
ADINQLTEL

SEQ ID NO: 24141 - protein, 9 aa, Artificial Sequence
  source: /note="Description of Artificial Sequence: Synthetic peptide"
TELFSYEHF

SEQ ID NO: 24142 - protein, 10 aa, Artificial Sequence
  source: /note="Description of Artificial Sequence: Synthetic peptide"
ELFSYEHFYV

SEQ ID NO: 24143 - protein, 10 aa, Artificial Sequence
  source: /note="Description of Artificial Sequence: Synthetic peptide"
LFSYEHFYVI

SEQ ID NO: 24144 - protein, 10 aa, Artificial Sequence
  source: /note="Description of Artificial Sequence: Synthetic peptide"
INQLTELFSY

SEQ ID NO: 24145 - protein, 10 aa, Artificial Sequence
  source: /note="Description of Artificial Sequence: Synthetic peptide"
ADINQLTELF

SEQ ID NO: 24146 - protein, 10 aa, Artificial Sequence
  source: /note="Description of Artificial Sequence: Synthetic peptide"
LTELFSYEHF

SEQ ID NO: 24147 - protein, 10 aa, Artificial Sequence
  source: /note="Description of Artificial Sequence: Synthetic peptide"
TELFSYEHFY

SEQ ID NO: 24148 - protein, 9 aa, Artificial Sequence
  source: /note="Description of Artificial Sequence: Synthetic peptide"
YLSVYHPQL

SEQ ID NO: 24149 - protein, 9 aa, Artificial Sequence
  source: /note="Description of Artificial Sequence: Synthetic peptide"
KYLSVYHPQ

SEQ ID NO: 24150 - protein, 9 aa, Artificial Sequence
  source: /note="Description of Artificial Sequence: Synthetic peptide"
KVKYLSVYH

SEQ ID NO: 24151 - protein, 9 aa, Artificial Sequence
  source: /note="Description of Artificial Sequence: Synthetic peptide"
LPLHKVKYL

SEQ ID NO: 24152 - protein, 9 aa, Artificial Sequence
  source: /note="Description of Artificial Sequence: Synthetic peptide"
LHKVKYLSV

SEQ ID NO: 24153 - protein, 9 aa, Artificial Sequence
  source: /note="Description of Artificial Sequence: Synthetic peptide"
HKVKYLSVY

SEQ ID NO: 24154 - protein, 10 aa, Artificial Sequence
  source: /note="Description of Artificial Sequence: Synthetic peptide"
YLSVYHPQLA

SEQ ID NO: 24155 - protein, 10 aa, Artificial Sequence
  source: /note="Description of Artificial Sequence: Synthetic peptide"
LLPLHKVKYL

SEQ ID NO: 24156 - protein, 10 aa, Artificial Sequence
  source: /note="Description of Artificial Sequence: Synthetic peptide"
KYLSVYHPQL

SEQ ID NO: 24157 - protein, 10 aa, Artificial Sequence
  source: /note="Description of Artificial Sequence: Synthetic peptide"
KVKYLSVYHP

SEQ ID NO: 24158 - protein, 10 aa, Artificial Sequence
  source: /note="Description of Artificial Sequence: Synthetic peptide"
VLLPLHKVKY

SEQ ID NO: 24159 - protein, 10 aa, Artificial Sequence
  source: /note="Description of Artificial Sequence: Synthetic peptide"
LHKVKYLSVY

SEQ ID NO: 24160 - protein, 10 aa, Artificial Sequence
  source: /note="Description of Artificial Sequence: Synthetic peptide"
HKVKYLSVYH

SEQ ID NO: 24161 - protein, 9 aa, Artificial Sequence
  source: /note="Description of Artificial Sequence: Synthetic peptide"
HYIHSDSDF

SEQ ID NO: 24162 - protein, 9 aa, Artificial Sequence
  source: /note="Description of Artificial Sequence: Synthetic peptide"
SDFSNNSSF

SEQ ID NO: 24163 - protein, 10 aa, Artificial Sequence
  source: /note="Description of Artificial Sequence: Synthetic peptide"
LHYIHSDSDF

SEQ ID NO: 24164 - protein, 10 aa, Artificial Sequence
  source: /note="Description of Artificial Sequence: Synthetic peptide"
CYCCGNIASI

SEQ ID NO: 24165 - protein, 10 aa, Artificial Sequence
  source: /note="Description of Artificial Sequence: Synthetic peptide"
YCCGNIASIM

SEQ ID NO: 24166 - protein, 9 aa, Artificial Sequence
  source: /note="Description of Artificial Sequence: Synthetic peptide"
YLLDSFGLK

SEQ ID NO: 24167 - protein, 9 aa, Artificial Sequence
  source: /note="Description of Artificial Sequence: Synthetic peptide"
VYLLDSFGL

SEQ ID NO: 24168 - protein, 9 aa, Artificial Sequence
  source: /note="Description of Artificial Sequence: Synthetic peptide"
QLVYLLDSF

SEQ ID NO: 24169 - protein, 9 aa, Artificial Sequence
  source: /note="Description of Artificial Sequence: Synthetic peptide"
MEEQLVYLL

SEQ ID NO: 24170 - protein, 10 aa, Artificial Sequence
  source: /note="Description of Artificial Sequence: Synthetic peptide"
LVYLLDSFGL

SEQ ID NO: 24171 - protein, 10 aa, Artificial Sequence
  source: /note="Description of Artificial Sequence: Synthetic peptide"
YLLDSFGLKT

SEQ ID NO: 24172 - protein, 10 aa, Artificial Sequence
  source: /note="Description of Artificial Sequence: Synthetic peptide"
LLDSFGLKTL

SEQ ID NO: 24173 - protein, 10 aa, Artificial Sequence
  source: /note="Description of Artificial Sequence: Synthetic peptide"
EQLVYLLDSF

SEQ ID NO: 24174 - protein, 9 aa, Artificial Sequence
  source: /note="Description of Artificial Sequence: Synthetic peptide"
RDSSTFPKK

SEQ ID NO: 24175 - protein, 9 aa, Artificial Sequence
  source: /note="Description of Artificial Sequence: Synthetic peptide"
EPKRDSSTF

SEQ ID NO: 24176 - protein, 10 aa, Artificial Sequence
  source: /note="Description of Artificial Sequence: Synthetic peptide"
SEPKRDSSTF

SEQ ID NO: 24177 - protein, 9 aa, Artificial Sequence
  source: /note="Description of Artificial Sequence: Synthetic peptide"
MAHGSFLNA

SEQ ID NO: 24178 - protein, 9 aa, Artificial Sequence
  source: /note="Description of Artificial Sequence: Synthetic peptide"
SFLNAKRNK

SEQ ID NO: 24179 - protein, 9 aa, Artificial Sequence
  source: /note="Description of Artificial Sequence: Synthetic peptide"
HGSFLNAKR

SEQ ID NO: 24180 - protein, 9 aa, Artificial Sequence
  source: /note="Description of Artificial Sequence: Synthetic peptide"
EAMAHGSFL

SEQ ID NO: 24181 - protein, 9 aa, Artificial Sequence
  source: /note="Description of Artificial Sequence: Synthetic peptide"
SEAMAHGSF

SEQ ID NO: 24182 - protein, 10 aa, Artificial Sequence
  source: /note="Description of Artificial Sequence: Synthetic peptide"
AMAHGSFLNA

SEQ ID NO: 24183 - protein, 10 aa, Artificial Sequence
  source: /note="Description of Artificial Sequence: Synthetic peptide"
MAHGSFLNAK

SEQ ID NO: 24184 - protein, 10 aa, Artificial Sequence
  source: /note="Description of Artificial Sequence: Synthetic peptide"
GSFLNAKRNK

SEQ ID NO: 24185 - protein, 10 aa, Artificial Sequence
  source: /note="Description of Artificial Sequence: Synthetic peptide"
WSEAMAHGSF

SEQ ID NO: 24186 - protein, 10 aa, Artificial Sequence
  source: /note="Description of Artificial Sequence: Synthetic peptide"
SEAMAHGSFL

SEQ ID NO: 24187 - protein, 9 aa, Artificial Sequence
  source: /note="Description of Artificial Sequence: Synthetic peptide"
RMREQQPLT

SEQ ID NO: 24188 - protein, 9 aa, Artificial Sequence
  source: /note="Description of Artificial Sequence: Synthetic peptide"
EQQPLTVFV

SEQ ID NO: 24189 - protein, 9 aa, Artificial Sequence
  source: /note="Description of Artificial Sequence: Synthetic peptide"
REQQPLTVF

SEQ ID NO: 24190 - protein, 10 aa, Artificial Sequence
  source: /note="Description of Artificial Sequence: Synthetic peptide"
RMREQQPLTV

SEQ ID NO: 24191 - protein, 10 aa, Artificial Sequence
  source: /note="Description of Artificial Sequence: Synthetic peptide"
CPRMREQQPL

SEQ ID NO: 24192 - protein, 10 aa, Artificial Sequence
  source: /note="Description of Artificial Sequence: Synthetic peptide"
MREQQPLTVF

SEQ ID NO: 24193 - protein, 10 aa, Artificial Sequence
  source: /note="Description of Artificial Sequence: Synthetic peptide"
REQQPLTVFV

SEQ ID NO: 24194 - protein, 9 aa, Artificial Sequence
  source: /note="Description of Artificial Sequence: Synthetic peptide"
LSHMDVSHY

SEQ ID NO: 24195 - protein, 9 aa, Artificial Sequence
  source: /note="Description of Artificial Sequence: Synthetic peptide"
SHMDVSHYV

SEQ ID NO: 24196 - protein, 10 aa, Artificial Sequence
  source: /note="Description of Artificial Sequence: Synthetic peptide"
VSHYVSPEQK

SEQ ID NO: 24197 - protein, 10 aa, Artificial Sequence
  source: /note="Description of Artificial Sequence: Synthetic peptide"
ILSHMDVSHY

SEQ ID NO: 24198 - protein, 10 aa, Artificial Sequence
  source: /note="Description of Artificial Sequence: Synthetic peptide"
LSHMDVSHYV

SEQ ID NO: 24199 - protein, 9 aa, Artificial Sequence
  source: /note="Description of Artificial Sequence: Synthetic peptide"
LRQPKVIVF

SEQ ID NO: 24200 - protein, 10 aa, Artificial Sequence
  source: /note="Description of Artificial Sequence: Synthetic peptide"
TPRDLRQPKV

SEQ ID NO: 24201 - protein, 10 aa, Artificial Sequence
  source: /note="Description of Artificial Sequence: Synthetic peptide"
DLRQPKVIVF

SEQ ID NO: 24202 - protein, 10 aa, Artificial Sequence
  source: /note="Description of Artificial Sequence: Synthetic peptide"
QPKVIVFCTV

SEQ ID NO: 24203 - protein, 9 aa, Artificial Sequence
  source: /note="Description of Artificial Sequence: Synthetic peptide"
SWCPSIHQL

SEQ ID NO: 24204 - protein, 9 aa, Artificial Sequence
  source: /note="Description of Artificial Sequence: Synthetic peptide"
HLSWCPSIH

SEQ ID NO: 24205 - protein, 10 aa, Artificial Sequence
  source: /note="Description of Artificial Sequence: Synthetic peptide"
SWCPSIHQLK

SEQ ID NO: 24206 - protein, 10 aa, Artificial Sequence
  source: /note="Description of Artificial Sequence: Synthetic peptide"
CPSIHQLKEL

SEQ ID NO: 24207 - protein, 10 aa, Artificial Sequence
  source: /note="Description of Artificial Sequence: Synthetic peptide"
LSWCPSIHQL

SEQ ID NO: 24208 - protein, 9 aa, Artificial Sequence
  source: /note="Description of Artificial Sequence: Synthetic peptide"
HPNKKATIL

SEQ ID NO: 24209 - protein, 9 aa, Artificial Sequence
  source: /note="Description of Artificial Sequence: Synthetic peptide"
VPHLQQEAI

SEQ ID NO: 24210 - protein, 9 aa, Artificial Sequence
  source: /note="Description of Artificial Sequence: Synthetic peptide"
IPSSLRHLL

SEQ ID NO: 24211 - protein, 9 aa, Artificial Sequence
  source: /note="Description of Artificial Sequence: Synthetic peptide"
SPRDHHALL

SEQ ID NO: 24212 - protein, 9 aa, Artificial Sequence
  source: /note="Description of Artificial Sequence: Synthetic peptide"
LPDLPSDSL

SEQ ID NO: 24213 - protein, 9 aa, Artificial Sequence
  source: /note="Description of Artificial Sequence: Synthetic peptide"
DSLPSHLGF

SEQ ID NO: 24214 - protein, 9 aa, Artificial Sequence
  source: /note="Description of Artificial Sequence: Synthetic peptide"
SKSQSADLL

SEQ ID NO: 24215 - protein, 9 aa, Artificial Sequence
  source: /note="Description of Artificial Sequence: Synthetic peptide"
LQQEAIPSS

SEQ ID NO: 24216 - protein, 9 aa, Artificial Sequence
  source: /note="Description of Artificial Sequence: Synthetic peptide"
QQEAIPSSL

SEQ ID NO: 24217 - protein, 9 aa, Artificial Sequence
  source: /note="Description of Artificial Sequence: Synthetic peptide"
LPSDSLPSH

SEQ ID NO: 24218 - protein, 10 aa, Artificial Sequence
  source: /note="Description of Artificial Sequence: Synthetic peptide"
LQQEAIPSSL

SEQ ID NO: 24219 - protein, 10 aa, Artificial Sequence
  source: /note="Description of Artificial Sequence: Synthetic peptide"
AIPSSLRHLL

SEQ ID NO: 24220 - protein, 10 aa, Artificial Sequence
  source: /note="Description of Artificial Sequence: Synthetic peptide"
LLKGADLPDL

SEQ ID NO: 24221 - protein, 10 aa, Artificial Sequence
  source: /note="Description of Artificial Sequence: Synthetic peptide"
SADLLQESHK

SEQ ID NO: 24222 - protein, 10 aa, Artificial Sequence
  source: /note="Description of Artificial Sequence: Synthetic peptide"
SPRDHHALLK

SEQ ID NO: 24223 - protein, 10 aa, Artificial Sequence
  source: /note="Description of Artificial Sequence: Synthetic peptide"
EAIPSSLRHL

SEQ ID NO: 24224 - protein, 10 aa, Artificial Sequence
  source: /note="Description of Artificial Sequence: Synthetic peptide"
IPSSLRHLLL

SEQ ID NO: 24225 - protein, 10 aa, Artificial Sequence
  source: /note="Description of Artificial Sequence: Synthetic peptide"
LPSDSLPSHL

SEQ ID NO: 24226 - protein, 10 aa, Artificial Sequence
  source: /note="Description of Artificial Sequence: Synthetic peptide"
KKATILKVPH

SEQ ID NO: 24227 - protein, 10 aa, Artificial Sequence
  source: /note="Description of Artificial Sequence: Synthetic peptide"
LKVPHLQQEA

SEQ ID NO: 24228 - protein, 10 aa, Artificial Sequence
  source: /note="Description of Artificial Sequence: Synthetic peptide"
SDSLPSHLGF

SEQ ID NO: 24229 - protein, 9 aa, Artificial Sequence
  source: /note="Description of Artificial Sequence: Synthetic peptide"
KTFGQLCNL

SEQ ID NO: 24230 - protein, 9 aa, Artificial Sequence
  source: /note="Description of Artificial Sequence: Synthetic peptide"
GQLCNLKVH

SEQ ID NO: 24231 - protein, 10 aa, Artificial Sequence
  source: /note="Description of Artificial Sequence: Synthetic peptide"
KTFGQLCNLK

SEQ ID NO: 24232 - protein, 10 aa, Artificial Sequence
  source: /note="Description of Artificial Sequence: Synthetic peptide"
QLCNLKVHLR

SEQ ID NO: 24233 - protein, 10 aa, Artificial Sequence
  source: /note="Description of Artificial Sequence: Synthetic peptide"
AKTFGQLCNL

SEQ ID NO: 24234 - protein, 10 aa, Artificial Sequence
  source: /note="Description of Artificial Sequence: Synthetic peptide"
GQLCNLKVHL

SEQ ID NO: 24235 - protein, 9 aa, Artificial Sequence
  source: /note="Description of Artificial Sequence: Synthetic peptide"
ALVSQHPGV

SEQ ID NO: 24236 - protein, 9 aa, Artificial Sequence
  source: /note="Description of Artificial Sequence: Synthetic peptide"
KKHEHENAL

SEQ ID NO: 24237 - protein, 9 aa, Artificial Sequence
  source: /note="Description of Artificial Sequence: Synthetic peptide"
HEHENALVS

SEQ ID NO: 24238 - protein, 9 aa, Artificial Sequence
  source: /note="Description of Artificial Sequence: Synthetic peptide"
HENALVSQH

SEQ ID NO: 24239 - protein, 10 aa, Artificial Sequence
  source: /note="Description of Artificial Sequence: Synthetic peptide"
ALVSQHPGVL

SEQ ID NO: 24240 - protein, 10 aa, Artificial Sequence
  source: /note="Description of Artificial Sequence: Synthetic peptide"
LKKHEHENAL

SEQ ID NO: 24241 - protein, 10 aa, Artificial Sequence
  source: /note="Description of Artificial Sequence: Synthetic peptide"
KKHEHENALV

SEQ ID NO: 24242 - protein, 9 aa, Artificial Sequence
  source: /note="Description of Artificial Sequence: Synthetic peptide"
AEELKPQGL

SEQ ID NO: 24243 - protein, 9 aa, Artificial Sequence
  source: /note="Description of Artificial Sequence: Synthetic peptide"
KIHITSYLL

SEQ ID NO: 24244 - protein, 9 aa, Artificial Sequence
  source: /note="Description of Artificial Sequence: Synthetic peptide"
SAHKKKEKK

SEQ ID NO: 24245 - protein, 9 aa, Artificial Sequence
  source: /note="Description of Artificial Sequence: Synthetic peptide"
NGKIHITSY

SEQ ID NO: 24246 - protein, 9 aa, Artificial Sequence
  source: /note="Description of Artificial Sequence: Synthetic peptide"
GKIHITSYL

SEQ ID NO: 24247 - protein, 10 aa, Artificial Sequence
  source: /note="Description of Artificial Sequence: Synthetic peptide"
ILDENANGKI

SEQ ID NO: 24248 - protein, 10 aa, Artificial Sequence
  source: /note="Description of Artificial Sequence: Synthetic peptide"
SLSAHKKKEK

SEQ ID NO: 24249 - protein, 10 aa, Artificial Sequence
  source: /note="Description of Artificial Sequence: Synthetic peptide"
AILDENANGK

SEQ ID NO: 24250 - protein, 10 aa, Artificial Sequence
  source: /note="Description of Artificial Sequence: Synthetic peptide"
ANGKIHITSY

SEQ ID NO: 24251 - protein, 10 aa, Artificial Sequence
  source: /note="Description of Artificial Sequence: Synthetic peptide"
NGKIHITSYL

SEQ ID NO: 24252 - protein, 10 aa, Artificial Sequence
  source: /note="Description of Artificial Sequence: Synthetic peptide"
GKIHITSYLL

SEQ ID NO: 24253 - protein, 9 aa, Artificial Sequence
  source: /note="Description of Artificial Sequence: Synthetic peptide"
SGLGMSMAR

SEQ ID NO: 24254 - protein, 9 aa, Artificial Sequence
  source: /note="Description of Artificial Sequence: Synthetic peptide"
QAVNCWSGL

SEQ ID NO: 24255 - protein, 9 aa, Artificial Sequence
  source: /note="Description of Artificial Sequence: Synthetic peptide"
VNCWSGLGM

SEQ ID NO: 24256 - protein, 9 aa, Artificial Sequence
  source: /note="Description of Artificial Sequence: Synthetic peptide"
CWSGLGMSM

SEQ ID NO: 24257 - protein, 9 aa, Artificial Sequence
  source: /note="Description of Artificial Sequence: Synthetic peptide"
LGMSMARNW

SEQ ID NO: 24258 - protein, 10 aa, Artificial Sequence
  source: /note="Description of Artificial Sequence: Synthetic peptide"
GQAVNCWSGL

SEQ ID NO: 24259 - protein, 10 aa, Artificial Sequence
  source: /note="Description of Artificial Sequence: Synthetic peptide"
AVNCWSGLGM

SEQ ID NO: 24260 - protein, 10 aa, Artificial Sequence
  source: /note="Description of Artificial Sequence: Synthetic peptide"
NCWSGLGMSM

SEQ ID NO: 24261 - protein, 9 aa, Artificial Sequence
  source: /note="Description of Artificial Sequence: Synthetic peptide"
KLENLLLLY

SEQ ID NO: 24262 - protein, 9 aa, Artificial Sequence
  source: /note="Description of Artificial Sequence: Synthetic peptide"
LLYLQHNRL

SEQ ID NO: 24263 - protein, 9 aa, Artificial Sequence
  source: /note="Description of Artificial Sequence: Synthetic peptide"
LLLYLQHNR

SEQ ID NO: 24264 - protein, 9 aa, Artificial Sequence
  source: /note="Description of Artificial Sequence: Synthetic peptide"
LENLLLLYL

SEQ ID NO: 24265 - protein, 10 aa, Artificial Sequence
  source: /note="Description of Artificial Sequence: Synthetic peptide"
KLENLLLLYL

SEQ ID NO: 24266 - protein, 10 aa, Artificial Sequence
  source: /note="Description of Artificial Sequence: Synthetic peptide"
LLLYLQHNRL

SEQ ID NO: 24267 - protein, 10 aa, Artificial Sequence
  source: /note="Description of Artificial Sequence: Synthetic peptide"
SKLENLLLLY

SEQ ID NO: 24268 - protein, 10 aa, Artificial Sequence
  source: /note="Description of Artificial Sequence: Synthetic peptide"
LLLLYLQHNR

SEQ ID NO: 24269 - protein, 9 aa, Artificial Sequence
  source: /note="Description of Artificial Sequence: Synthetic peptide"
KLDGSHPAL

SEQ ID NO: 24270 - protein, 9 aa, Artificial Sequence
  source: /note="Description of Artificial Sequence: Synthetic peptide"
SHPALLYGY

SEQ ID NO: 24271 - protein, 9 aa, Artificial Sequence
  source: /note="Description of Artificial Sequence: Synthetic peptide"
ALLYGYGGF

SEQ ID NO: 24272 - protein, 10 aa, Artificial Sequence
  source: /note="Description of Artificial Sequence: Synthetic peptide"
KLDGSHPALL

SEQ ID NO: 24273 - protein, 10 aa, Artificial Sequence
  source: /note="Description of Artificial Sequence: Synthetic peptide"
LLYGYGGFNI

SEQ ID NO: 24274 - protein, 10 aa, Artificial Sequence
  source: /note="Description of Artificial Sequence: Synthetic peptide"
GSHPALLYGY

SEQ ID NO: 24275 - protein, 10 aa, Artificial Sequence
  source: /note="Description of Artificial Sequence: Synthetic peptide"
LDGSHPALLY

SEQ ID NO: 24276 - protein, 10 aa, Artificial Sequence
  source: /note="Description of Artificial Sequence: Synthetic peptide"
IKLDGSHPAL

SEQ ID NO: 24277 - protein, 9 aa, Artificial Sequence
  source: /note="Description of Artificial Sequence: Synthetic peptide"
AAPPYIYAV

SEQ ID NO: 24278 - protein, 9 aa, Artificial Sequence
  source: /note="Description of Artificial Sequence: Synthetic peptide"
RGAAPPYIY

SEQ ID NO: 24279 - protein, 10 aa, Artificial Sequence
  source: /note="Description of Artificial Sequence: Synthetic peptide"
GAAPPYIYAV

SEQ ID NO: 24280 - protein, 10 aa, Artificial Sequence
  source: /note="Description of Artificial Sequence: Synthetic peptide"
QIRGAAPPYI

SEQ ID NO: 24281 - protein, 10 aa, Artificial Sequence
  source: /note="Description of Artificial Sequence: Synthetic peptide"
RGAAPPYIYA

SEQ ID NO: 24282 - protein, 10 aa, Artificial Sequence
  source: /note="Description of Artificial Sequence: Synthetic peptide"
IRGAAPPYIY

SEQ ID NO: 24283 - protein, 9 aa, Artificial Sequence
  source: /note="Description of Artificial Sequence: Synthetic peptide"
MSRAFKETK

SEQ ID NO: 24284 - protein, 9 aa, Artificial Sequence
  source: /note="Description of Artificial Sequence: Synthetic peptide"
FKETKHFPM

SEQ ID NO: 24285 - protein, 9 aa, Artificial Sequence
  source: /note="Description of Artificial Sequence: Synthetic peptide"
RAFKETKHF

SEQ ID NO: 24286 - protein, 10 aa, Artificial Sequence
  source: /note="Description of Artificial Sequence: Synthetic peptide"
VMSRAFKETK

SEQ ID NO: 24287 - protein, 10 aa, Artificial Sequence
  source: /note="Description of Artificial Sequence: Synthetic peptide"
KGPVMSRAFK

SEQ ID NO: 24288 - protein, 10 aa, Artificial Sequence
  source: /note="Description of Artificial Sequence: Synthetic peptide"
MSRAFKETKH

SEQ ID NO: 24289 - protein, 10 aa, Artificial Sequence
  source: /note="Description of Artificial Sequence: Synthetic peptide"
AFKETKHFPM

SEQ ID NO: 24290 - protein, 10 aa, Artificial Sequence
  source: /note="Description of Artificial Sequence: Synthetic peptide"
SRAFKETKHF

SEQ ID NO: 24291 - protein, 9 aa, Artificial Sequence
  source: /note="Description of Artificial Sequence: Synthetic peptide"
ILKERERQK

SEQ ID NO: 24292 - protein, 9 aa, Artificial Sequence
  source: /note="Description of Artificial Sequence: Synthetic peptide"
RQKGLKLGM

SEQ ID NO: 24293 - protein, 9 aa, Artificial Sequence
  source: /note="Description of Artificial Sequence: Synthetic peptide"
KERERQKGL

SEQ ID NO: 24294 - protein, 9 aa, Artificial Sequence
  source: /note="Description of Artificial Sequence: Synthetic peptide"
RERQKGLKL

SEQ ID NO: 24295 - protein, 10 aa, Artificial Sequence
  source: /note="Description of Artificial Sequence: Synthetic peptide"
AILKERERQK

SEQ ID NO: 24296 - protein, 10 aa, Artificial Sequence
  source: /note="Description of Artificial Sequence: Synthetic peptide"
KERERQKGLK

SEQ ID NO: 24297 - protein, 9 aa, Artificial Sequence
  source: /note="Description of Artificial Sequence: Synthetic peptide"
EPLLFRFFF

SEQ ID NO: 24298 - protein, 10 aa, Artificial Sequence
  source: /note="Description of Artificial Sequence: Synthetic peptide"
DEPLLFRFFF

SEQ ID NO: 24299 - protein, 9 aa, Artificial Sequence
  source: /note="Description of Artificial Sequence: Synthetic peptide"
KAAAPHTPK

SEQ ID NO: 24300 - protein, 9 aa, Artificial Sequence
  source: /note="Description of Artificial Sequence: Synthetic peptide"
APHTPKEPA

SEQ ID NO: 24301 - protein, 9 aa, Artificial Sequence
  source: /note="Description of Artificial Sequence: Synthetic peptide"
IVREVLPQA

SEQ ID NO: 24302 - protein, 9 aa, Artificial Sequence
  source: /note="Description of Artificial Sequence: Synthetic peptide"
REVLPQAST

SEQ ID NO: 24303 - protein, 9 aa, Artificial Sequence
  source: /note="Description of Artificial Sequence: Synthetic peptide"
EVLPQASTW

SEQ ID NO: 24304 - protein, 10 aa, Artificial Sequence
  source: /note="Description of Artificial Sequence: Synthetic peptide"
GIVREVLPQA

SEQ ID NO: 24305 - protein, 10 aa, Artificial Sequence
  source: /note="Description of Artificial Sequence: Synthetic peptide"
QASTWEQGLR

SEQ ID NO: 24306 - protein, 10 aa, Artificial Sequence
  source: /note="Description of Artificial Sequence: Synthetic peptide"
REVLPQASTW

SEQ ID NO: 24307 - protein, 9 aa, Artificial Sequence
  source: /note="Description of Artificial Sequence: Synthetic peptide"
GIQSQSKPY

SEQ ID NO: 24308 - protein, 10 aa, Artificial Sequence
  source: /note="Description of Artificial Sequence: Synthetic peptide"
KAKWHLGIQS

SEQ ID NO: 24309 - protein, 10 aa, Artificial Sequence
  source: /note="Description of Artificial Sequence: Synthetic peptide"
LGIQSQSKPY

SEQ ID NO: 24310 - protein, 10 aa, Artificial Sequence
  source: /note="Description of Artificial Sequence: Synthetic peptide"
IQSQSKPYDI

SEQ ID NO: 24311 - protein, 9 aa, Artificial Sequence
  source: /note="Description of Artificial Sequence: Synthetic peptide"
NWSKLHLTR

SEQ ID NO: 24312 - protein, 9 aa, Artificial Sequence
  source: /note="Description of Artificial Sequence: Synthetic peptide"
HLTRSHNNF

SEQ ID NO: 24313 - protein, 9 aa, Artificial Sequence
  source: /note="Description of Artificial Sequence: Synthetic peptide"
FNNWSKLHL

SEQ ID NO: 24314 - protein, 9 aa, Artificial Sequence
  source: /note="Description of Artificial Sequence: Synthetic peptide"
SKLHLTRSH

SEQ ID NO: 24315 - protein, 10 aa, Artificial Sequence
  source: /note="Description of Artificial Sequence: Synthetic peptide"
HLTRSHNNFV

SEQ ID NO: 24316 - protein, 10 aa, Artificial Sequence
  source: /note="Description of Artificial Sequence: Synthetic peptide"
SFNNWSKLHL

SEQ ID NO: 24317 - protein, 10 aa, Artificial Sequence
  source: /note="Description of Artificial Sequence: Synthetic peptide"
NNWSKLHLTR

SEQ ID NO: 24318 - protein, 10 aa, Artificial Sequence
  source: /note="Description of Artificial Sequence: Synthetic peptide"
LHLTRSHNNF

SEQ ID NO: 24319 - protein, 9 aa, Artificial Sequence
  source: /note="Description of Artificial Sequence: Synthetic peptide"
DLADSFFIV

SEQ ID NO: 24320 - protein, 9 aa, Artificial Sequence
  source: /note="Description of Artificial Sequence: Synthetic peptide"
AQGDLADSF

SEQ ID NO: 24321 - protein, 9 aa, Artificial Sequence
  source: /note="Description of Artificial Sequence: Synthetic peptide"
GDLADSFFI

SEQ ID NO: 24322 - protein, 10 aa, Artificial Sequence
  source: /note="Description of Artificial Sequence: Synthetic peptide"
AQGDLADSFF

SEQ ID NO: 24323 - protein, 10 aa, Artificial Sequence
  source: /note="Description of Artificial Sequence: Synthetic peptide"
IAQGDLADSF

SEQ ID NO: 24324 - protein, 10 aa, Artificial Sequence
  source: /note="Description of Artificial Sequence: Synthetic peptide"
GEQIIAQGDL

SEQ ID NO: 24325 - protein, 10 aa, Artificial Sequence
  source: /note="Description of Artificial Sequence: Synthetic peptide"
GDLADSFFIV

SEQ ID NO: 24326 - protein, 10 aa, Artificial Sequence
  source: /note="Description of Artificial Sequence: Synthetic peptide"
FVMEFLNGGT

SEQ ID NO: 24327 - protein, 9 aa, Artificial Sequence
  source: /note="Description of Artificial Sequence: Synthetic peptide"
HLSSAAHLL

SEQ ID NO: 24328 - protein, 9 aa, Artificial Sequence
  source: /note="Description of Artificial Sequence: Synthetic peptide"
YLLRSLWVP

SEQ ID NO: 24329 - protein, 9 aa, Artificial Sequence
  source: /note="Description of Artificial Sequence: Synthetic peptide"
GTLAAGFAV

SEQ ID NO: 24330 - protein, 9 aa, Artificial Sequence
  source: /note="Description of Artificial Sequence: Synthetic peptide"
QVHGHLSSA

SEQ ID NO: 24331 - protein, 9 aa, Artificial Sequence
  source: /note="Description of Artificial Sequence: Synthetic peptide"
SLHLRGPQA

SEQ ID NO: 24332 - protein, 9 aa, Artificial Sequence
  source: /note="Description of Artificial Sequence: Synthetic peptide"
LLRSLWVPA

SEQ ID NO: 24333 - protein, 9 aa, Artificial Sequence
  source: /note="Description of Artificial Sequence: Synthetic peptide"
RLHLGCHRK

SEQ ID NO: 24334 - protein, 9 aa, Artificial Sequence
  source: /note="Description of Artificial Sequence: Synthetic peptide"
AVPRAHNHK

SEQ ID NO: 24335 - protein, 9 aa, Artificial Sequence
  source: /note="Description of Artificial Sequence: Synthetic peptide"
PYLLRSLWV

SEQ ID NO: 24336 - protein, 9 aa, Artificial Sequence
  source: /note="Description of Artificial Sequence: Synthetic peptide"
LWVPALGTL

SEQ ID NO: 24337 - protein, 9 aa, Artificial Sequence
  source: /note="Description of Artificial Sequence: Synthetic peptide"
RPRKRQGGR

SEQ ID NO: 24338 - protein, 9 aa, Artificial Sequence
  source: /note="Description of Artificial Sequence: Synthetic peptide"
HNHKVCWVK

SEQ ID NO: 24339 - protein, 9 aa, Artificial Sequence
  source: /note="Description of Artificial Sequence: Synthetic peptide"
VQRQHAPQV

SEQ ID NO: 24340 - protein, 9 aa, Artificial Sequence
  source: /note="Description of Artificial Sequence: Synthetic peptide"
RQHAPQVRY

SEQ ID NO: 24341 - protein, 9 aa, Artificial Sequence
  source: /note="Description of Artificial Sequence: Synthetic peptide"
RSLWVPALG

SEQ ID NO: 24342 - protein, 9 aa, Artificial Sequence
  source: /note="Description of Artificial Sequence: Synthetic peptide"
RYPQLQGPY

SEQ ID NO: 24343 - protein, 9 aa, Artificial Sequence
  source: /note="Description of Artificial Sequence: Synthetic peptide"
WVKEAGDPR

SEQ ID NO: 24344 - protein, 9 aa, Artificial Sequence
  source: /note="Description of Artificial Sequence: Synthetic peptide"
QLQGPYLLR

SEQ ID NO: 24345 - protein, 9 aa, Artificial Sequence
  source: /note="Description of Artificial Sequence: Synthetic peptide"
SAAHLLLPL

SEQ ID NO: 24346 - protein, 9 aa, Artificial Sequence
  source: /note="Description of Artificial Sequence: Synthetic peptide"
GPSGQRPQV

SEQ ID NO: 24347 - protein, 9 aa, Artificial Sequence
  source: /note="Description of Artificial Sequence: Synthetic peptide"
RPQVHGHLS

SEQ ID NO: 24348 - protein, 9 aa, Artificial Sequence
  source: /note="Description of Artificial Sequence: Synthetic peptide"
VPRAHNHKV

SEQ ID NO: 24349 - protein, 9 aa, Artificial Sequence
  source: /note="Description of Artificial Sequence: Synthetic peptide"
DPRPGGLPA

SEQ ID NO: 24350 - protein, 9 aa, Artificial Sequence
  source: /note="Description of Artificial Sequence: Synthetic peptide"
APQVRYPQL

SEQ ID NO: 24351 - protein, 9 aa, Artificial Sequence
  source: /note="Description of Artificial Sequence: Synthetic peptide"
YPQLQGPYL

SEQ ID NO: 24352 - protein, 9 aa, Artificial Sequence
  source: /note="Description of Artificial Sequence: Synthetic peptide"
VPALGTLAA

SEQ ID NO: 24353 - protein, 9 aa, Artificial Sequence
  source: /note="Description of Artificial Sequence: Synthetic peptide"
ALGTLAAGF

SEQ ID NO: 24354 - protein, 9 aa, Artificial Sequence
  source: /note="Description of Artificial Sequence: Synthetic peptide"
RKRQGGRQA

SEQ ID NO: 24355 - protein, 9 aa, Artificial Sequence
  source: /note="Description of Artificial Sequence: Synthetic peptide"
GQRPQVHGH

SEQ ID NO: 24356 - protein, 9 aa, Artificial Sequence
  source: /note="Description of Artificial Sequence: Synthetic peptide"
HGHLSSAAH

SEQ ID NO: 24357 - protein, 9 aa, Artificial Sequence
  source: /note="Description of Artificial Sequence: Synthetic peptide"
GHLSSAAHL

SEQ ID NO: 24358 - protein, 9 aa, Artificial Sequence
  source: /note="Description of Artificial Sequence: Synthetic peptide"
LSSAAHLLL

SEQ ID NO: 24359 - protein, 9 aa, Artificial Sequence
  source: /note="Description of Artificial Sequence: Synthetic peptide"
LQRLHLGCH

SEQ ID NO: 24360 - protein, 9 aa, Artificial Sequence
  source: /note="Description of Artificial Sequence: Synthetic peptide"
CHRKAGIPV

SEQ ID NO: 24361 - protein, 9 aa, Artificial Sequence
  source: /note="Description of Artificial Sequence: Synthetic peptide"
KAGIPVSSL

SEQ ID NO: 24362 - protein, 9 aa, Artificial Sequence
  source: /note="Description of Artificial Sequence: Synthetic peptide"
LHLRGPQAV

SEQ ID NO: 24363 - protein, 9 aa, Artificial Sequence
  source: /note="Description of Artificial Sequence: Synthetic peptide"
RAHNHKVCW

SEQ ID NO: 24364 - protein, 9 aa, Artificial Sequence
  source: /note="Description of Artificial Sequence: Synthetic peptide"
PQLQGPYLL

SEQ ID NO: 24365 - protein, 9 aa, Artificial Sequence
  source: /note="Description of Artificial Sequence: Synthetic peptide"
GPYLLRSLW

SEQ ID NO: 24366 - protein, 9 aa, Artificial Sequence
  source: /note="Description of Artificial Sequence: Synthetic peptide"
LRSLWVPAL

SEQ ID NO: 24367 - protein, 10 aa, Artificial Sequence
  source: /note="Description of Artificial Sequence: Synthetic peptide"
HLSSAAHLLL

SEQ ID NO: 24368 - protein, 10 aa, Artificial Sequence
  source: /note="Description of Artificial Sequence: Synthetic peptide"
LLLPLQRLHL

SEQ ID NO: 24369 - protein, 10 aa, Artificial Sequence
  source: /note="Description of Artificial Sequence: Synthetic peptide"
SLHLRGPQAV

SEQ ID NO: 24370 - protein, 10 aa, Artificial Sequence
  source: /note="Description of Artificial Sequence: Synthetic peptide"
YLLRSLWVPA

SEQ ID NO: 24371 - protein, 10 aa, Artificial Sequence
  source: /note="Description of Artificial Sequence: Synthetic peptide"
LLRSLWVPAL

SEQ ID NO: 24372 - protein, 10 aa, Artificial Sequence
  source: /note="Description of Artificial Sequence: Synthetic peptide"
SLWVPALGTL

SEQ ID NO: 24373 - protein, 10 aa, Artificial Sequence
  source: /note="Description of Artificial Sequence: Synthetic peptide"
ALGTLAAGFA

SEQ ID NO: 24374 - protein, 10 aa, Artificial Sequence
  source: /note="Description of Artificial Sequence: Synthetic peptide"
AAHLLLPLQR

SEQ ID NO: 24375 - protein, 10 aa, Artificial Sequence
  source: /note="Description of Artificial Sequence: Synthetic peptide"
RYPQLQGPYL

SEQ ID NO: 24376 - protein, 10 aa, Artificial Sequence
  source: /note="Description of Artificial Sequence: Synthetic peptide"
RMRPRKRQGG

SEQ ID NO: 24377 - protein, 10 aa, Artificial Sequence
  source: /note="Description of Artificial Sequence: Synthetic peptide"
LQRLHLGCHR

SEQ ID NO: 24378 - protein, 10 aa, Artificial Sequence
  source: /note="Description of Artificial Sequence: Synthetic peptide"
RLHLGCHRKA

SEQ ID NO: 24379 - protein, 10 aa, Artificial Sequence
  source: /note="Description of Artificial Sequence: Synthetic peptide"
SSLHLRGPQA

SEQ ID NO: 24380 - protein, 10 aa, Artificial Sequence
  source: /note="Description of Artificial Sequence: Synthetic peptide"
HLRGPQAVPR

SEQ ID NO: 24381 - protein, 10 aa, Artificial Sequence
  source: /note="Description of Artificial Sequence: Synthetic peptide"
QAVPRAHNHK

SEQ ID NO: 24382 - protein, 10 aa, Artificial Sequence
  source: /note="Description of Artificial Sequence: Synthetic peptide"
RAHNHKVCWV

SEQ ID NO: 24383 - protein, 10 aa, Artificial Sequence
  source: /note="Description of Artificial Sequence: Synthetic peptide"
VQRQHAPQVR

SEQ ID NO: 24384 - protein, 10 aa, Artificial Sequence
  source: /note="Description of Artificial Sequence: Synthetic peptide"
VRYPQLQGPY

SEQ ID NO: 24385 - protein, 10 aa, Artificial Sequence
  source: /note="Description of Artificial Sequence: Synthetic peptide"
SSAAHLLLPL

SEQ ID NO: 24386 - protein, 10 aa, Artificial Sequence
  source: /note="Description of Artificial Sequence: Synthetic peptide"
RPQVHGHLSS

SEQ ID NO: 24387 - protein, 10 aa, Artificial Sequence
  source: /note="Description of Artificial Sequence: Synthetic peptide"
VPRAHNHKVC

SEQ ID NO: 24388 - protein, 10 aa, Artificial Sequence
  source: /note="Description of Artificial Sequence: Synthetic peptide"
DPRPGGLPAV

SEQ ID NO: 24389 - protein, 10 aa, Artificial Sequence
  source: /note="Description of Artificial Sequence: Synthetic peptide"
YPQLQGPYLL

SEQ ID NO: 24390 - protein, 10 aa, Artificial Sequence
  source: /note="Description of Artificial Sequence: Synthetic peptide"
GPYLLRSLWV

SEQ ID NO: 24391 - protein, 10 aa, Artificial Sequence
  source: /note="Description of Artificial Sequence: Synthetic peptide"
HLGCHRKAGI

SEQ ID NO: 24392 - protein, 10 aa, Artificial Sequence
  source: /note="Description of Artificial Sequence: Synthetic peptide"
GQRPQVHGHL

SEQ ID NO: 24393 - protein, 10 aa, Artificial Sequence
  source: /note="Description of Artificial Sequence: Synthetic peptide"
HGHLSSAAHL

SEQ ID NO: 24394 - protein, 10 aa, Artificial Sequence
  source: /note="Description of Artificial Sequence: Synthetic peptide"
GHLSSAAHLL

SEQ ID NO: 24395 - protein, 10 aa, Artificial Sequence
  source: /note="Description of Artificial Sequence: Synthetic peptide"
RKAGIPVSSL

SEQ ID NO: 24396 - protein, 10 aa, Artificial Sequence
  source: /note="Description of Artificial Sequence: Synthetic peptide"
AGIPVSSLHL

SEQ ID NO: 24397 - protein, 10 aa, Artificial Sequence
  source: /note="Description of Artificial Sequence: Synthetic peptide"
RQHAPQVRYP

SEQ ID NO: 24398 - protein, 10 aa, Artificial Sequence
  source: /note="Description of Artificial Sequence: Synthetic peptide"
LQGPYLLRSL

SEQ ID NO: 24399 - protein, 10 aa, Artificial Sequence
  source: /note="Description of Artificial Sequence: Synthetic peptide"
VPALGTLAAG

SEQ ID NO: 24400 - protein, 9 aa, Artificial Sequence
  source: /note="Description of Artificial Sequence: Synthetic peptide"
CLHISDFSF

SEQ ID NO: 24401 - protein, 10 aa, Artificial Sequence
  source: /note="Description of Artificial Sequence: Synthetic peptide"
CLHISDFSFL

SEQ ID NO: 24402 - protein, 10 aa, Artificial Sequence
  source: /note="Description of Artificial Sequence: Synthetic peptide"
SPGCLHISDF

SEQ ID NO: 24403 - protein, 10 aa, Artificial Sequence
  source: /note="Description of Artificial Sequence: Synthetic peptide"
GCLHISDFSF

SEQ ID NO: 24404 - protein, 9 aa, Artificial Sequence
  source: /note="Description of Artificial Sequence: Synthetic peptide"
KQICIPRSL

SEQ ID NO: 24405 - protein, 9 aa, Artificial Sequence
  source: /note="Description of Artificial Sequence: Synthetic peptide"
CIPRSLSVK

SEQ ID NO: 24406 - protein, 10 aa, Artificial Sequence
  source: /note="Description of Artificial Sequence: Synthetic peptide"
KQICIPRSLS

SEQ ID NO: 24407 - protein, 10 aa, Artificial Sequence
  source: /note="Description of Artificial Sequence: Synthetic peptide"
LEKQICIPRS

SEQ ID NO: 24408 - protein, 9 aa, Artificial Sequence
  source: /note="Description of Artificial Sequence: Synthetic peptide"
KLMAEVLAM

SEQ ID NO: 24409 - protein, 9 aa, Artificial Sequence
  source: /note="Description of Artificial Sequence: Synthetic peptide"
LMAEVLAMI

SEQ ID NO: 24410 - protein, 9 aa, Artificial Sequence
  source: /note="Description of Artificial Sequence: Synthetic peptide"
NQKLMAEVL

SEQ ID NO: 24411 - protein, 9 aa, Artificial Sequence
  source: /note="Description of Artificial Sequence: Synthetic peptide"
AEVLAMIES

SEQ ID NO: 24412 - protein, 10 aa, Artificial Sequence
  source: /note="Description of Artificial Sequence: Synthetic peptide"
GINQKLMAEV

SEQ ID NO: 24413 - protein, 10 aa, Artificial Sequence
  source: /note="Description of Artificial Sequence: Synthetic peptide"
KLMAEVLAMI

SEQ ID NO: 24414 - protein, 10 aa, Artificial Sequence
  source: /note="Description of Artificial Sequence: Synthetic peptide"
QKLMAEVLAM

SEQ ID NO: 24415 - protein, 10 aa, Artificial Sequence
  source: /note="Description of Artificial Sequence: Synthetic peptide"
AEVLAMIEST

SEQ ID NO: 24416 - protein, 9 aa, Artificial Sequence
  source: /note="Description of Artificial Sequence: Synthetic peptide"
GVIEDFINA

SEQ ID NO: 24417 - protein, 10 aa, Artificial Sequence
  source: /note="Description of Artificial Sequence: Synthetic peptide"
GVIEDFINAL

SEQ ID NO: 24418 - protein, 9 aa, Artificial Sequence
  source: /note="Description of Artificial Sequence: Synthetic peptide"
QPNNQLNPI

SEQ ID NO: 24419 - protein, 10 aa, Artificial Sequence
  source: /note="Description of Artificial Sequence: Synthetic peptide"
KQPNNQLNPI

SEQ ID NO: 24420 - protein, 9 aa, Artificial Sequence
  source: /note="Description of Artificial Sequence: Synthetic peptide"
LLSPCNASI

SEQ ID NO: 24421 - protein, 9 aa, Artificial Sequence
  source: /note="Description of Artificial Sequence: Synthetic peptide"
SIMCPLNPA

SEQ ID NO: 24422 - protein, 9 aa, Artificial Sequence
  source: /note="Description of Artificial Sequence: Synthetic peptide"
IMCPLNPAA

SEQ ID NO: 24423 - protein, 9 aa, Artificial Sequence
  source: /note="Description of Artificial Sequence: Synthetic peptide"
SPPSPSSLL

SEQ ID NO: 24424 - protein, 9 aa, Artificial Sequence
  source: /note="Description of Artificial Sequence: Synthetic peptide"
LSPCNASIM

SEQ ID NO: 24425 - protein, 10 aa, Artificial Sequence
  source: /note="Description of Artificial Sequence: Synthetic peptide"
SLLSPCNASI

SEQ ID NO: 24426 - protein, 10 aa, Artificial Sequence
  source: /note="Description of Artificial Sequence: Synthetic peptide"
SIMCPLNPAA

SEQ ID NO: 24427 - protein, 10 aa, Artificial Sequence
  source: /note="Description of Artificial Sequence: Synthetic peptide"
LLSPCNASIM

SEQ ID NO: 24428 - protein, 10 aa, Artificial Sequence
  source: /note="Description of Artificial Sequence: Synthetic peptide"
PPSPPSPSSL

SEQ ID NO: 24429 - protein, 10 aa, Artificial Sequence
  source: /note="Description of Artificial Sequence: Synthetic peptide"
SPPPQPPQPV

SEQ ID NO: 24430 - protein, 9 aa, Artificial Sequence
  source: /note="Description of Artificial Sequence: Synthetic peptide"
VYFGQVLGM

SEQ ID NO: 24431 - protein, 9 aa, Artificial Sequence
  source: /note="Description of Artificial Sequence: Synthetic peptide"
RVYFGQVLG

SEQ ID NO: 24432 - protein, 9 aa, Artificial Sequence
  source: /note="Description of Artificial Sequence: Synthetic peptide"
HRVYFGQVL

SEQ ID NO: 24433 - protein, 10 aa, Artificial Sequence
  source: /note="Description of Artificial Sequence: Synthetic peptide"
RVYFGQVLGM

SEQ ID NO: 24434 - protein, 10 aa, Artificial Sequence
  source: /note="Description of Artificial Sequence: Synthetic peptide"
VLGMCDQISF

SEQ ID NO: 24435 - protein, 10 aa, Artificial Sequence
  source: /note="Description of Artificial Sequence: Synthetic peptide"
GQVLGMCDQI

SEQ ID NO: 24436 - protein, 9 aa, Artificial Sequence
  source: /note="Description of Artificial Sequence: Synthetic peptide"
IIRDFFPTV

SEQ ID NO: 24437 - protein, 9 aa, Artificial Sequence
  source: /note="Description of Artificial Sequence: Synthetic peptide"
GFTIIRDFF

SEQ ID NO: 24438 - protein, 9 aa, Artificial Sequence
  source: /note="Description of Artificial Sequence: Synthetic peptide"
TIIRDFFPT

SEQ ID NO: 24439 - protein, 9 aa, Artificial Sequence
  source: /note="Description of Artificial Sequence: Synthetic peptide"
APFYGFTII

SEQ ID NO: 24440 - protein, 9 aa, Artificial Sequence
  source: /note="Description of Artificial Sequence: Synthetic peptide"
YGFTIIRDF

SEQ ID NO: 24441 - protein, 9 aa, Artificial Sequence
  source: /note="Description of Artificial Sequence: Synthetic peptide"
IRDFFPTVF

SEQ ID NO: 24442 - protein, 10 aa, Artificial Sequence
  source: /note="Description of Artificial Sequence: Synthetic peptide"
TIIRDFFPTV

SEQ ID NO: 24443 - protein, 10 aa, Artificial Sequence
  source: /note="Description of Artificial Sequence: Synthetic peptide"
FYGFTIIRDF

SEQ ID NO: 24444 - protein, 10 aa, Artificial Sequence
  source: /note="Description of Artificial Sequence: Synthetic peptide"
YGFTIIRDFF

SEQ ID NO: 24445 - protein, 10 aa, Artificial Sequence
  source: /note="Description of Artificial Sequence: Synthetic peptide"
APFYGFTIIR

SEQ ID NO: 24446 - protein, 10 aa, Artificial Sequence
  source: /note="Description of Artificial Sequence: Synthetic peptide"
FTIIRDFFPT

SEQ ID NO: 24447 - protein, 10 aa, Artificial Sequence
  source: /note="Description of Artificial Sequence: Synthetic peptide"
IIRDFFPTVF

SEQ ID NO: 24448 - protein, 9 aa, Artificial Sequence
  source: /note="Description of Artificial Sequence: Synthetic peptide"
KLMFFIPVI

SEQ ID NO: 24449 - protein, 9 aa, Artificial Sequence
  source: /note="Description of Artificial Sequence: Synthetic peptide"
FIPVIPAPI

SEQ ID NO: 24450 - protein, 9 aa, Artificial Sequence
  source: /note="Description of Artificial Sequence: Synthetic peptide"
KAKLMFFIP

SEQ ID NO: 24451 - protein, 9 aa, Artificial Sequence
  source: /note="Description of Artificial Sequence: Synthetic peptide"
MFFIPVIPA

SEQ ID NO: 24452 - protein, 9 aa, Artificial Sequence
  source: /note="Description of Artificial Sequence: Synthetic peptide"
KKAKLMFFI

SEQ ID NO: 24453 - protein, 9 aa, Artificial Sequence
  source: /note="Description of Artificial Sequence: Synthetic peptide"
AKLMFFIPV

SEQ ID NO: 24454 - protein, 10 aa, Artificial Sequence
  source: /note="Description of Artificial Sequence: Synthetic peptide"
LMFFIPVIPA

SEQ ID NO: 24455 - protein, 10 aa, Artificial Sequence
  source: /note="Description of Artificial Sequence: Synthetic peptide"
FFIPVIPAPI

SEQ ID NO: 24456 - protein, 10 aa, Artificial Sequence
  source: /note="Description of Artificial Sequence: Synthetic peptide"
KAKLMFFIPV

SEQ ID NO: 24457 - protein, 10 aa, Artificial Sequence
  source: /note="Description of Artificial Sequence: Synthetic peptide"
AKLMFFIPVI

SEQ ID NO: 24458 - protein, 9 aa, Artificial Sequence
  source: /note="Description of Artificial Sequence: Synthetic peptide"
SFQQLDSAR

SEQ ID NO: 24459 - protein, 10 aa, Artificial Sequence
  source: /note="Description of Artificial Sequence: Synthetic peptide"
QSFQQLDSAR

SEQ ID NO: 24460 - protein, 9 aa, Artificial Sequence
  source: /note="Description of Artificial Sequence: Synthetic peptide"
RWKAARLVA

SEQ ID NO: 24461 - protein, 9 aa, Artificial Sequence
  source: /note="Description of Artificial Sequence: Synthetic peptide"
DLRWKAARL

SEQ ID NO: 24462 - protein, 9 aa, Artificial Sequence
  source: /note="Description of Artificial Sequence: Synthetic peptide"
WKAARLVAA

SEQ ID NO: 24463 - protein, 9 aa, Artificial Sequence
  source: /note="Description of Artificial Sequence: Synthetic peptide"
LRWKAARLV

SEQ ID NO: 24464 - protein, 9 aa, Artificial Sequence
  source: /note="Description of Artificial Sequence: Synthetic peptide"
LPPDLRWKA

SEQ ID NO: 24465 - protein, 10 aa, Artificial Sequence
  source: /note="Description of Artificial Sequence: Synthetic peptide"
SLPPDLRWKA

SEQ ID NO: 24466 - protein, 10 aa, Artificial Sequence
  source: /note="Description of Artificial Sequence: Synthetic peptide"
QSLPPDLRWK

SEQ ID NO: 24467 - protein, 10 aa, Artificial Sequence
  source: /note="Description of Artificial Sequence: Synthetic peptide"
RWKAARLVAA

SEQ ID NO: 24468 - protein, 10 aa, Artificial Sequence
  source: /note="Description of Artificial Sequence: Synthetic peptide"
DLRWKAARLV

SEQ ID NO: 24469 - protein, 10 aa, Artificial Sequence
  source: /note="Description of Artificial Sequence: Synthetic peptide"
VQSLPPDLRW

SEQ ID NO: 24470 - protein, 10 aa, Artificial Sequence
  source: /note="Description of Artificial Sequence: Synthetic peptide"
LRWKAARLVA

SEQ ID NO: 24471 - protein, 10 aa, Artificial Sequence
  source: /note="Description of Artificial Sequence: Synthetic peptide"
LPPDLRWKAA

SEQ ID NO: 24472 - protein, 9 aa, Artificial Sequence
  source: /note="Description of Artificial Sequence: Synthetic peptide"
QLTRALAIL

SEQ ID NO: 24473 - protein, 9 aa, Artificial Sequence
  source: /note="Description of Artificial Sequence: Synthetic peptide"
KIGQLTRAL

SEQ ID NO: 24474 - protein, 9 aa, Artificial Sequence
  source: /note="Description of Artificial Sequence: Synthetic peptide"
GQLTRALAI

SEQ ID NO: 24475 - protein, 10 aa, Artificial Sequence
  source: /note="Description of Artificial Sequence: Synthetic peptide"
ALAILEKSRL

SEQ ID NO: 24476 - protein, 10 aa, Artificial Sequence
  source: /note="Description of Artificial Sequence: Synthetic peptide"
LTRALAILEK

SEQ ID NO: 24477 - protein, 10 aa, Artificial Sequence
  source: /note="Description of Artificial Sequence: Synthetic peptide"
KIGQLTRALA

SEQ ID NO: 24478 - protein, 10 aa, Artificial Sequence
  source: /note="Description of Artificial Sequence: Synthetic peptide"
RALAILEKSR

SEQ ID NO: 24479 - protein, 10 aa, Artificial Sequence
  source: /note="Description of Artificial Sequence: Synthetic peptide"
EKIGQLTRAL

SEQ ID NO: 24480 - protein, 10 aa, Artificial Sequence
  source: /note="Description of Artificial Sequence: Synthetic peptide"
GQLTRALAIL

SEQ ID NO: 24481 - protein, 9 aa, Artificial Sequence
  source: /note="Description of Artificial Sequence: Synthetic peptide"
AASSTAAPV

SEQ ID NO: 24482 - protein, 9 aa, Artificial Sequence
  source: /note="Description of Artificial Sequence: Synthetic peptide"
STAAPVITA

SEQ ID NO: 24483 - protein, 9 aa, Artificial Sequence
  source: /note="Description of Artificial Sequence: Synthetic peptide"
TPAPAASST

SEQ ID NO: 24484 - protein, 9 aa, Artificial Sequence
  source: /note="Description of Artificial Sequence: Synthetic peptide"
APAASSTAA

SEQ ID NO: 24485 - protein, 9 aa, Artificial Sequence
  source: /note="Description of Artificial Sequence: Synthetic peptide"
ASSTAAPVI

SEQ ID NO: 24486 - protein, 10 aa, Artificial Sequence
  source: /note="Description of Artificial Sequence: Synthetic peptide"
TAAPVITAPT

SEQ ID NO: 24487 - protein, 10 aa, Artificial Sequence
  source: /note="Description of Artificial Sequence: Synthetic peptide"
TPAPAASSTA

SEQ ID NO: 24488 - protein, 10 aa, Artificial Sequence
  source: /note="Description of Artificial Sequence: Synthetic peptide"
APAASSTAAP

SEQ ID NO: 24489 - protein, 10 aa, Artificial Sequence
  source: /note="Description of Artificial Sequence: Synthetic peptide"
AASSTAAPVI

SEQ ID NO: 24490 - protein, 9 aa, Artificial Sequence
  source: /note="Description of Artificial Sequence: Synthetic peptide"
LSWGTVSPY

SEQ ID NO: 24491 - protein, 9 aa, Artificial Sequence
  source: /note="Description of Artificial Sequence: Synthetic peptide"
YLSWGTVSP

SEQ ID NO: 24492 - protein, 9 aa, Artificial Sequence
  source: /note="Description of Artificial Sequence: Synthetic peptide"
TVSPYSAMA

SEQ ID NO: 24493 - protein, 9 aa, Artificial Sequence
  source: /note="Description of Artificial Sequence: Synthetic peptide"
GTVSPYSAM

SEQ ID NO: 24494 - protein, 9 aa, Artificial Sequence
  source: /note="Description of Artificial Sequence: Synthetic peptide"
TDYLSWGTV

SEQ ID NO: 24495 - protein, 10 aa, Artificial Sequence
  source: /note="Description of Artificial Sequence: Synthetic peptide"
PTDYLSWGTV

SEQ ID NO: 24496 - protein, 10 aa, Artificial Sequence
  source: /note="Description of Artificial Sequence: Synthetic peptide"
YLSWGTVSPY

SEQ ID NO: 24497 - protein, 10 aa, Artificial Sequence
  source: /note="Description of Artificial Sequence: Synthetic peptide"
VSPYSAMATY

SEQ ID NO: 24498 - protein, 10 aa, Artificial Sequence
  source: /note="Description of Artificial Sequence: Synthetic peptide"
WGTVSPYSAM

SEQ ID NO: 24499 - protein, 9 aa, Artificial Sequence
  source: /note="Description of Artificial Sequence: Synthetic peptide"
TLNNNIMLI

SEQ ID NO: 24500 - protein, 9 aa, Artificial Sequence
  source: /note="Description of Artificial Sequence: Synthetic peptide"
KTLNNNIML

SEQ ID NO: 24501 - protein, 9 aa, Artificial Sequence
  source: /note="Description of Artificial Sequence: Synthetic peptide"
RKTLNNNIM

SEQ ID NO: 24502 - protein, 10 aa, Artificial Sequence
  source: /note="Description of Artificial Sequence: Synthetic peptide"
KTLNNNIMLI

SEQ ID NO: 24503 - protein, 10 aa, Artificial Sequence
  source: /note="Description of Artificial Sequence: Synthetic peptide"
TLNNNIMLIK

SEQ ID NO: 24504 - protein, 10 aa, Artificial Sequence
  source: /note="Description of Artificial Sequence: Synthetic peptide"
NIMLIKLSSR

SEQ ID NO: 24505 - protein, 10 aa, Artificial Sequence
  source: /note="Description of Artificial Sequence: Synthetic peptide"
RKTLNNNIML

SEQ ID NO: 24506 - protein, 9 aa, Artificial Sequence
  source: /note="Description of Artificial Sequence: Synthetic peptide"
GLRPPWPSW

SEQ ID NO: 24507 - protein, 9 aa, Artificial Sequence
  source: /note="Description of Artificial Sequence: Synthetic peptide"
QHLGLRPPW

SEQ ID NO: 24508 - protein, 10 aa, Artificial Sequence
  source: /note="Description of Artificial Sequence: Synthetic peptide"
PQHLGLRPPW

SEQ ID NO: 24509 - protein, 10 aa, Artificial Sequence
  source: /note="Description of Artificial Sequence: Synthetic peptide"
LGLRPPWPSW

SEQ ID NO: 24510 - protein, 9 aa, Artificial Sequence
  source: /note="Description of Artificial Sequence: Synthetic peptide"
AQIIGGHQV

SEQ ID NO: 24511 - protein, 9 aa, Artificial Sequence
  source: /note="Description of Artificial Sequence: Synthetic peptide"
QVTPHSRPY

SEQ ID NO: 24512 - protein, 10 aa, Artificial Sequence
  source: /note="Description of Artificial Sequence: Synthetic peptide"
HQVTPHSRPY

SEQ ID NO: 24513 - protein, 10 aa, Artificial Sequence
  source: /note="Description of Artificial Sequence: Synthetic peptide"
AQIIGGHQVT

SEQ ID NO: 24514 - protein, 9 aa, Artificial Sequence
  source: /note="Description of Artificial Sequence: Synthetic peptide"
GGMRMMMRR

SEQ ID NO: 24515 - protein, 9 aa, Artificial Sequence
  source: /note="Description of Artificial Sequence: Synthetic peptide"
GMRMMMRRT

SEQ ID NO: 24516 - protein, 9 aa, Artificial Sequence
  source: /note="Description of Artificial Sequence: Synthetic peptide"
RMMMRRTRT

SEQ ID NO: 24517 - protein, 9 aa, Artificial Sequence
  source: /note="Description of Artificial Sequence: Synthetic peptide"
MMMRRTRTS

SEQ ID NO: 24518 - protein, 9 aa, Artificial Sequence
  source: /note="Description of Artificial Sequence: Synthetic peptide"
MMRRTRTSC

SEQ ID NO: 24519 - protein, 9 aa, Artificial Sequence
  source: /note="Description of Artificial Sequence: Synthetic peptide"
GPGGMRMMM

SEQ ID NO: 24520 - protein, 9 aa, Artificial Sequence
  source: /note="Description of Artificial Sequence: Synthetic peptide"
PQGPGGMRM

SEQ ID NO: 24521 - protein, 10 aa, Artificial Sequence
  source: /note="Description of Artificial Sequence: Synthetic peptide"
MMMRRTRTSC

SEQ ID NO: 24522 - protein, 10 aa, Artificial Sequence
  source: /note="Description of Artificial Sequence: Synthetic peptide"
GMRMMMRRTR

SEQ ID NO: 24523 - protein, 10 aa, Artificial Sequence
  source: /note="Description of Artificial Sequence: Synthetic peptide"
RMMMRRTRTS

SEQ ID NO: 24524 - protein, 10 aa, Artificial Sequence
  source: /note="Description of Artificial Sequence: Synthetic peptide"
GPQGPGGMRM

SEQ ID NO: 24525 - protein, 10 aa, Artificial Sequence
  source: /note="Description of Artificial Sequence: Synthetic peptide"
PQGPGGMRMM

SEQ ID NO: 24526 - protein, 9 aa, Artificial Sequence
  source: /note="Description of Artificial Sequence: Synthetic peptide"
MGSPEILEK

SEQ ID NO: 24527 - protein, 9 aa, Artificial Sequence
  source: /note="Description of Artificial Sequence: Synthetic peptide"
SEMGSPEIL

SEQ ID NO: 24528 - protein, 10 aa, Artificial Sequence
  source: /note="Description of Artificial Sequence: Synthetic peptide"
EMGSPEILEK

SEQ ID NO: 24529 - protein, 10 aa, Artificial Sequence
  source: /note="Description of Artificial Sequence: Synthetic peptide"
AHSEMGSPEI

SEQ ID NO: 24530 - protein, 9 aa, Artificial Sequence
  source: /note="Description of Artificial Sequence: Synthetic peptide"
SVCNSATGK

SEQ ID NO: 24531 - protein, 10 aa, Artificial Sequence
  source: /note="Description of Artificial Sequence: Synthetic peptide"
GLYACSVCNS

SEQ ID NO: 24532 - protein, 10 aa, Artificial Sequence
  source: /note="Description of Artificial Sequence: Synthetic peptide"
CSVCNSATGK

SEQ ID NO: 24533 - protein, 9 aa, Artificial Sequence
  source: /note="Description of Artificial Sequence: Synthetic peptide"
DQYGGICSY

SEQ ID NO: 24534 - protein, 9 aa, Artificial Sequence
  source: /note="Description of Artificial Sequence: Synthetic peptide"
CSYPVTLNV

SEQ ID NO: 24535 - protein, 10 aa, Artificial Sequence
  source: /note="Description of Artificial Sequence: Synthetic peptide"
QYGGICSYPV

SEQ ID NO: 24536 - protein, 10 aa, Artificial Sequence
  source: /note="Description of Artificial Sequence: Synthetic peptide"
RDQYGGICSY

SEQ ID NO: 24537 - protein, 10 aa, Artificial Sequence
  source: /note="Description of Artificial Sequence: Synthetic peptide"
GGICSYPVTL

SEQ ID NO: 24538 - protein, 10 aa, Artificial Sequence
  source: /note="Description of Artificial Sequence: Synthetic peptide"
CSYPVTLNVL

SEQ ID NO: 24539 - protein, 9 aa, Artificial Sequence
  source: /note="Description of Artificial Sequence: Synthetic peptide"
KISKSMTVK

SEQ ID NO: 24540 - protein, 9 aa, Artificial Sequence
  source: /note="Description of Artificial Sequence: Synthetic peptide"
SATGKKISK

SEQ ID NO: 24541 - protein, 9 aa, Artificial Sequence
  source: /note="Description of Artificial Sequence: Synthetic peptide"
KKISKSMTV

SEQ ID NO: 24542 - protein, 10 aa, Artificial Sequence
  source: /note="Description of Artificial Sequence: Synthetic peptide"
KISKSMTVKV

SEQ ID NO: 24543 - protein, 10 aa, Artificial Sequence
  source: /note="Description of Artificial Sequence: Synthetic peptide"
SVHNSATGKK

SEQ ID NO: 24544 - protein, 9 aa, Artificial Sequence
  source: /note="Description of Artificial Sequence: Synthetic peptide"
MAAAVVVEF

SEQ ID NO: 24545 - protein, 10 aa, Artificial Sequence
  source: /note="Description of Artificial Sequence: Synthetic peptide"
AAAVVVEFQR

SEQ ID NO: 24546 - protein, 9 aa, Artificial Sequence
  source: /note="Description of Artificial Sequence: Synthetic peptide"
YIQTQIISK

SEQ ID NO: 24547 - protein, 9 aa, Artificial Sequence
  source: /note="Description of Artificial Sequence: Synthetic peptide"
IQTQIISKK

SEQ ID NO: 24548 - protein, 9 aa, Artificial Sequence
  source: /note="Description of Artificial Sequence: Synthetic peptide"
KDYIQTQII

SEQ ID NO: 24549 - protein, 10 aa, Artificial Sequence
  source: /note="Description of Artificial Sequence: Synthetic peptide"
AVKDYIQTQI

SEQ ID NO: 24550 - protein, 10 aa, Artificial Sequence
  source: /note="Description of Artificial Sequence: Synthetic peptide"
YIQTQIISKK

SEQ ID NO: 24551 - protein, 10 aa, Artificial Sequence
  source: /note="Description of Artificial Sequence: Synthetic peptide"
IQTQIISKKI

SEQ ID NO: 24552 - protein, 9 aa, Artificial Sequence
  source: /note="Description of Artificial Sequence: Synthetic peptide"
SLWLIISEL

SEQ ID NO: 24553 - protein, 9 aa, Artificial Sequence
  source: /note="Description of Artificial Sequence: Synthetic peptide"
KEYISLWLI

SEQ ID NO: 24554 - protein, 9 aa, Artificial Sequence
  source: /note="Description of Artificial Sequence: Synthetic peptide"
EYISLWLII

SEQ ID NO: 24555 - protein, 9 aa, Artificial Sequence
  source: /note="Description of Artificial Sequence: Synthetic peptide"
DEKEYISLW

SEQ ID NO: 24556 - protein, 10 aa, Artificial Sequence
  source: /note="Description of Artificial Sequence: Synthetic peptide"
SLWLIISELR

SEQ ID NO: 24557 - protein, 10 aa, Artificial Sequence
  source: /note="Description of Artificial Sequence: Synthetic peptide"
KEYISLWLII

SEQ ID NO: 24558 - protein, 10 aa, Artificial Sequence
  source: /note="Description of Artificial Sequence: Synthetic peptide"
ISLWLIISEL

SEQ ID NO: 24559 - protein, 10 aa, Artificial Sequence
  source: /note="Description of Artificial Sequence: Synthetic peptide"
DEKEYISLWL

SEQ ID NO: 24560 - protein, 9 aa, Artificial Sequence
  source: /note="Description of Artificial Sequence: Synthetic peptide"
GVDPDDFSK

SEQ ID NO: 24561 - protein, 9 aa, Artificial Sequence
  source: /note="Description of Artificial Sequence: Synthetic peptide"
LPGVDPDDF

SEQ ID NO: 24562 - protein, 10 aa, Artificial Sequence
  source: /note="Description of Artificial Sequence: Synthetic peptide"
DDFSKCMITF

SEQ ID NO: 24563 - protein, 10 aa, Artificial Sequence
  source: /note="Description of Artificial Sequence: Synthetic peptide"
DPDDFSKCMI

SEQ ID NO: 24564 - protein, 9 aa, Artificial Sequence
  source: /note="Description of Artificial Sequence: Synthetic peptide"
SIIEHVASK

SEQ ID NO: 24565 - protein, 9 aa, Artificial Sequence
  source: /note="Description of Artificial Sequence: Synthetic peptide"
ISGGFRSII

SEQ ID NO: 24566 - protein, 10 aa, Artificial Sequence
  source: /note="Description of Artificial Sequence: Synthetic peptide"
SIIEHVASKL

SEQ ID NO: 24567 - protein, 10 aa, Artificial Sequence
  source: /note="Description of Artificial Sequence: Synthetic peptide"
LISGGFRSII

SEQ ID NO: 24568 - protein, 10 aa, Artificial Sequence
  source: /note="Description of Artificial Sequence: Synthetic peptide"
RSIIEHVASK

SEQ ID NO: 24569 - protein, 10 aa, Artificial Sequence
  source: /note="Description of Artificial Sequence: Synthetic peptide"
GFRSIIEHVA

SEQ ID NO: 24570 - protein, 10 aa, Artificial Sequence
  source: /note="Description of Artificial Sequence: Synthetic peptide"
IEHVASKLNI

SEQ ID NO: 24571 - protein, 9 aa, Artificial Sequence
  source: /note="Description of Artificial Sequence: Synthetic peptide"
EISVQHVTV

SEQ ID NO: 24572 - protein, 9 aa, Artificial Sequence
  source: /note="Description of Artificial Sequence: Synthetic peptide"
SEISVQHVT

SEQ ID NO: 24573 - protein, 10 aa, Artificial Sequence
  source: /note="Description of Artificial Sequence: Synthetic peptide"
SEISVQHVTV

SEQ ID NO: 24574 - protein, 10 aa, Artificial Sequence
  source: /note="Description of Artificial Sequence: Synthetic peptide"
VQHVTVTQDT

SEQ ID NO: 24575 - protein, 9 aa, Artificial Sequence
  source: /note="Description of Artificial Sequence: Synthetic peptide"
FLLKGILAL

SEQ ID NO: 24576 - protein, 9 aa, Artificial Sequence
  source: /note="Description of Artificial Sequence: Synthetic peptide"
LLKGILALA

SEQ ID NO: 24577 - protein, 9 aa, Artificial Sequence
  source: /note="Description of Artificial Sequence: Synthetic peptide"
ILALAIGPA

SEQ ID NO: 24578 - protein, 9 aa, Artificial Sequence
  source: /note="Description of Artificial Sequence: Synthetic peptide"
ALAIGPAGA

SEQ ID NO: 24579 - protein, 9 aa, Artificial Sequence
  source: /note="Description of Artificial Sequence: Synthetic peptide"
LLKFLLKGI

SEQ ID NO: 24580 - protein, 9 aa, Artificial Sequence
  source: /note="Description of Artificial Sequence: Synthetic peptide"
AIGPAGALA

SEQ ID NO: 24581 - protein, 9 aa, Artificial Sequence
  source: /note="Description of Artificial Sequence: Synthetic peptide"
ALAGPVLTT

SEQ ID NO: 24582 - protein, 9 aa, Artificial Sequence
  source: /note="Description of Artificial Sequence: Synthetic peptide"
ETLLKFLLK

SEQ ID NO: 24583 - protein, 9 aa, Artificial Sequence
  source: /note="Description of Artificial Sequence: Synthetic peptide"
KFLLKGILA

SEQ ID NO: 24584 - protein, 9 aa, Artificial Sequence
  source: /note="Description of Artificial Sequence: Synthetic peptide"
TQRPLPWAA

SEQ ID NO: 24585 - protein, 9 aa, Artificial Sequence
  source: /note="Description of Artificial Sequence: Synthetic peptide"
WAAPCPATA

SEQ ID NO: 24586 - protein, 9 aa, Artificial Sequence
  source: /note="Description of Artificial Sequence: Synthetic peptide"
LAIGPAGAL

SEQ ID NO: 24587 - protein, 9 aa, Artificial Sequence
  source: /note="Description of Artificial Sequence: Synthetic peptide"
RPLPWAAPC

SEQ ID NO: 24588 - protein, 9 aa, Artificial Sequence
  source: /note="Description of Artificial Sequence: Synthetic peptide"
LPWAAPCPA

SEQ ID NO: 24589 - protein, 9 aa, Artificial Sequence
  source: /note="Description of Artificial Sequence: Synthetic peptide"
LKFLLKGIL

SEQ ID NO: 24590 - protein, 9 aa, Artificial Sequence
  source: /note="Description of Artificial Sequence: Synthetic peptide"
LKGILALAI

SEQ ID NO: 24591 - protein, 9 aa, Artificial Sequence
  source: /note="Description of Artificial Sequence: Synthetic peptide"
AGALAGPVL

SEQ ID NO: 24592 - protein, 9 aa, Artificial Sequence
  source: /note="Description of Artificial Sequence: Synthetic peptide"
LAGPVLTTL

SEQ ID NO: 24593 - protein, 9 aa, Artificial Sequence
  source: /note="Description of Artificial Sequence: Synthetic peptide"
LGTQRPLPW

SEQ ID NO: 24594 - protein, 9 aa, Artificial Sequence
  source: /note="Description of Artificial Sequence: Synthetic peptide"
AETLLKFLL

SEQ ID NO: 24595 - protein, 10 aa, Artificial Sequence
  source: /note="Description of Artificial Sequence: Synthetic peptide"
TLLKFLLKGI

SEQ ID NO: 24596 - protein, 10 aa, Artificial Sequence
  source: /note="Description of Artificial Sequence: Synthetic peptide"
FLLKGILALA

SEQ ID NO: 24597 - protein, 10 aa, Artificial Sequence
  source: /note="Description of Artificial Sequence: Synthetic peptide"
LLKGILALAI

SEQ ID NO: 24598 - protein, 10 aa, Artificial Sequence
  source: /note="Description of Artificial Sequence: Synthetic peptide"
ALAIGPAGAL

SEQ ID NO: 24599 - protein, 10 aa, Artificial Sequence
  source: /note="Description of Artificial Sequence: Synthetic peptide"
ALAGPVLTTL

SEQ ID NO: 24600 - protein, 10 aa, Artificial Sequence
  source: /note="Description of Artificial Sequence: Synthetic peptide"
KFLLKGILAL

SEQ ID NO: 24601 - protein, 10 aa, Artificial Sequence
  source: /note="Description of Artificial Sequence: Synthetic peptide"
HPPTDRAETL

SEQ ID NO: 24602 - protein, 10 aa, Artificial Sequence
  source: /note="Description of Artificial Sequence: Synthetic peptide"
GPAGALAGPV

SEQ ID NO: 24603 - protein, 10 aa, Artificial Sequence
  source: /note="Description of Artificial Sequence: Synthetic peptide"
CPATASPSPL

SEQ ID NO: 24604 - protein, 10 aa, Artificial Sequence
  source: /note="Description of Artificial Sequence: Synthetic peptide"
LLKFLLKGIL

SEQ ID NO: 24605 - protein, 10 aa, Artificial Sequence
  source: /note="Description of Artificial Sequence: Synthetic peptide"
TDRAETLLKF

SEQ ID NO: 24606 - protein, 10 aa, Artificial Sequence
  source: /note="Description of Artificial Sequence: Synthetic peptide"
LKFLLKGILA

SEQ ID NO: 24607 - protein, 10 aa, Artificial Sequence
  source: /note="Description of Artificial Sequence: Synthetic peptide"
TQRPLPWAAP

SEQ ID NO: 24608 - protein, 10 aa, Artificial Sequence
  source: /note="Description of Artificial Sequence: Synthetic peptide"
LPWAAPCPAT

SEQ ID NO: 24609 - protein, 9 aa, Artificial Sequence
  source: /note="Description of Artificial Sequence: Synthetic peptide"
SLFLETILA

SEQ ID NO: 24610 - protein, 9 aa, Artificial Sequence
  source: /note="Description of Artificial Sequence: Synthetic peptide"
FLETILAPF

SEQ ID NO: 24611 - protein, 9 aa, Artificial Sequence
  source: /note="Description of Artificial Sequence: Synthetic peptide"
ILAPFSQGV

SEQ ID NO: 24612 - protein, 9 aa, Artificial Sequence
  source: /note="Description of Artificial Sequence: Synthetic peptide"
DIHPISLFL

SEQ ID NO: 24613 - protein, 9 aa, Artificial Sequence
  source: /note="Description of Artificial Sequence: Synthetic peptide"
ISLFLETIL

SEQ ID NO: 24614 - protein, 9 aa, Artificial Sequence
  source: /note="Description of Artificial Sequence: Synthetic peptide"
FSQGVSPSI

SEQ ID NO: 24615 - protein, 9 aa, Artificial Sequence
  source: /note="Description of Artificial Sequence: Synthetic peptide"
SQGVSPSIL

SEQ ID NO: 24616 - protein, 9 aa, Artificial Sequence
  source: /note="Description of Artificial Sequence: Synthetic peptide"
HPISLFLET

SEQ ID NO: 24617 - protein, 9 aa, Artificial Sequence
  source: /note="Description of Artificial Sequence: Synthetic peptide"
LETILAPFS

SEQ ID NO: 24618 - protein, 10 aa, Artificial Sequence
  source: /note="Description of Artificial Sequence: Synthetic peptide"
TILAPFSQGV

SEQ ID NO: 24619 - protein, 10 aa, Artificial Sequence
  source: /note="Description of Artificial Sequence: Synthetic peptide"
LFLETILAPF

SEQ ID NO: 24620 - protein, 10 aa, Artificial Sequence
  source: /note="Description of Artificial Sequence: Synthetic peptide"
HPISLFLETI

SEQ ID NO: 24621 - protein, 10 aa, Artificial Sequence
  source: /note="Description of Artificial Sequence: Synthetic peptide"
FSQGVSPSIL

SEQ ID NO: 24622 - protein, 9 aa, Artificial Sequence
  source: /note="Description of Artificial Sequence: Synthetic peptide"
GTGVMICAY

SEQ ID NO: 24623 - protein, 10 aa, Artificial Sequence
  source: /note="Description of Artificial Sequence: Synthetic peptide"
GGTGVMICAY

SEQ ID NO: 24624 - protein, 10 aa, Artificial Sequence
  source: /note="Description of Artificial Sequence: Synthetic peptide"
KAGKGGTGVM

SEQ ID NO: 24625 - protein, 9 aa, Artificial Sequence
  source: /note="Description of Artificial Sequence: Synthetic peptide"
QTGVMICAY

SEQ ID NO: 24626 - protein, 9 aa, Artificial Sequence
  source: /note="Description of Artificial Sequence: Synthetic peptide"
GKGQTGVMI

SEQ ID NO: 24627 - protein, 10 aa, Artificial Sequence
  source: /note="Description of Artificial Sequence: Synthetic peptide"
GQTGVMICAY

SEQ ID NO: 24628 - protein, 10 aa, Artificial Sequence
  source: /note="Description of Artificial Sequence: Synthetic peptide"
KAGKGQTGVM

SEQ ID NO: 24629 - protein, 9 aa, Artificial Sequence
  source: /note="Description of Artificial Sequence: Synthetic peptide"
PTGVMICAY

SEQ ID NO: 24630 - protein, 9 aa, Artificial Sequence
  source: /note="Description of Artificial Sequence: Synthetic peptide"
GKGPTGVMI

SEQ ID NO: 24631 - protein, 10 aa, Artificial Sequence
  source: /note="Description of Artificial Sequence: Synthetic peptide"
GPTGVMICAY

SEQ ID NO: 24632 - protein, 10 aa, Artificial Sequence
  source: /note="Description of Artificial Sequence: Synthetic peptide"
KAGKGPTGVM

SEQ ID NO: 24633 - protein, 9 aa, Artificial Sequence
  source: /note="Description of Artificial Sequence: Synthetic peptide"
LTGVMICAY

SEQ ID NO: 24634 - protein, 9 aa, Artificial Sequence
  source: /note="Description of Artificial Sequence: Synthetic peptide"
GLTGVMICA

SEQ ID NO: 24635 - protein, 9 aa, Artificial Sequence
  source: /note="Description of Artificial Sequence: Synthetic peptide"
KAGKGLTGV

SEQ ID NO: 24636 - protein, 9 aa, Artificial Sequence
  source: /note="Description of Artificial Sequence: Synthetic peptide"
GKGLTGVMI

SEQ ID NO: 24637 - protein, 10 aa, Artificial Sequence
  source: /note="Description of Artificial Sequence: Synthetic peptide"
GLTGVMICAY

SEQ ID NO: 24638 - protein, 10 aa, Artificial Sequence
  source: /note="Description of Artificial Sequence: Synthetic peptide"
KAGKGLTGVM

SEQ ID NO: 24639 - protein, 9 aa, Artificial Sequence
  source: /note="Description of Artificial Sequence: Synthetic peptide"
GVMIYAYLL

SEQ ID NO: 24640 - protein, 9 aa, Artificial Sequence
  source: /note="Description of Artificial Sequence: Synthetic peptide"
VMIYAYLLH

SEQ ID NO: 24641 - protein, 9 aa, Artificial Sequence
  source: /note="Description of Artificial Sequence: Synthetic peptide"
RTGVMIYAY

SEQ ID NO: 24642 - protein, 9 aa, Artificial Sequence
  source: /note="Description of Artificial Sequence: Synthetic peptide"
KGRTGVMIY

SEQ ID NO: 24643 - protein, 10 aa, Artificial Sequence
  source: /note="Description of Artificial Sequence: Synthetic peptide"
VMIYAYLLHR

SEQ ID NO: 24644 - protein, 10 aa, Artificial Sequence
  source: /note="Description of Artificial Sequence: Synthetic peptide"
GVMIYAYLLH

SEQ ID NO: 24645 - protein, 10 aa, Artificial Sequence
  source: /note="Description of Artificial Sequence: Synthetic peptide"
KGRTGVMIYA

SEQ ID NO: 24646 - protein, 10 aa, Artificial Sequence
  source: /note="Description of Artificial Sequence: Synthetic peptide"
RTGVMIYAYL

SEQ ID NO: 24647 - protein, 10 aa, Artificial Sequence
  source: /note="Description of Artificial Sequence: Synthetic peptide"
GKGRTGVMIY

SEQ ID NO: 24648 - protein, 10 aa, Artificial Sequence
  source: /note="Description of Artificial Sequence: Synthetic peptide"
GRTGVMIYAY

SEQ ID NO: 24649 - protein, 9 aa, Artificial Sequence
  source: /note="Description of Artificial Sequence: Synthetic peptide"
VTIPNQRRY

SEQ ID NO: 24650 - protein, 9 aa, Artificial Sequence
  source: /note="Description of Artificial Sequence: Synthetic peptide"
NQRRYVYYY

SEQ ID NO: 24651 - protein, 9 aa, Artificial Sequence
  source: /note="Description of Artificial Sequence: Synthetic peptide"
IPNQRRYVY

SEQ ID NO: 24652 - protein, 10 aa, Artificial Sequence
  source: /note="Description of Artificial Sequence: Synthetic peptide"
GVTIPNQRRY

SEQ ID NO: 24653 - protein, 10 aa, Artificial Sequence
  source: /note="Description of Artificial Sequence: Synthetic peptide"
TIPNQRRYVY

SEQ ID NO: 24654 - protein, 10 aa, Artificial Sequence
  source: /note="Description of Artificial Sequence: Synthetic peptide"
VTIPNQRRYV

SEQ ID NO: 24655 - protein, 10 aa, Artificial Sequence
  source: /note="Description of Artificial Sequence: Synthetic peptide"
IPNQRRYVYY

SEQ ID NO: 24656 - protein, 9 aa, Artificial Sequence
  source: /note="Description of Artificial Sequence: Synthetic peptide"
TIPSQRHYV

SEQ ID NO: 24657 - protein, 9 aa, Artificial Sequence
  source: /note="Description of Artificial Sequence: Synthetic peptide"
HYVYYYSYL

SEQ ID NO: 24658 - protein, 9 aa, Artificial Sequence
  source: /note="Description of Artificial Sequence: Synthetic peptide"
SQRHYVYYY

SEQ ID NO: 24659 - protein, 9 aa, Artificial Sequence
  source: /note="Description of Artificial Sequence: Synthetic peptide"
RHYVYYYSY

SEQ ID NO: 24660 - protein, 9 aa, Artificial Sequence
  source: /note="Description of Artificial Sequence: Synthetic peptide"
VTIPSQRHY

SEQ ID NO: 24661 - protein, 9 aa, Artificial Sequence
  source: /note="Description of Artificial Sequence: Synthetic peptide"
IPSQRHYVY

SEQ ID NO: 24662 - protein, 9 aa, Artificial Sequence
  source: /note="Description of Artificial Sequence: Synthetic peptide"
PSQRHYVYY

SEQ ID NO: 24663 - protein, 10 aa, Artificial Sequence
  source: /note="Description of Artificial Sequence: Synthetic peptide"
PSQRHYVYYY

SEQ ID NO: 24664 - protein, 10 aa, Artificial Sequence
  source: /note="Description of Artificial Sequence: Synthetic peptide"
VTIPSQRHYV

SEQ ID NO: 24665 - protein, 10 aa, Artificial Sequence
  source: /note="Description of Artificial Sequence: Synthetic peptide"
RHYVYYYSYL

SEQ ID NO: 24666 - protein, 10 aa, Artificial Sequence
  source: /note="Description of Artificial Sequence: Synthetic peptide"
HYVYYYSYLL

SEQ ID NO: 24667 - protein, 10 aa, Artificial Sequence
  source: /note="Description of Artificial Sequence: Synthetic peptide"
SQRHYVYYYS

SEQ ID NO: 24668 - protein, 10 aa, Artificial Sequence
  source: /note="Description of Artificial Sequence: Synthetic peptide"
GVTIPSQRHY

SEQ ID NO: 24669 - protein, 10 aa, Artificial Sequence
  source: /note="Description of Artificial Sequence: Synthetic peptide"
TIPSQRHYVY

SEQ ID NO: 24670 - protein, 10 aa, Artificial Sequence
  source: /note="Description of Artificial Sequence: Synthetic peptide"
QRHYVYYYSY

SEQ ID NO: 24671 - protein, 10 aa, Artificial Sequence
  source: /note="Description of Artificial Sequence: Synthetic peptide"
IPSQRHYVYY

SEQ ID NO: 24672 - protein, 9 aa, Artificial Sequence
  source: /note="Description of Artificial Sequence: Synthetic peptide"
RLEDKFMYF

SEQ ID NO: 24673 - protein, 10 aa, Artificial Sequence
  source: /note="Description of Artificial Sequence: Synthetic peptide"
YSSNSGPTRL

SEQ ID NO: 24674 - protein, 10 aa, Artificial Sequence
  source: /note="Description of Artificial Sequence: Synthetic peptide"
TRLEDKFMYF

SEQ ID NO: 24675 - protein, 10 aa, Artificial Sequence
  source: /note="Description of Artificial Sequence: Synthetic peptide"
LEDKFMYFEF

SEQ ID NO: 24676 - protein, 9 aa, Artificial Sequence
  source: /note="Description of Artificial Sequence: Synthetic peptide"
KMLKRTKCF

SEQ ID NO: 24677 - protein, 9 aa, Artificial Sequence
  source: /note="Description of Artificial Sequence: Synthetic peptide"
MLKRTKCFT

SEQ ID NO: 24678 - protein, 9 aa, Artificial Sequence
  source: /note="Description of Artificial Sequence: Synthetic peptide"
LKRTKCFTF

SEQ ID NO: 24679 - protein, 10 aa, Artificial Sequence
  source: /note="Description of Artificial Sequence: Synthetic peptide"
MLKRTKCFTF

SEQ ID NO: 24680 - protein, 10 aa, Artificial Sequence
  source: /note="Description of Artificial Sequence: Synthetic peptide"
KQNKMLKRTK

SEQ ID NO: 24681 - protein, 10 aa, Artificial Sequence
  source: /note="Description of Artificial Sequence: Synthetic peptide"
KMLKRTKCFT

SEQ ID NO: 24682 - protein, 10 aa, Artificial Sequence
  source: /note="Description of Artificial Sequence: Synthetic peptide"
NKMLKRTKCF

SEQ ID NO: 24683 - protein, 9 aa, Artificial Sequence
  source: /note="Description of Artificial Sequence: Synthetic peptide"
KMFHFWVNI

SEQ ID NO: 24684 - protein, 9 aa, Artificial Sequence
  source: /note="Description of Artificial Sequence: Synthetic peptide"
MFHFWVNIF

SEQ ID NO: 24685 - protein, 9 aa, Artificial Sequence
  source: /note="Description of Artificial Sequence: Synthetic peptide"
FHFWVNIFF

SEQ ID NO: 24686 - protein, 9 aa, Artificial Sequence
  source: /note="Description of Artificial Sequence: Synthetic peptide"
HFWVNIFFI

SEQ ID NO: 24687 - protein, 10 aa, Artificial Sequence
  source: /note="Description of Artificial Sequence: Synthetic peptide"
KMFHFWVNIF

SEQ ID NO: 24688 - protein, 10 aa, Artificial Sequence
  source: /note="Description of Artificial Sequence: Synthetic peptide"
MFHFWVNIFF

SEQ ID NO: 24689 - protein, 10 aa, Artificial Sequence
  source: /note="Description of Artificial Sequence: Synthetic peptide"
FHFWVNIFFI

SEQ ID NO: 24690 - protein, 9 aa, Artificial Sequence
  source: /note="Description of Artificial Sequence: Synthetic peptide"
VLLAALFLT

SEQ ID NO: 24691 - protein, 9 aa, Artificial Sequence
  source: /note="Description of Artificial Sequence: Synthetic peptide"
LLAALFLTV

SEQ ID NO: 24692 - protein, 9 aa, Artificial Sequence
  source: /note="Description of Artificial Sequence: Synthetic peptide"
EVLLAALFL

SEQ ID NO: 24693 - protein, 9 aa, Artificial Sequence
  source: /note="Description of Artificial Sequence: Synthetic peptide"
GEVLLAALF

SEQ ID NO: 24694 - protein, 10 aa, Artificial Sequence
  source: /note="Description of Artificial Sequence: Synthetic peptide"
VLLAALFLTV

SEQ ID NO: 24695 - protein, 10 aa, Artificial Sequence
  source: /note="Description of Artificial Sequence: Synthetic peptide"
AALFLTVDPY

SEQ ID NO: 24696 - protein, 10 aa, Artificial Sequence
  source: /note="Description of Artificial Sequence: Synthetic peptide"
LKNGEVLLAA

SEQ ID NO: 24697 - protein, 10 aa, Artificial Sequence
  source: /note="Description of Artificial Sequence: Synthetic peptide"
GEVLLAALFL

SEQ ID NO: 24698 - protein, 9 aa, Artificial Sequence
  source: /note="Description of Artificial Sequence: Synthetic peptide"
LLLLLLVVV

SEQ ID NO: 24699 - protein, 9 aa, Artificial Sequence
  source: /note="Description of Artificial Sequence: Synthetic peptide"
LLVVVPWGV

SEQ ID NO: 24700 - protein, 9 aa, Artificial Sequence
  source: /note="Description of Artificial Sequence: Synthetic peptide"
LVVVPWGVR

SEQ ID NO: 24701 - protein, 9 aa, Artificial Sequence
  source: /note="Description of Artificial Sequence: Synthetic peptide"
LLLLVVVPW

SEQ ID NO: 24702 - protein, 10 aa, Artificial Sequence
  source: /note="Description of Artificial Sequence: Synthetic peptide"
RLLLLLLLLV

SEQ ID NO: 24703 - protein, 10 aa, Artificial Sequence
  source: /note="Description of Artificial Sequence: Synthetic peptide"
LLLLLLLVVV

SEQ ID NO: 24704 - protein, 10 aa, Artificial Sequence
  source: /note="Description of Artificial Sequence: Synthetic peptide"
LLLVVVPWGV

SEQ ID NO: 24705 - protein, 10 aa, Artificial Sequence
  source: /note="Description of Artificial Sequence: Synthetic peptide"
LLVVVPWGVR

SEQ ID NO: 24706 - protein, 10 aa, Artificial Sequence
  source: /note="Description of Artificial Sequence: Synthetic peptide"
LLLLLVVVPW

SEQ ID NO: 24707 - protein, 9 aa, Artificial Sequence
  source: /note="Description of Artificial Sequence: Synthetic peptide"
WKRWNVECL

SEQ ID NO: 24708 - protein, 9 aa, Artificial Sequence
  source: /note="Description of Artificial Sequence: Synthetic peptide"
WNVECLQPL

SEQ ID NO: 24709 - protein, 10 aa, Artificial Sequence
  source: /note="Description of Artificial Sequence: Synthetic peptide"
LWKRWNVECL

SEQ ID NO: 24710 - protein, 10 aa, Artificial Sequence
  source: /note="Description of Artificial Sequence: Synthetic peptide"
RWNVECLQPL

SEQ ID NO: 24711 - protein, 10 aa, Artificial Sequence
  source: /note="Description of Artificial Sequence: Synthetic peptide"
QQFDPLWKRW

SEQ ID NO: 24712 - protein, 9 aa, Artificial Sequence
  source: /note="Description of Artificial Sequence: Synthetic peptide"
QMVRSQRSV

SEQ ID NO: 24713 - protein, 9 aa, Artificial Sequence
  source: /note="Description of Artificial Sequence: Synthetic peptide"
MVRSQRSVM

SEQ ID NO: 24714 - protein, 9 aa, Artificial Sequence
  source: /note="Description of Artificial Sequence: Synthetic peptide"
RSVMVQTEA

SEQ ID NO: 24715 - protein, 9 aa, Artificial Sequence
  source: /note="Description of Artificial Sequence: Synthetic peptide"
VMVQTEAQY

SEQ ID NO: 24716 - protein, 9 aa, Artificial Sequence
  source: /note="Description of Artificial Sequence: Synthetic peptide"
SQRSVMVQT

SEQ ID NO: 24717 - protein, 10 aa, Artificial Sequence
  source: /note="Description of Artificial Sequence: Synthetic peptide"
IQMVRSQRSV

SEQ ID NO: 24718 - protein, 10 aa, Artificial Sequence
  source: /note="Description of Artificial Sequence: Synthetic peptide"
SVMVQTEAQY

SEQ ID NO: 24719 - protein, 10 aa, Artificial Sequence
  source: /note="Description of Artificial Sequence: Synthetic peptide"
MVRSQRSVMV

SEQ ID NO: 24720 - protein, 10 aa, Artificial Sequence
  source: /note="Description of Artificial Sequence: Synthetic peptide"
QMVRSQRSVM

SEQ ID NO: 24721 - protein, 9 aa, Artificial Sequence
  source: /note="Description of Artificial Sequence: Synthetic peptide"
KLVQYYMEH

SEQ ID NO: 24722 - protein, 9 aa, Artificial Sequence
  source: /note="Description of Artificial Sequence: Synthetic peptide"
ATLAKLVQY

SEQ ID NO: 24723 - protein, 9 aa, Artificial Sequence
  source: /note="Description of Artificial Sequence: Synthetic peptide"
LAKLVQYYM

SEQ ID NO: 24724 - protein, 9 aa, Artificial Sequence
  source: /note="Description of Artificial Sequence: Synthetic peptide"
TLAKLVQYY

SEQ ID NO: 24725 - protein, 9 aa, Artificial Sequence
  source: /note="Description of Artificial Sequence: Synthetic peptide"
EKFATLAKL

SEQ ID NO: 24726 - protein, 10 aa, Artificial Sequence
  source: /note="Description of Artificial Sequence: Synthetic peptide"
TLAKLVQYYM

SEQ ID NO: 24727 - protein, 10 aa, Artificial Sequence
  source: /note="Description of Artificial Sequence: Synthetic peptide"
ATLAKLVQYY

SEQ ID NO: 24728 - protein, 10 aa, Artificial Sequence
  source: /note="Description of Artificial Sequence: Synthetic peptide"
FATLAKLVQY

SEQ ID NO: 24729 - protein, 10 aa, Artificial Sequence
  source: /note="Description of Artificial Sequence: Synthetic peptide"
GEKFATLAKL

SEQ ID NO: 24730 - protein, 10 aa, Artificial Sequence
  source: /note="Description of Artificial Sequence: Synthetic peptide"
KLVQYYMEHH

SEQ ID NO: 24731 - protein, 9 aa, Artificial Sequence
  source: /note="Description of Artificial Sequence: Synthetic peptide"
IGFGNQCGK

SEQ ID NO: 24732 - protein, 9 aa, Artificial Sequence
  source: /note="Description of Artificial Sequence: Synthetic peptide"
RALFRSLNL

SEQ ID NO: 24733 - protein, 9 aa, Artificial Sequence
  source: /note="Description of Artificial Sequence: Synthetic peptide"
LFRSLNLQA

SEQ ID NO: 24734 - protein, 9 aa, Artificial Sequence
  source: /note="Description of Artificial Sequence: Synthetic peptide"
AQDIERALF

SEQ ID NO: 24735 - protein, 9 aa, Artificial Sequence
  source: /note="Description of Artificial Sequence: Synthetic peptide"
IERALFRSL

SEQ ID NO: 24736 - protein, 10 aa, Artificial Sequence
  source: /note="Description of Artificial Sequence: Synthetic peptide"
ALFRSLNLQA

SEQ ID NO: 24737 - protein, 9 aa, Artificial Sequence
  source: /note="Description of Artificial Sequence: Synthetic peptide"
QSLLDVVDK

SEQ ID NO: 24738 - protein, 10 aa, Artificial Sequence
  source: /note="Description of Artificial Sequence: Synthetic peptide"
SLLDVVDKEA

SEQ ID NO: 24739 - protein, 9 aa, Artificial Sequence
  source: /note="Description of Artificial Sequence: Synthetic peptide"
SESEEEEEA

SEQ ID NO: 24740 - protein, 9 aa, Artificial Sequence
  source: /note="Description of Artificial Sequence: Synthetic peptide"
ALFHTDDIK

SEQ ID NO: 24741 - protein, 9 aa, Artificial Sequence
  source: /note="Description of Artificial Sequence: Synthetic peptide"
HTDDIKNAK

SEQ ID NO: 24742 - protein, 9 aa, Artificial Sequence
  source: /note="Description of Artificial Sequence: Synthetic peptide"
KNAKYISRL

SEQ ID NO: 24743 - protein, 10 aa, Artificial Sequence
  source: /note="Description of Artificial Sequence: Synthetic peptide"
HTDDIKNAKY

SEQ ID NO: 24744 - protein, 10 aa, Artificial Sequence
  source: /note="Description of Artificial Sequence: Synthetic peptide"
TALFHTDDIK

SEQ ID NO: 24745 - protein, 10 aa, Artificial Sequence
  source: /note="Description of Artificial Sequence: Synthetic peptide"
DIKNAKYISR

SEQ ID NO: 24746 - protein, 10 aa, Artificial Sequence
  source: /note="Description of Artificial Sequence: Synthetic peptide"
IKNAKYISRL

SEQ ID NO: 24747 - protein, 10 aa, Artificial Sequence
  source: /note="Description of Artificial Sequence: Synthetic peptide"
KNAKYISRLF

SEQ ID NO: 24748 - protein, 9 aa, Artificial Sequence
  source: /note="Description of Artificial Sequence: Synthetic peptide"
QTGTGTGAR

SEQ ID NO: 24749 - protein, 9 aa, Artificial Sequence
  source: /note="Description of Artificial Sequence: Synthetic peptide"
QKNFLHIIL

SEQ ID NO: 24750 - protein, 10 aa, Artificial Sequence
  source: /note="Description of Artificial Sequence: Synthetic peptide"
RPLPPQKNFL

SEQ ID NO: 24751 - protein, 10 aa, Artificial Sequence
  source: /note="Description of Artificial Sequence: Synthetic peptide"
LPPQKNFLHI

SEQ ID NO: 24752 - protein, 9 aa, Artificial Sequence
  source: /note="Description of Artificial Sequence: Synthetic peptide"
HSFSHERTV

SEQ ID NO: 24753 - protein, 9 aa, Artificial Sequence
  source: /note="Description of Artificial Sequence: Synthetic peptide"
ENHSFSHER

SEQ ID NO: 24754 - protein, 10 aa, Artificial Sequence
  source: /note="Description of Artificial Sequence: Synthetic peptide"
FSHERTVPDK

SEQ ID NO: 24755 - protein, 10 aa, Artificial Sequence
  source: /note="Description of Artificial Sequence: Synthetic peptide"
GKYENHSFSH

SEQ ID NO: 24756 - protein, 9 aa, Artificial Sequence
  source: /note="Description of Artificial Sequence: Synthetic peptide"
KCNPTQQKF

SEQ ID NO: 24757 - protein, 10 aa, Artificial Sequence
  source: /note="Description of Artificial Sequence: Synthetic peptide"
GGKCNPTQQK

SEQ ID NO: 24758 - protein, 10 aa, Artificial Sequence
  source: /note="Description of Artificial Sequence: Synthetic peptide"
GKCNPTQQKF

SEQ ID NO: 24759 - protein, 9 aa, Artificial Sequence
  source: /note="Description of Artificial Sequence: Synthetic peptide"
RQRCLMVHV

SEQ ID NO: 24760 - protein, 9 aa, Artificial Sequence
  source: /note="Description of Artificial Sequence: Synthetic peptide"
LMVHVEAQY

SEQ ID NO: 24761 - protein, 9 aa, Artificial Sequence
  source: /note="Description of Artificial Sequence: Synthetic peptide"
MVHVEAQYI

SEQ ID NO: 24762 - protein, 9 aa, Artificial Sequence
  source: /note="Description of Artificial Sequence: Synthetic peptide"
VHVEAQYIL

SEQ ID NO: 24763 - protein, 10 aa, Artificial Sequence
  source: /note="Description of Artificial Sequence: Synthetic peptide"
LMVHVEAQYI

SEQ ID NO: 24764 - protein, 10 aa, Artificial Sequence
  source: /note="Description of Artificial Sequence: Synthetic peptide"
RQRCLMVHVE

SEQ ID NO: 24765 - protein, 10 aa, Artificial Sequence
  source: /note="Description of Artificial Sequence: Synthetic peptide"
CLMVHVEAQY

SEQ ID NO: 24766 - protein, 10 aa, Artificial Sequence
  source: /note="Description of Artificial Sequence: Synthetic peptide"
MVHVEAQYIL

SEQ ID NO: 24767 - protein, 9 aa, Artificial Sequence
  source: /note="Description of Artificial Sequence: Synthetic peptide"
EQQRRRRQA

SEQ ID NO: 24768 - protein, 10 aa, Artificial Sequence
  source: /note="Description of Artificial Sequence: Synthetic peptide"
QQRRRRQAER

SEQ ID NO: 24769 - protein, 9 aa, Artificial Sequence
  source: /note="Description of Artificial Sequence: Synthetic peptide"
LVWLEPGTR

SEQ ID NO: 24770 - protein, 9 aa, Artificial Sequence
  source: /note="Description of Artificial Sequence: Synthetic peptide"
RDTEVLLVW

SEQ ID NO: 24771 - protein, 9 aa, Artificial Sequence
  source: /note="Description of Artificial Sequence: Synthetic peptide"
VWLEPGTRY

SEQ ID NO: 24772 - protein, 10 aa, Artificial Sequence
  source: /note="Description of Artificial Sequence: Synthetic peptide"
VLLVWLEPGT

SEQ ID NO: 24773 - protein, 10 aa, Artificial Sequence
  source: /note="Description of Artificial Sequence: Synthetic peptide"
WLEPGTRYNA

SEQ ID NO: 24774 - protein, 10 aa, Artificial Sequence
  source: /note="Description of Artificial Sequence: Synthetic peptide"
LVWLEPGTRY

SEQ ID NO: 24775 - protein, 10 aa, Artificial Sequence
  source: /note="Description of Artificial Sequence: Synthetic peptide"
RDTEVLLVWL

SEQ ID NO: 24776 - protein, 9 aa, Artificial Sequence
  source: /note="Description of Artificial Sequence: Synthetic peptide"
IISYDHSLV

SEQ ID NO: 24777 - protein, 9 aa, Artificial Sequence
  source: /note="Description of Artificial Sequence: Synthetic peptide"
NIISYDHSL

SEQ ID NO: 24778 - protein, 9 aa, Artificial Sequence
  source: /note="Description of Artificial Sequence: Synthetic peptide"
ISYDHSLVR

SEQ ID NO: 24779 - protein, 9 aa, Artificial Sequence
  source: /note="Description of Artificial Sequence: Synthetic peptide"
SYDHSLVRL

SEQ ID NO: 24780 - protein, 9 aa, Artificial Sequence
  source: /note="Description of Artificial Sequence: Synthetic peptide"
HSLVRLLVL

SEQ ID NO: 24781 - protein, 9 aa, Artificial Sequence
  source: /note="Description of Artificial Sequence: Synthetic peptide"
YDHSLVRLL

SEQ ID NO: 24782 - protein, 10 aa, Artificial Sequence
  source: /note="Description of Artificial Sequence: Synthetic peptide"
NIISYDHSLV

SEQ ID NO: 24783 - protein, 10 aa, Artificial Sequence
  source: /note="Description of Artificial Sequence: Synthetic peptide"
IISYDHSLVR

SEQ ID NO: 24784 - protein, 10 aa, Artificial Sequence
  source: /note="Description of Artificial Sequence: Synthetic peptide"
SYDHSLVRLL

SEQ ID NO: 24785 - protein, 10 aa, Artificial Sequence
  source: /note="Description of Artificial Sequence: Synthetic peptide"
ISYDHSLVRL

SEQ ID NO: 24786 - protein, 10 aa, Artificial Sequence
  source: /note="Description of Artificial Sequence: Synthetic peptide"
YDHSLVRLLV

SEQ ID NO: 24787 - protein, 9 aa, Artificial Sequence
  source: /note="Description of Artificial Sequence: Synthetic peptide"
RQVKFLNPR

SEQ ID NO: 24788 - protein, 9 aa, Artificial Sequence
  source: /note="Description of Artificial Sequence: Synthetic peptide"
QVKFLNPRK

SEQ ID NO: 24789 - protein, 9 aa, Artificial Sequence
  source: /note="Description of Artificial Sequence: Synthetic peptide"
VKFLNPRKL

SEQ ID NO: 24790 - protein, 10 aa, Artificial Sequence
  source: /note="Description of Artificial Sequence: Synthetic peptide"
RQVKFLNPRK

SEQ ID NO: 24791 - protein, 9 aa, Artificial Sequence
  source: /note="Description of Artificial Sequence: Synthetic peptide"
NLHSGTTYL

SEQ ID NO: 24792 - protein, 9 aa, Artificial Sequence
  source: /note="Description of Artificial Sequence: Synthetic peptide"
LHSGTTYLF

SEQ ID NO: 24793 - protein, 9 aa, Artificial Sequence
  source: /note="Description of Artificial Sequence: Synthetic peptide"
SNLHSGTTY

SEQ ID NO: 24794 - protein, 10 aa, Artificial Sequence
  source: /note="Description of Artificial Sequence: Synthetic peptide"
FSNLHSGTTY

SEQ ID NO: 24795 - protein, 10 aa, Artificial Sequence
  source: /note="Description of Artificial Sequence: Synthetic peptide"
NLHSGTTYLF

SEQ ID NO: 24796 - protein, 10 aa, Artificial Sequence
  source: /note="Description of Artificial Sequence: Synthetic peptide"
SGTTYLFSVR

SEQ ID NO: 24797 - protein, 10 aa, Artificial Sequence
  source: /note="Description of Artificial Sequence: Synthetic peptide"
HVFSNLHSGT

SEQ ID NO: 24798 - protein, 10 aa, Artificial Sequence
  source: /note="Description of Artificial Sequence: Synthetic peptide"
HSGTTYLFSV

SEQ ID NO: 24799 - protein, 10 aa, Artificial Sequence
  source: /note="Description of Artificial Sequence: Synthetic peptide"
SNLHSGTTYL

SEQ ID NO: 24800 - protein, 9 aa, Artificial Sequence
  source: /note="Description of Artificial Sequence: Synthetic peptide"
CYNVALEYL

SEQ ID NO: 24801 - protein, 9 aa, Artificial Sequence
  source: /note="Description of Artificial Sequence: Synthetic peptide"
FCYNVALEY

SEQ ID NO: 24802 - protein, 9 aa, Artificial Sequence
  source: /note="Description of Artificial Sequence: Synthetic peptide"
DQYHFCYNV

SEQ ID NO: 24803 - protein, 9 aa, Artificial Sequence
  source: /note="Description of Artificial Sequence: Synthetic peptide"
YHFCYNVAL

SEQ ID NO: 24804 - protein, 10 aa, Artificial Sequence
  source: /note="Description of Artificial Sequence: Synthetic peptide"
QYHFCYNVAL

SEQ ID NO: 24805 - protein, 10 aa, Artificial Sequence
  source: /note="Description of Artificial Sequence: Synthetic peptide"
HFCYNVALEY

SEQ ID NO: 24806 - protein, 10 aa, Artificial Sequence
  source: /note="Description of Artificial Sequence: Synthetic peptide"
NVALEYLEGL

SEQ ID NO: 24807 - protein, 10 aa, Artificial Sequence
  source: /note="Description of Artificial Sequence: Synthetic peptide"
DQYHFCYNVA

SEQ ID NO: 24808 - protein, 10 aa, Artificial Sequence
  source: /note="Description of Artificial Sequence: Synthetic peptide"
MDQYHFCYNV

SEQ ID NO: 24809 - protein, 9 aa, Artificial Sequence
  source: /note="Description of Artificial Sequence: Synthetic peptide"
VTIPLVGVV

SEQ ID NO: 24810 - protein, 9 aa, Artificial Sequence
  source: /note="Description of Artificial Sequence: Synthetic peptide"
PLVGVVNPI

SEQ ID NO: 24811 - protein, 9 aa, Artificial Sequence
  source: /note="Description of Artificial Sequence: Synthetic peptide"
PPIPVTIPL

SEQ ID NO: 24812 - protein, 10 aa, Artificial Sequence
  source: /note="Description of Artificial Sequence: Synthetic peptide"
RPPIPVTIPL

SEQ ID NO: 24813 - protein, 10 aa, Artificial Sequence
  source: /note="Description of Artificial Sequence: Synthetic peptide"
IPLVGVVNPI

SEQ ID NO: 24814 - protein, 10 aa, Artificial Sequence
  source: /note="Description of Artificial Sequence: Synthetic peptide"
PPIPVTIPLV

SEQ ID NO: 24815 - protein, 10 aa, Artificial Sequence
  source: /note="Description of Artificial Sequence: Synthetic peptide"
IPVTIPLVGV

SEQ ID NO: 24816 - protein, 9 aa, Artificial Sequence
  source: /note="Description of Artificial Sequence: Synthetic peptide"
VIATLLFCL

SEQ ID NO: 24817 - protein, 9 aa, Artificial Sequence
  source: /note="Description of Artificial Sequence: Synthetic peptide"
ATLLFCLLV

SEQ ID NO: 24818 - protein, 9 aa, Artificial Sequence
  source: /note="Description of Artificial Sequence: Synthetic peptide"
TLLFCLLVV

SEQ ID NO: 24819 - protein, 9 aa, Artificial Sequence
  source: /note="Description of Artificial Sequence: Synthetic peptide"
VVVGVIATL

SEQ ID NO: 24820 - protein, 9 aa, Artificial Sequence
  source: /note="Description of Artificial Sequence: Synthetic peptide"
VGVIATLLF

SEQ ID NO: 24821 - protein, 10 aa, Artificial Sequence
  source: /note="Description of Artificial Sequence: Synthetic peptide"
GVIATLLFCL

SEQ ID NO: 24822 - protein, 10 aa, Artificial Sequence
  source: /note="Description of Artificial Sequence: Synthetic peptide"
VIATLLFCLL

SEQ ID NO: 24823 - protein, 10 aa, Artificial Sequence
  source: /note="Description of Artificial Sequence: Synthetic peptide"
ATLLFCLLVV

SEQ ID NO: 24824 - protein, 10 aa, Artificial Sequence
  source: /note="Description of Artificial Sequence: Synthetic peptide"
TLLFCLLVVV

SEQ ID NO: 24825 - protein, 10 aa, Artificial Sequence
  source: /note="Description of Artificial Sequence: Synthetic peptide"
VVVGVIATLL

SEQ ID NO: 24826 - protein, 10 aa, Artificial Sequence
  source: /note="Description of Artificial Sequence: Synthetic peptide"
VVGVIATLLF

SEQ ID NO: 24827 - protein, 9 aa, Artificial Sequence
  source: /note="Description of Artificial Sequence: Synthetic peptide"
MQLGSSSPL

SEQ ID NO: 24828 - protein, 9 aa, Artificial Sequence
  source: /note="Description of Artificial Sequence: Synthetic peptide"
QLGSSSPLL

SEQ ID NO: 24829 - protein, 9 aa, Artificial Sequence
  source: /note="Description of Artificial Sequence: Synthetic peptide"
RTSCGCPSR

SEQ ID NO: 24830 - protein, 9 aa, Artificial Sequence
  source: /note="Description of Artificial Sequence: Synthetic peptide"
GVCPATATR

SEQ ID NO: 24831 - protein, 9 aa, Artificial Sequence
  source: /note="Description of Artificial Sequence: Synthetic peptide"
SSAPSACGR

SEQ ID NO: 24832 - protein, 9 aa, Artificial Sequence
  source: /note="Description of Artificial Sequence: Synthetic peptide"
GFSPPRPPA

SEQ ID NO: 24833 - protein, 9 aa, Artificial Sequence
  source: /note="Description of Artificial Sequence: Synthetic peptide"
LTRCGSGTR

SEQ ID NO: 24834 - protein, 9 aa, Artificial Sequence
  source: /note="Description of Artificial Sequence: Synthetic peptide"
SARGGVCPA

SEQ ID NO: 24835 - protein, 9 aa, Artificial Sequence
  source: /note="Description of Artificial Sequence: Synthetic peptide"
ATRGASSSA

SEQ ID NO: 24836 - protein, 9 aa, Artificial Sequence
  source: /note="Description of Artificial Sequence: Synthetic peptide"
CGRARCSVR

SEQ ID NO: 24837 - protein, 9 aa, Artificial Sequence
  source: /note="Description of Artificial Sequence: Synthetic peptide"
RARCSVRSA

SEQ ID NO: 24838 - protein, 9 aa, Artificial Sequence
  source: /note="Description of Artificial Sequence: Synthetic peptide"
TSCGCPSRR

SEQ ID NO: 24839 - protein, 9 aa, Artificial Sequence
  source: /note="Description of Artificial Sequence: Synthetic peptide"
APSHPRPSC

SEQ ID NO: 24840 - protein, 9 aa, Artificial Sequence
  source: /note="Description of Artificial Sequence: Synthetic peptide"
HPRPSCRRC

SEQ ID NO: 24841 - protein, 9 aa, Artificial Sequence
  source: /note="Description of Artificial Sequence: Synthetic peptide"
RPSCRRCPP

SEQ ID NO: 24842 - protein, 9 aa, Artificial Sequence
  source: /note="Description of Artificial Sequence: Synthetic peptide"
GPSSARGGV

SEQ ID NO: 24843 - protein, 9 aa, Artificial Sequence
  source: /note="Description of Artificial Sequence: Synthetic peptide"
CPATATRGA

SEQ ID NO: 24844 - protein, 9 aa, Artificial Sequence
  source: /note="Description of Artificial Sequence: Synthetic peptide"
LPAGFSPPR

SEQ ID NO: 24845 - protein, 10 aa, Artificial Sequence
  source: /note="Description of Artificial Sequence: Synthetic peptide"
VMQLGSSSPL

SEQ ID NO: 24846 - protein, 10 aa, Artificial Sequence
  source: /note="Description of Artificial Sequence: Synthetic peptide"
MQLGSSSPLL

SEQ ID NO: 24847 - protein, 10 aa, Artificial Sequence
  source: /note="Description of Artificial Sequence: Synthetic peptide"
TSKAPPSLTR

SEQ ID NO: 24848 - protein, 10 aa, Artificial Sequence
  source: /note="Description of Artificial Sequence: Synthetic peptide"
RTSCGCPSRR

SEQ ID NO: 24849 - protein, 10 aa, Artificial Sequence
  source: /note="Description of Artificial Sequence: Synthetic peptide"
SSSAPSACGR

SEQ ID NO: 24850 - protein, 10 aa, Artificial Sequence
  source: /note="Description of Artificial Sequence: Synthetic peptide"
AGFSPPRPPA

SEQ ID NO: 24851 - protein, 10 aa, Artificial Sequence
  source: /note="Description of Artificial Sequence: Synthetic peptide"
RTLPTSKAPP

SEQ ID NO: 24852 - protein, 10 aa, Artificial Sequence
  source: /note="Description of Artificial Sequence: Synthetic peptide"
GTRTSCGCPS

SEQ ID NO: 24853 - protein, 10 aa, Artificial Sequence
  source: /note="Description of Artificial Sequence: Synthetic peptide"
PSRRPGPSSA

SEQ ID NO: 24854 - protein, 10 aa, Artificial Sequence
  source: /note="Description of Artificial Sequence: Synthetic peptide"
RGASSSAPSA

SEQ ID NO: 24855 - protein, 10 aa, Artificial Sequence
  source: /note="Description of Artificial Sequence: Synthetic peptide"
RARCSVRSAR

SEQ ID NO: 24856 - protein, 10 aa, Artificial Sequence
  source: /note="Description of Artificial Sequence: Synthetic peptide"
SSSPLLPAGF

SEQ ID NO: 24857 - protein, 10 aa, Artificial Sequence
  source: /note="Description of Artificial Sequence: Synthetic peptide"
LLPAGFSPPR

SEQ ID NO: 24858 - protein, 10 aa, Artificial Sequence
  source: /note="Description of Artificial Sequence: Synthetic peptide"
RPSCRRCPPE

SEQ ID NO: 24859 - protein, 10 aa, Artificial Sequence
  source: /note="Description of Artificial Sequence: Synthetic peptide"
CPRTLPTSKA

SEQ ID NO: 24860 - protein, 10 aa, Artificial Sequence
  source: /note="Description of Artificial Sequence: Synthetic peptide"
LPTSKAPPSL

SEQ ID NO: 24861 - protein, 10 aa, Artificial Sequence
  source: /note="Description of Artificial Sequence: Synthetic peptide"
CPATATRGAS

SEQ ID NO: 24862 - protein, 9 aa, Artificial Sequence
  source: /note="Description of Artificial Sequence: Synthetic peptide"
RAVMQESQK

SEQ ID NO: 24863 - protein, 9 aa, Artificial Sequence
  source: /note="Description of Artificial Sequence: Synthetic peptide"
AVMQESQKK

SEQ ID NO: 24864 - protein, 9 aa, Artificial Sequence
  source: /note="Description of Artificial Sequence: Synthetic peptide"
SRGQFRAVM

SEQ ID NO: 24865 - protein, 10 aa, Artificial Sequence
  source: /note="Description of Artificial Sequence: Synthetic peptide"
RSRGQFRAVM

SEQ ID NO: 24866 - protein, 10 aa, Artificial Sequence
  source: /note="Description of Artificial Sequence: Synthetic peptide"
RAVMQESQKK

SEQ ID NO: 24867 - protein, 10 aa, Artificial Sequence
  source: /note="Description of Artificial Sequence: Synthetic peptide"
GQFRAVMQES

SEQ ID NO: 24868 - protein, 9 aa, Artificial Sequence
  source: /note="Description of Artificial Sequence: Synthetic peptide"
GMTSDSPEK

SEQ ID NO: 24869 - protein, 9 aa, Artificial Sequence
  source: /note="Description of Artificial Sequence: Synthetic peptide"
MTSDSPEKR

SEQ ID NO: 24870 - protein, 10 aa, Artificial Sequence
  source: /note="Description of Artificial Sequence: Synthetic peptide"
RGMTSDSPEK

SEQ ID NO: 24871 - protein, 9 aa, Artificial Sequence
  source: /note="Description of Artificial Sequence: Synthetic peptide"
NMPPRVLAT

SEQ ID NO: 24872 - protein, 9 aa, Artificial Sequence
  source: /note="Description of Artificial Sequence: Synthetic peptide"
VLATHPQAT

SEQ ID NO: 24873 - protein, 9 aa, Artificial Sequence
  source: /note="Description of Artificial Sequence: Synthetic peptide"
RVLATHPQA

SEQ ID NO: 24874 - protein, 9 aa, Artificial Sequence
  source: /note="Description of Artificial Sequence: Synthetic peptide"
MPPRVLATH

SEQ ID NO: 24875 - protein, 10 aa, Artificial Sequence
  source: /note="Description of Artificial Sequence: Synthetic peptide"
AFNMPPRVLA

SEQ ID NO: 24876 - protein, 10 aa, Artificial Sequence
  source: /note="Description of Artificial Sequence: Synthetic peptide"
RVLATHPQAT

SEQ ID NO: 24877 - protein, 10 aa, Artificial Sequence
  source: /note="Description of Artificial Sequence: Synthetic peptide"
MGPAFNMPPR

SEQ ID NO: 24878 - protein, 10 aa, Artificial Sequence
  source: /note="Description of Artificial Sequence: Synthetic peptide"
GPAFNMPPRV

SEQ ID NO: 24879 - protein, 9 aa, Artificial Sequence
  source: /note="Description of Artificial Sequence: Synthetic peptide"
ATKRSKMSK

SEQ ID NO: 24880 - protein, 10 aa, Artificial Sequence
  source: /note="Description of Artificial Sequence: Synthetic peptide"
TATKRSKMSK

SEQ ID NO: 24881 - protein, 9 aa, Artificial Sequence
  source: /note="Description of Artificial Sequence: Synthetic peptide"
GLIPLVNLM

SEQ ID NO: 24882 - protein, 9 aa, Artificial Sequence
  source: /note="Description of Artificial Sequence: Synthetic peptide"
NLMDVPGIL

SEQ ID NO: 24883 - protein, 9 aa, Artificial Sequence
  source: /note="Description of Artificial Sequence: Synthetic peptide"
IPLVNLMDV

SEQ ID NO: 24884 - protein, 10 aa, Artificial Sequence
  source: /note="Description of Artificial Sequence: Synthetic peptide"
NLMDVPGILT

SEQ ID NO: 24885 - protein, 10 aa, Artificial Sequence
  source: /note="Description of Artificial Sequence: Synthetic peptide"
LVNLMDVPGI

SEQ ID NO: 24886 - protein, 9 aa, Artificial Sequence
  source: /note="Description of Artificial Sequence: Synthetic peptide"
HFLGFPCSL

SEQ ID NO: 24887 - protein, 9 aa, Artificial Sequence
  source: /note="Description of Artificial Sequence: Synthetic peptide"
CQGSEPHFL

SEQ ID NO: 24888 - protein, 9 aa, Artificial Sequence
  source: /note="Description of Artificial Sequence: Synthetic peptide"
GSEPHFLGF

SEQ ID NO: 24889 - protein, 9 aa, Artificial Sequence
  source: /note="Description of Artificial Sequence: Synthetic peptide"
EPHFLGFPC

SEQ ID NO: 24890 - protein, 10 aa, Artificial Sequence
  source: /note="Description of Artificial Sequence: Synthetic peptide"
FLGFPCSLWV

SEQ ID NO: 24891 - protein, 10 aa, Artificial Sequence
  source: /note="Description of Artificial Sequence: Synthetic peptide"
HFLGFPCSLW

SEQ ID NO: 24892 - protein, 10 aa, Artificial Sequence
  source: /note="Description of Artificial Sequence: Synthetic peptide"
QGSEPHFLGF

SEQ ID NO: 24893 - protein, 10 aa, Artificial Sequence
  source: /note="Description of Artificial Sequence: Synthetic peptide"
LGFPCSLWVL

SEQ ID NO: 24894 - protein, 10 aa, Artificial Sequence
  source: /note="Description of Artificial Sequence: Synthetic peptide"
SEPHFLGFPC

SEQ ID NO: 24895 - protein, 9 aa, Artificial Sequence
  source: /note="Description of Artificial Sequence: Synthetic peptide"
LMVMYFFFL

SEQ ID NO: 24896 - protein, 9 aa, Artificial Sequence
  source: /note="Description of Artificial Sequence: Synthetic peptide"
MVMYFFFLV

SEQ ID NO: 24897 - protein, 9 aa, Artificial Sequence
  source: /note="Description of Artificial Sequence: Synthetic peptide"
VMYFFFLVR

SEQ ID NO: 24898 - protein, 9 aa, Artificial Sequence
  source: /note="Description of Artificial Sequence: Synthetic peptide"
FLVRSRRWK

SEQ ID NO: 24899 - protein, 9 aa, Artificial Sequence
  source: /note="Description of Artificial Sequence: Synthetic peptide"
FFLVRSRRW

SEQ ID NO: 24900 - protein, 9 aa, Artificial Sequence
  source: /note="Description of Artificial Sequence: Synthetic peptide"
LVRSRRWKV

SEQ ID NO: 24901 - protein, 9 aa, Artificial Sequence
  source: /note="Description of Artificial Sequence: Synthetic peptide"
YFFFLVRSR

SEQ ID NO: 24902 - protein, 9 aa, Artificial Sequence
  source: /note="Description of Artificial Sequence: Synthetic peptide"
FFFLVRSRR

SEQ ID NO: 24903 - protein, 10 aa, Artificial Sequence
  source: /note="Description of Artificial Sequence: Synthetic peptide"
FLMVMYFFFL

SEQ ID NO: 24904 - protein, 10 aa, Artificial Sequence
  source: /note="Description of Artificial Sequence: Synthetic peptide"
LMVMYFFFLV

SEQ ID NO: 24905 - protein, 10 aa, Artificial Sequence
  source: /note="Description of Artificial Sequence: Synthetic peptide"
FLVRSRRWKV

SEQ ID NO: 24906 - protein, 10 aa, Artificial Sequence
  source: /note="Description of Artificial Sequence: Synthetic peptide"
MVMYFFFLVR

SEQ ID NO: 24907 - protein, 10 aa, Artificial Sequence
  source: /note="Description of Artificial Sequence: Synthetic peptide"
FFFLVRSRRW

SEQ ID NO: 24908 - protein, 10 aa, Artificial Sequence
  source: /note="Description of Artificial Sequence: Synthetic peptide"
MYFFFLVRSR

SEQ ID NO: 24909 - protein, 10 aa, Artificial Sequence
  source: /note="Description of Artificial Sequence: Synthetic peptide"
FFLVRSRRWK

SEQ ID NO: 24910 - protein, 10 aa, Artificial Sequence
  source: /note="Description of Artificial Sequence: Synthetic peptide"
LVRSRRWKVK

SEQ ID NO: 24911 - protein, 10 aa, Artificial Sequence
  source: /note="Description of Artificial Sequence: Synthetic peptide"
YFFFLVRSRR

SEQ ID NO: 24912 - protein, 9 aa, Artificial Sequence
  source: /note="Description of Artificial Sequence: Synthetic peptide"
LLSNQRSSM

SEQ ID NO: 24913 - protein, 10 aa, Artificial Sequence
  source: /note="Description of Artificial Sequence: Synthetic peptide"
NQRSSMGGQM

SEQ ID NO: 24914 - protein, 10 aa, Artificial Sequence
  source: /note="Description of Artificial Sequence: Synthetic peptide"
GLLSNQRSSM

SEQ ID NO: 24915 - protein, 9 aa, Artificial Sequence
  source: /note="Description of Artificial Sequence: Synthetic peptide"
GMGGQMQGL

SEQ ID NO: 24916 - protein, 9 aa, Artificial Sequence
  source: /note="Description of Artificial Sequence: Synthetic peptide"
LLSSQRSGM

SEQ ID NO: 24917 - protein, 9 aa, Artificial Sequence
  source: /note="Description of Artificial Sequence: Synthetic peptide"
QRSGMGGQM

SEQ ID NO: 24918 - protein, 10 aa, Artificial Sequence
  source: /note="Description of Artificial Sequence: Synthetic peptide"
GMGGQMQGLV

SEQ ID NO: 24919 - protein, 10 aa, Artificial Sequence
  source: /note="Description of Artificial Sequence: Synthetic peptide"
SQRSGMGGQM

SEQ ID NO: 24920 - protein, 10 aa, Artificial Sequence
  source: /note="Description of Artificial Sequence: Synthetic peptide"
GLLSSQRSGM

SEQ ID NO: 24921 - protein, 9 aa, Artificial Sequence
  source: /note="Description of Artificial Sequence: Synthetic peptide"
RMLLHWVAA

SEQ ID NO: 24922 - protein, 9 aa, Artificial Sequence
  source: /note="Description of Artificial Sequence: Synthetic peptide"
MLLHWVAAY

SEQ ID NO: 24923 - protein, 9 aa, Artificial Sequence
  source: /note="Description of Artificial Sequence: Synthetic peptide"
SYHRMLLHW

SEQ ID NO: 24924 - protein, 9 aa, Artificial Sequence
  source: /note="Description of Artificial Sequence: Synthetic peptide"
HWVAAYFGM

SEQ ID NO: 24925 - protein, 9 aa, Artificial Sequence
  source: /note="Description of Artificial Sequence: Synthetic peptide"
LLHWVAAYF

SEQ ID NO: 24926 - protein, 9 aa, Artificial Sequence
  source: /note="Description of Artificial Sequence: Synthetic peptide"
HRMLLHWVA

SEQ ID NO: 24927 - protein, 10 aa, Artificial Sequence
  source: /note="Description of Artificial Sequence: Synthetic peptide"
MLLHWVAAYF

SEQ ID NO: 24928 - protein, 10 aa, Artificial Sequence
  source: /note="Description of Artificial Sequence: Synthetic peptide"
RMLLHWVAAY

SEQ ID NO: 24929 - protein, 10 aa, Artificial Sequence
  source: /note="Description of Artificial Sequence: Synthetic peptide"
SYHRMLLHWV

SEQ ID NO: 24930 - protein, 10 aa, Artificial Sequence
  source: /note="Description of Artificial Sequence: Synthetic peptide"
YHRMLLHWVA

SEQ ID NO: 24931 - protein, 10 aa, Artificial Sequence
  source: /note="Description of Artificial Sequence: Synthetic peptide"
TSYHRMLLHW

SEQ ID NO: 24932 - protein, 10 aa, Artificial Sequence
  source: /note="Description of Artificial Sequence: Synthetic peptide"
HRMLLHWVAA

SEQ ID NO: 24933 - protein, 10 aa, Artificial Sequence
  source: /note="Description of Artificial Sequence: Synthetic peptide"
LHWVAAYFGM

SEQ ID NO: 24934 - protein, 9 aa, Artificial Sequence
  source: /note="Description of Artificial Sequence: Synthetic peptide"
ALRDELMEA

SEQ ID NO: 24935 - protein, 9 aa, Artificial Sequence
  source: /note="Description of Artificial Sequence: Synthetic peptide"
LAAEIDTAL

SEQ ID NO: 24936 - protein, 10 aa, Artificial Sequence
  source: /note="Description of Artificial Sequence: Synthetic peptide"
SLAAEIDTAL

SEQ ID NO: 24937 - protein, 10 aa, Artificial Sequence
  source: /note="Description of Artificial Sequence: Synthetic peptide"
ALRDELMEAL

SEQ ID NO: 24938 - protein, 10 aa, Artificial Sequence
  source: /note="Description of Artificial Sequence: Synthetic peptide"
LAAEIDTALR

SEQ ID NO: 24939 - protein, 9 aa, Artificial Sequence
  source: /note="Description of Artificial Sequence: Synthetic peptide"
IEVTIQFTH

SEQ ID NO: 24940 - protein, 9 aa, Artificial Sequence
  source: /note="Description of Artificial Sequence: Synthetic peptide"
IQFTHNNLS

SEQ ID NO: 24941 - protein, 9 aa, Artificial Sequence
  source: /note="Description of Artificial Sequence: Synthetic peptide"
THNNLSASM

SEQ ID NO: 24942 - protein, 9 aa, Artificial Sequence
  source: /note="Description of Artificial Sequence: Synthetic peptide"
HNNLSASMF

SEQ ID NO: 24943 - protein, 10 aa, Artificial Sequence
  source: /note="Description of Artificial Sequence: Synthetic peptide"
IQFTHNNLSA

SEQ ID NO: 24944 - protein, 10 aa, Artificial Sequence
  source: /note="Description of Artificial Sequence: Synthetic peptide"
FTHNNLSASM

SEQ ID NO: 24945 - protein, 10 aa, Artificial Sequence
  source: /note="Description of Artificial Sequence: Synthetic peptide"
VTIQFTHNNL

SEQ ID NO: 24946 - protein, 10 aa, Artificial Sequence
  source: /note="Description of Artificial Sequence: Synthetic peptide"
THNNLSASMF

SEQ ID NO: 24947 - protein, 9 aa, Artificial Sequence
  source: /note="Description of Artificial Sequence: Synthetic peptide"
SLALDILLK

SEQ ID NO: 24948 - protein, 9 aa, Artificial Sequence
  source: /note="Description of Artificial Sequence: Synthetic peptide"
DEAFSSLAL

SEQ ID NO: 24949 - protein, 9 aa, Artificial Sequence
  source: /note="Description of Artificial Sequence: Synthetic peptide"
FSSLALDIL

SEQ ID NO: 24950 - protein, 10 aa, Artificial Sequence
  source: /note="Description of Artificial Sequence: Synthetic peptide"
SSLALDILLK

SEQ ID NO: 24951 - protein, 10 aa, Artificial Sequence
  source: /note="Description of Artificial Sequence: Synthetic peptide"
EAFSSLALDI

SEQ ID NO: 24952 - protein, 10 aa, Artificial Sequence
  source: /note="Description of Artificial Sequence: Synthetic peptide"
VDEAFSSLAL

SEQ ID NO: 24953 - protein, 9 aa, Artificial Sequence
  source: /note="Description of Artificial Sequence: Synthetic peptide"
RLYYWDASA

SEQ ID NO: 24954 - protein, 9 aa, Artificial Sequence
  source: /note="Description of Artificial Sequence: Synthetic peptide"
TSMTRLYYW

SEQ ID NO: 24955 - protein, 9 aa, Artificial Sequence
  source: /note="Description of Artificial Sequence: Synthetic peptide"
YYWDASACV

SEQ ID NO: 24956 - protein, 9 aa, Artificial Sequence
  source: /note="Description of Artificial Sequence: Synthetic peptide"
MTRLYYWDA

SEQ ID NO: 24957 - protein, 9 aa, Artificial Sequence
  source: /note="Description of Artificial Sequence: Synthetic peptide"
WDASACVIM

SEQ ID NO: 24958 - protein, 10 aa, Artificial Sequence
  source: /note="Description of Artificial Sequence: Synthetic peptide"
SMTRLYYWDA

SEQ ID NO: 24959 - protein, 10 aa, Artificial Sequence
  source: /note="Description of Artificial Sequence: Synthetic peptide"
RLYYWDASAC

SEQ ID NO: 24960 - protein, 10 aa, Artificial Sequence
  source: /note="Description of Artificial Sequence: Synthetic peptide"
FTSMTRLYYW

SEQ ID NO: 24961 - protein, 10 aa, Artificial Sequence
  source: /note="Description of Artificial Sequence: Synthetic peptide"
LYYWDASACV

SEQ ID NO: 24962 - protein, 10 aa, Artificial Sequence
  source: /note="Description of Artificial Sequence: Synthetic peptide"
YYWDASACVI

SEQ ID NO: 24963 - protein, 10 aa, Artificial Sequence
  source: /note="Description of Artificial Sequence: Synthetic peptide"
MTRLYYWDAS

SEQ ID NO: 24964 - protein, 10 aa, Artificial Sequence
  source: /note="Description of Artificial Sequence: Synthetic peptide"
YWDASACVIM

SEQ ID NO: 24965 - protein, 10 aa, Artificial Sequence
  source: /note="Description of Artificial Sequence: Synthetic peptide"
WDASACVIMF

SEQ ID NO: 24966 - protein, 9 aa, Artificial Sequence
  source: /note="Description of Artificial Sequence: Synthetic peptide"
LIGDSGVWK

SEQ ID NO: 24967 - protein, 9 aa, Artificial Sequence
  source: /note="Description of Artificial Sequence: Synthetic peptide"
GVWKTCVLF

SEQ ID NO: 24968 - protein, 9 aa, Artificial Sequence
  source: /note="Description of Artificial Sequence: Synthetic peptide"
VWKTCVLFR

SEQ ID NO: 24969 - protein, 9 aa, Artificial Sequence
  source: /note="Description of Artificial Sequence: Synthetic peptide"
LLIGDSGVW

SEQ ID NO: 24970 - protein, 9 aa, Artificial Sequence
  source: /note="Description of Artificial Sequence: Synthetic peptide"
WKTCVLFRF

SEQ ID NO: 24971 - protein, 10 aa, Artificial Sequence
  source: /note="Description of Artificial Sequence: Synthetic peptide"
GVWKTCVLFR

SEQ ID NO: 24972 - protein, 10 aa, Artificial Sequence
  source: /note="Description of Artificial Sequence: Synthetic peptide"
SGVWKTCVLF

SEQ ID NO: 24973 - protein, 10 aa, Artificial Sequence
  source: /note="Description of Artificial Sequence: Synthetic peptide"
VWKTCVLFRF

SEQ ID NO: 24974 - protein, 10 aa, Artificial Sequence
  source: /note="Description of Artificial Sequence: Synthetic peptide"
LLLIGDSGVW

SEQ ID NO: 24975 - protein, 9 aa, Artificial Sequence
  source: /note="Description of Artificial Sequence: Synthetic peptide"
SEIKKKQFY

SEQ ID NO: 24976 - protein, 9 aa, Artificial Sequence
  source: /note="Description of Artificial Sequence: Synthetic peptide"
IKKKQFYHW

SEQ ID NO: 24977 - protein, 10 aa, Artificial Sequence
  source: /note="Description of Artificial Sequence: Synthetic peptide"
AESEIKKKQF

SEQ ID NO: 24978 - protein, 9 aa, Artificial Sequence
  source: /note="Description of Artificial Sequence: Synthetic peptide"
SLVTISRFV

SEQ ID NO: 24979 - protein, 9 aa, Artificial Sequence
  source: /note="Description of Artificial Sequence: Synthetic peptide"
KTVLSLVTI

SEQ ID NO: 24980 - protein, 9 aa, Artificial Sequence
  source: /note="Description of Artificial Sequence: Synthetic peptide"
VLSLVTISR

SEQ ID NO: 24981 - protein, 9 aa, Artificial Sequence
  source: /note="Description of Artificial Sequence: Synthetic peptide"
EIKKTVLSL

SEQ ID NO: 24982 - protein, 9 aa, Artificial Sequence
  source: /note="Description of Artificial Sequence: Synthetic peptide"
LSLVTISRF

SEQ ID NO: 24983 - protein, 9 aa, Artificial Sequence
  source: /note="Description of Artificial Sequence: Synthetic peptide"
KKTVLSLVT

SEQ ID NO: 24984 - protein, 9 aa, Artificial Sequence
  source: /note="Description of Artificial Sequence: Synthetic peptide"
AESEIKKTV

SEQ ID NO: 24985 - protein, 10 aa, Artificial Sequence
  source: /note="Description of Artificial Sequence: Synthetic peptide"
SLVTISRFVL

SEQ ID NO: 24986 - protein, 10 aa, Artificial Sequence
  source: /note="Description of Artificial Sequence: Synthetic peptide"
TVLSLVTISR

SEQ ID NO: 24987 - protein, 10 aa, Artificial Sequence
  source: /note="Description of Artificial Sequence: Synthetic peptide"
EIKKTVLSLV

SEQ ID NO: 24988 - protein, 10 aa, Artificial Sequence
  source: /note="Description of Artificial Sequence: Synthetic peptide"
VLSLVTISRF

SEQ ID NO: 24989 - protein, 10 aa, Artificial Sequence
  source: /note="Description of Artificial Sequence: Synthetic peptide"
AESEIKKTVL

SEQ ID NO: 24990 - protein, 10 aa, Artificial Sequence
  source: /note="Description of Artificial Sequence: Synthetic peptide"
SEIKKTVLSL

SEQ ID NO: 24991 - protein, 10 aa, Artificial Sequence
  source: /note="Description of Artificial Sequence: Synthetic peptide"
KKTVLSLVTI

SEQ ID NO: 24992 - protein, 9 aa, Artificial Sequence
  source: /note="Description of Artificial Sequence: Synthetic peptide"
RLQSDIQYI

SEQ ID NO: 24993 - protein, 9 aa, Artificial Sequence
  source: /note="Description of Artificial Sequence: Synthetic peptide"
LQSDIQYIT

SEQ ID NO: 24994 - protein, 9 aa, Artificial Sequence
  source: /note="Description of Artificial Sequence: Synthetic peptide"
SDIQYITRF

SEQ ID NO: 24995 - protein, 10 aa, Artificial Sequence
  source: /note="Description of Artificial Sequence: Synthetic peptide"
QSDIQYITRF

SEQ ID NO: 24996 - protein, 9 aa, Artificial Sequence
  source: /note="Description of Artificial Sequence: Synthetic peptide"
RTVFDNYSA

SEQ ID NO: 24997 - protein, 9 aa, Artificial Sequence
  source: /note="Description of Artificial Sequence: Synthetic peptide"
YIRTVFDNY

SEQ ID NO: 24998 - protein, 9 aa, Artificial Sequence
  source: /note="Description of Artificial Sequence: Synthetic peptide"
NAFPGEYIR

SEQ ID NO: 24999 - protein, 9 aa, Artificial Sequence
  source: /note="Description of Artificial Sequence: Synthetic peptide"
FPGEYIRTV

SEQ ID NO: 25000 - protein, 10 aa, Artificial Sequence
  source: /note="Description of Artificial Sequence: Synthetic peptide"
FPGEYIRTVF

SEQ ID NO: 25001 - protein, 9 aa, Artificial Sequence
  source: /note="Description of Artificial Sequence: Synthetic peptide"
AVKYLECSV

SEQ ID NO: 25002 - protein, 9 aa, Artificial Sequence
  source: /note="Description of Artificial Sequence: Synthetic peptide"
SVLTQRGLK

SEQ ID NO: 25003 - protein, 9 aa, Artificial Sequence
  source: /note="Description of Artificial Sequence: Synthetic peptide"
KYLECSVLT

SEQ ID NO: 25004 - protein, 9 aa, Artificial Sequence
  source: /note="Description of Artificial Sequence: Synthetic peptide"
VKYLECSVL

SEQ ID NO: 25005 - protein, 10 aa, Artificial Sequence
  source: /note="Description of Artificial Sequence: Synthetic peptide"
VLTQRGLKTV

SEQ ID NO: 25006 - protein, 10 aa, Artificial Sequence
  source: /note="Description of Artificial Sequence: Synthetic peptide"
CSVLTQRGLK

SEQ ID NO: 25007 - protein, 10 aa, Artificial Sequence
  source: /note="Description of Artificial Sequence: Synthetic peptide"
AVKYLECSVL

SEQ ID NO: 25008 - protein, 9 aa, Artificial Sequence
  source: /note="Description of Artificial Sequence: Synthetic peptide"
TTNAFSGEY

SEQ ID NO: 25009 - protein, 9 aa, Artificial Sequence
  source: /note="Description of Artificial Sequence: Synthetic peptide"
FSGEYIPTV

SEQ ID NO: 25010 - protein, 9 aa, Artificial Sequence
  source: /note="Description of Artificial Sequence: Synthetic peptide"
SGEYIPTVF

SEQ ID NO: 25011 - protein, 10 aa, Artificial Sequence
  source: /note="Description of Artificial Sequence: Synthetic peptide"
YTTNAFSGEY

SEQ ID NO: 25012 - protein, 10 aa, Artificial Sequence
  source: /note="Description of Artificial Sequence: Synthetic peptide"
TTNAFSGEYI

SEQ ID NO: 25013 - protein, 10 aa, Artificial Sequence
  source: /note="Description of Artificial Sequence: Synthetic peptide"
FSGEYIPTVF

SEQ ID NO: 25014 - protein, 9 aa, Artificial Sequence
  source: /note="Description of Artificial Sequence: Synthetic peptide"
GNTFVHYPK

SEQ ID NO: 25015 - protein, 9 aa, Artificial Sequence
  source: /note="Description of Artificial Sequence: Synthetic peptide"
NTFVHYPKV

SEQ ID NO: 25016 - protein, 9 aa, Artificial Sequence
  source: /note="Description of Artificial Sequence: Synthetic peptide"
TKGNTFVHY

SEQ ID NO: 25017 - protein, 10 aa, Artificial Sequence
  source: /note="Description of Artificial Sequence: Synthetic peptide"
KGNTFVHYPK

SEQ ID NO: 25018 - protein, 10 aa, Artificial Sequence
  source: /note="Description of Artificial Sequence: Synthetic peptide"
GTKGNTFVHY

SEQ ID NO: 25019 - protein, 10 aa, Artificial Sequence
  source: /note="Description of Artificial Sequence: Synthetic peptide"
NTFVHYPKVA

SEQ ID NO: 25020 - protein, 10 aa, Artificial Sequence
  source: /note="Description of Artificial Sequence: Synthetic peptide"
YPKVAQETDV

SEQ ID NO: 25021 - protein, 10 aa, Artificial Sequence
  source: /note="Description of Artificial Sequence: Synthetic peptide"
KQKLQNDKKL

SEQ ID NO: 25022 - protein, 9 aa, Artificial Sequence
  source: /note="Description of Artificial Sequence: Synthetic peptide"
FMVNRVVDL

SEQ ID NO: 25023 - protein, 9 aa, Artificial Sequence
  source: /note="Description of Artificial Sequence: Synthetic peptide"
MVNRVVDLA

SEQ ID NO: 25024 - protein, 9 aa, Artificial Sequence
  source: /note="Description of Artificial Sequence: Synthetic peptide"
EGSFMVNRV

SEQ ID NO: 25025 - protein, 10 aa, Artificial Sequence
  source: /note="Description of Artificial Sequence: Synthetic peptide"
FMVNRVVDLA

SEQ ID NO: 25026 - protein, 10 aa, Artificial Sequence
  source: /note="Description of Artificial Sequence: Synthetic peptide"
SFMVNRVVDL

SEQ ID NO: 25027 - protein, 10 aa, Artificial Sequence
  source: /note="Description of Artificial Sequence: Synthetic peptide"
DTEGSFMVNR

SEQ ID NO: 25028 - protein, 10 aa, Artificial Sequence
  source: /note="Description of Artificial Sequence: Synthetic peptide"
TEGSFMVNRV

SEQ ID NO: 25029 - protein, 9 aa, Artificial Sequence
  source: /note="Description of Artificial Sequence: Synthetic peptide"
ELLAQVHLL

SEQ ID NO: 25030 - protein, 9 aa, Artificial Sequence
  source: /note="Description of Artificial Sequence: Synthetic peptide"
AQVHLLPDF

SEQ ID NO: 25031 - protein, 9 aa, Artificial Sequence
  source: /note="Description of Artificial Sequence: Synthetic peptide"
TELLAQVHL

SEQ ID NO: 25032 - protein, 10 aa, Artificial Sequence
  source: /note="Description of Artificial Sequence: Synthetic peptide"
AQVHLLPDFL

SEQ ID NO: 25033 - protein, 10 aa, Artificial Sequence
  source: /note="Description of Artificial Sequence: Synthetic peptide"
LAQVHLLPDF

SEQ ID NO: 25034 - protein, 10 aa, Artificial Sequence
  source: /note="Description of Artificial Sequence: Synthetic peptide"
HLLPDFLSEH

SEQ ID NO: 25035 - protein, 10 aa, Artificial Sequence
  source: /note="Description of Artificial Sequence: Synthetic peptide"
TELLAQVHLL

SEQ ID NO: 25036 - protein, 9 aa, Artificial Sequence
  source: /note="Description of Artificial Sequence: Synthetic peptide"
RQRLTSTPN

SEQ ID NO: 25037 - protein, 9 aa, Artificial Sequence
  source: /note="Description of Artificial Sequence: Synthetic peptide"
LTSTPNVHM

SEQ ID NO: 25038 - protein, 9 aa, Artificial Sequence
  source: /note="Description of Artificial Sequence: Synthetic peptide"
SQRQRLTST

SEQ ID NO: 25039 - protein, 9 aa, Artificial Sequence
  source: /note="Description of Artificial Sequence: Synthetic peptide"
RLTSTPNVH

SEQ ID NO: 25040 - protein, 10 aa, Artificial Sequence
  source: /note="Description of Artificial Sequence: Synthetic peptide"
LTSTPNVHMV

SEQ ID NO: 25041 - protein, 10 aa, Artificial Sequence
  source: /note="Description of Artificial Sequence: Synthetic peptide"
RQRLTSTPNV

SEQ ID NO: 25042 - protein, 10 aa, Artificial Sequence
  source: /note="Description of Artificial Sequence: Synthetic peptide"
RLTSTPNVHM

SEQ ID NO: 25043 - protein, 10 aa, Artificial Sequence
  source: /note="Description of Artificial Sequence: Synthetic peptide"
SQRQRLTSTP

SEQ ID NO: 25044 - protein, 9 aa, Artificial Sequence
  source: /note="Description of Artificial Sequence: Synthetic peptide"
IVCRVFSSK

SEQ ID NO: 25045 - protein, 10 aa, Artificial Sequence
  source: /note="Description of Artificial Sequence: Synthetic peptide"
LTDIEIVCRV

SEQ ID NO: 25046 - protein, 10 aa, Artificial Sequence
  source: /note="Description of Artificial Sequence: Synthetic peptide"
EIVCRVFSSK

SEQ ID NO: 25047 - protein, 10 aa, Artificial Sequence
  source: /note="Description of Artificial Sequence: Synthetic peptide"
IVCRVFSSKR

SEQ ID NO: 25048 - protein, 10 aa, Artificial Sequence
  source: /note="Description of Artificial Sequence: Synthetic peptide"
HLTDIEIVCR

SEQ ID NO: 25049 - protein, 10 aa, Artificial Sequence
  source: /note="Description of Artificial Sequence: Synthetic peptide"
TDIEIVCRVF

SEQ ID NO: 25050 - protein, 10 aa, Artificial Sequence
  source: /note="Description of Artificial Sequence: Synthetic peptide"
IEIVCRVFSS

SEQ ID NO: 25051 - protein, 9 aa, Artificial Sequence
  source: /note="Description of Artificial Sequence: Synthetic peptide"
TTPHITGGT

SEQ ID NO: 25052 - protein, 9 aa, Artificial Sequence
  source: /note="Description of Artificial Sequence: Synthetic peptide"
SAAVSTTPH

SEQ ID NO: 25053 - protein, 9 aa, Artificial Sequence
  source: /note="Description of Artificial Sequence: Synthetic peptide"
AAVSTTPHI

SEQ ID NO: 25054 - protein, 10 aa, Artificial Sequence
  source: /note="Description of Artificial Sequence: Synthetic peptide"
TPHITGGTGL

SEQ ID NO: 25055 - protein, 10 aa, Artificial Sequence
  source: /note="Description of Artificial Sequence: Synthetic peptide"
SAAVSTTPHI

SEQ ID NO: 25056 - protein, 9 aa, Artificial Sequence
  source: /note="Description of Artificial Sequence: Synthetic peptide"
RSPQRGLAL

SEQ ID NO: 25057 - protein, 10 aa, Artificial Sequence
  source: /note="Description of Artificial Sequence: Synthetic peptide"
SVLESRSPQR

SEQ ID NO: 25058 - protein, 10 aa, Artificial Sequence
  source: /note="Description of Artificial Sequence: Synthetic peptide"
LESRSPQRGL

SEQ ID NO: 25059 - protein, 10 aa, Artificial Sequence
  source: /note="Description of Artificial Sequence: Synthetic peptide"
SRSPQRGLAL

SEQ ID NO: 25060 - protein, 9 aa, Artificial Sequence
  source: /note="Description of Artificial Sequence: Synthetic peptide"
LTQDHISFI

SEQ ID NO: 25061 - protein, 9 aa, Artificial Sequence
  source: /note="Description of Artificial Sequence: Synthetic peptide"
CLTQDHISF

SEQ ID NO: 25062 - protein, 9 aa, Artificial Sequence
  source: /note="Description of Artificial Sequence: Synthetic peptide"
TQDHISFII

SEQ ID NO: 25063 - protein, 10 aa, Artificial Sequence
  source: /note="Description of Artificial Sequence: Synthetic peptide"
CLTQDHISFI

SEQ ID NO: 25064 - protein, 10 aa, Artificial Sequence
  source: /note="Description of Artificial Sequence: Synthetic peptide"
LLECLTQDHI

SEQ ID NO: 25065 - protein, 10 aa, Artificial Sequence
  source: /note="Description of Artificial Sequence: Synthetic peptide"
LTQDHISFII

SEQ ID NO: 25066 - protein, 10 aa, Artificial Sequence
  source: /note="Description of Artificial Sequence: Synthetic peptide"
QDHISFIINL

SEQ ID NO: 25067 - protein, 9 aa, Artificial Sequence
  source: /note="Description of Artificial Sequence: Synthetic peptide"
KTSGKICLL

SEQ ID NO: 25068 - protein, 9 aa, Artificial Sequence
  source: /note="Description of Artificial Sequence: Synthetic peptide"
CLLMRREQV

SEQ ID NO: 25069 - protein, 9 aa, Artificial Sequence
  source: /note="Description of Artificial Sequence: Synthetic peptide"
SGKICLLMR

SEQ ID NO: 25070 - protein, 9 aa, Artificial Sequence
  source: /note="Description of Artificial Sequence: Synthetic peptide"
HKTSGKICL

SEQ ID NO: 25071 - protein, 10 aa, Artificial Sequence
  source: /note="Description of Artificial Sequence: Synthetic peptide"
TSGKICLLMR

SEQ ID NO: 25072 - protein, 10 aa, Artificial Sequence
  source: /note="Description of Artificial Sequence: Synthetic peptide"
KTSGKICLLM

SEQ ID NO: 25073 - protein, 10 aa, Artificial Sequence
  source: /note="Description of Artificial Sequence: Synthetic peptide"
SGKICLLMRR

SEQ ID NO: 25074 - protein, 10 aa, Artificial Sequence
  source: /note="Description of Artificial Sequence: Synthetic peptide"
CLLMRREQVL

SEQ ID NO: 25075 - protein, 10 aa, Artificial Sequence
  source: /note="Description of Artificial Sequence: Synthetic peptide"
RHKTSGKICL

SEQ ID NO: 25076 - protein, 10 aa, Artificial Sequence
  source: /note="Description of Artificial Sequence: Synthetic peptide"
HKTSGKICLL

SEQ ID NO: 25077 - protein, 9 aa, Artificial Sequence
  source: /note="Description of Artificial Sequence: Synthetic peptide"
CLWEKVEVI

SEQ ID NO: 25078 - protein, 9 aa, Artificial Sequence
  source: /note="Description of Artificial Sequence: Synthetic peptide"
TARKCLWEK

SEQ ID NO: 25079 - protein, 9 aa, Artificial Sequence
  source: /note="Description of Artificial Sequence: Synthetic peptide"
KATARKCLW

SEQ ID NO: 25080 - protein, 10 aa, Artificial Sequence
  source: /note="Description of Artificial Sequence: Synthetic peptide"
ATARKCLWEK

SEQ ID NO: 25081 - protein, 9 aa, Artificial Sequence
  source: /note="Description of Artificial Sequence: Synthetic peptide"
YVEYFWWPM

SEQ ID NO: 25082 - protein, 9 aa, Artificial Sequence
  source: /note="Description of Artificial Sequence: Synthetic peptide"
SFKYVEYFW

SEQ ID NO: 25083 - protein, 9 aa, Artificial Sequence
  source: /note="Description of Artificial Sequence: Synthetic peptide"
KYVEYFWWP

SEQ ID NO: 25084 - protein, 9 aa, Artificial Sequence
  source: /note="Description of Artificial Sequence: Synthetic peptide"
EYFWWPMLL

SEQ ID NO: 25085 - protein, 9 aa, Artificial Sequence
  source: /note="Description of Artificial Sequence: Synthetic peptide"
FWWPMLLNM

SEQ ID NO: 25086 - protein, 9 aa, Artificial Sequence
  source: /note="Description of Artificial Sequence: Synthetic peptide"
FKYVEYFWW

SEQ ID NO: 25087 - protein, 9 aa, Artificial Sequence
  source: /note="Description of Artificial Sequence: Synthetic peptide"
VEYFWWPML

SEQ ID NO: 25088 - protein, 10 aa, Artificial Sequence
  source: /note="Description of Artificial Sequence: Synthetic peptide"
YVEYFWWPML

SEQ ID NO: 25089 - protein, 10 aa, Artificial Sequence
  source: /note="Description of Artificial Sequence: Synthetic peptide"
SFKYVEYFWW

SEQ ID NO: 25090 - protein, 10 aa, Artificial Sequence
  source: /note="Description of Artificial Sequence: Synthetic peptide"
KYVEYFWWPM

SEQ ID NO: 25091 - protein, 10 aa, Artificial Sequence
  source: /note="Description of Artificial Sequence: Synthetic peptide"
VEYFWWPMLL

SEQ ID NO: 25092 - protein, 10 aa, Artificial Sequence
  source: /note="Description of Artificial Sequence: Synthetic peptide"
YFWWPMLLNM

SEQ ID NO: 25093 - protein, 10 aa, Artificial Sequence
  source: /note="Description of Artificial Sequence: Synthetic peptide"
FWWPMLLNMR

SEQ ID NO: 25094 - protein, 10 aa, Artificial Sequence
  source: /note="Description of Artificial Sequence: Synthetic peptide"
TSFKYVEYFW

SEQ ID NO: 25095 - protein, 9 aa, Artificial Sequence
  source: /note="Description of Artificial Sequence: Synthetic peptide"
ISALGKILK

SEQ ID NO: 25096 - protein, 9 aa, Artificial Sequence
  source: /note="Description of Artificial Sequence: Synthetic peptide"
ALGKILKFK

SEQ ID NO: 25097 - protein, 9 aa, Artificial Sequence
  source: /note="Description of Artificial Sequence: Synthetic peptide"
SALGKILKF

SEQ ID NO: 25098 - protein, 9 aa, Artificial Sequence
  source: /note="Description of Artificial Sequence: Synthetic peptide"
TENCISALG

SEQ ID NO: 25099 - protein, 10 aa, Artificial Sequence
  source: /note="Description of Artificial Sequence: Synthetic peptide"
CISALGKILK

SEQ ID NO: 25100 - protein, 10 aa, Artificial Sequence
  source: /note="Description of Artificial Sequence: Synthetic peptide"
SALGKILKFK

SEQ ID NO: 25101 - protein, 10 aa, Artificial Sequence
  source: /note="Description of Artificial Sequence: Synthetic peptide"
IATENCISAL

SEQ ID NO: 25102 - protein, 10 aa, Artificial Sequence
  source: /note="Description of Artificial Sequence: Synthetic peptide"
ISALGKILKF

SEQ ID NO: 25103 - protein, 9 aa, Artificial Sequence
  source: /note="Description of Artificial Sequence: Synthetic peptide"
KSYLEVISK

SEQ ID NO: 25104 - protein, 9 aa, Artificial Sequence
  source: /note="Description of Artificial Sequence: Synthetic peptide"
SYLEVISKM

SEQ ID NO: 25105 - protein, 9 aa, Artificial Sequence
  source: /note="Description of Artificial Sequence: Synthetic peptide"
RNHKSYLEV

SEQ ID NO: 25106 - protein, 10 aa, Artificial Sequence
  source: /note="Description of Artificial Sequence: Synthetic peptide"
KSYLEVISKM

SEQ ID NO: 25107 - protein, 10 aa, Artificial Sequence
  source: /note="Description of Artificial Sequence: Synthetic peptide"
SYLEVISKMK

SEQ ID NO: 25108 - protein, 10 aa, Artificial Sequence
  source: /note="Description of Artificial Sequence: Synthetic peptide"
RNHKSYLEVI

SEQ ID NO: 25109 - protein, 9 aa, Artificial Sequence
  source: /note="Description of Artificial Sequence: Synthetic peptide"
MACGFCRAI

SEQ ID NO: 25110 - protein, 9 aa, Artificial Sequence
  source: /note="Description of Artificial Sequence: Synthetic peptide"
RTSHLRLSK

SEQ ID NO: 25111 - protein, 9 aa, Artificial Sequence
  source: /note="Description of Artificial Sequence: Synthetic peptide"
TSHLRLSKA

SEQ ID NO: 25112 - protein, 9 aa, Artificial Sequence
  source: /note="Description of Artificial Sequence: Synthetic peptide"
SHLRLSKAL

SEQ ID NO: 25113 - protein, 9 aa, Artificial Sequence
  source: /note="Description of Artificial Sequence: Synthetic peptide"
HLRLSKALW

SEQ ID NO: 25114 - protein, 10 aa, Artificial Sequence
  source: /note="Description of Artificial Sequence: Synthetic peptide"
RTSHLRLSKA

SEQ ID NO: 25115 - protein, 10 aa, Artificial Sequence
  source: /note="Description of Artificial Sequence: Synthetic peptide"
HLRLSKALWG

SEQ ID NO: 25116 - protein, 10 aa, Artificial Sequence
  source: /note="Description of Artificial Sequence: Synthetic peptide"
KESRTSHLRL

SEQ ID NO: 25117 - protein, 10 aa, Artificial Sequence
  source: /note="Description of Artificial Sequence: Synthetic peptide"
SHLRLSKALW

SEQ ID NO: 25118 - protein, 9 aa, Artificial Sequence
  source: /note="Description of Artificial Sequence: Synthetic peptide"
SYRTKPPTS

SEQ ID NO: 25119 - protein, 9 aa, Artificial Sequence
  source: /note="Description of Artificial Sequence: Synthetic peptide"
RTKPPTSIH

SEQ ID NO: 25120 - protein, 9 aa, Artificial Sequence
  source: /note="Description of Artificial Sequence: Synthetic peptide"
YRTKPPTSI

SEQ ID NO: 25121 - protein, 10 aa, Artificial Sequence
  source: /note="Description of Artificial Sequence: Synthetic peptide"
SYRTKPPTSI

SEQ ID NO: 25122 - protein, 10 aa, Artificial Sequence
  source: /note="Description of Artificial Sequence: Synthetic peptide"
RTKPPTSIHR

SEQ ID NO: 25123 - protein, 10 aa, Artificial Sequence
  source: /note="Description of Artificial Sequence: Synthetic peptide"
TSIHRELLGV

SEQ ID NO: 25124 - protein, 10 aa, Artificial Sequence
  source: /note="Description of Artificial Sequence: Synthetic peptide"
KPPTSIHREL

SEQ ID NO: 25125 - protein, 9 aa, Artificial Sequence
  source: /note="Description of Artificial Sequence: Synthetic peptide"
RLLGCLARL

SEQ ID NO: 25126 - protein, 9 aa, Artificial Sequence
  source: /note="Description of Artificial Sequence: Synthetic peptide"
HLPRLLGCL

SEQ ID NO: 25127 - protein, 9 aa, Artificial Sequence
  source: /note="Description of Artificial Sequence: Synthetic peptide"
LLGCLARLI

SEQ ID NO: 25128 - protein, 9 aa, Artificial Sequence
  source: /note="Description of Artificial Sequence: Synthetic peptide"
CLARLIKEA

SEQ ID NO: 25129 - protein, 9 aa, Artificial Sequence
  source: /note="Description of Artificial Sequence: Synthetic peptide"
LPRLLGCLA

SEQ ID NO: 25130 - protein, 10 aa, Artificial Sequence
  source: /note="Description of Artificial Sequence: Synthetic peptide"
RLLGCLARLI

SEQ ID NO: 25131 - protein, 10 aa, Artificial Sequence
  source: /note="Description of Artificial Sequence: Synthetic peptide"
CLARLIKEAV

SEQ ID NO: 25132 - protein, 10 aa, Artificial Sequence
  source: /note="Description of Artificial Sequence: Synthetic peptide"
HLPRLLGCLA

SEQ ID NO: 25133 - protein, 10 aa, Artificial Sequence
  source: /note="Description of Artificial Sequence: Synthetic peptide"
LLGCLARLIK

SEQ ID NO: 25134 - protein, 9 aa, Artificial Sequence
  source: /note="Description of Artificial Sequence: Synthetic peptide"
KKFILKIKI

SEQ ID NO: 25135 - protein, 10 aa, Artificial Sequence
  source: /note="Description of Artificial Sequence: Synthetic peptide"
DTKKFILKIK

SEQ ID NO: 25136 - protein, 10 aa, Artificial Sequence
  source: /note="Description of Artificial Sequence: Synthetic peptide"
VENLNDTKKF

SEQ ID NO: 25137 - protein, 9 aa, Artificial Sequence
  source: /note="Description of Artificial Sequence: Synthetic peptide"
QVQWSPHNK

SEQ ID NO: 25138 - protein, 9 aa, Artificial Sequence
  source: /note="Description of Artificial Sequence: Synthetic peptide"
SPHNKTILA

SEQ ID NO: 25139 - protein, 9 aa, Artificial Sequence
  source: /note="Description of Artificial Sequence: Synthetic peptide"
VQWSPHNKT

SEQ ID NO: 25140 - protein, 10 aa, Artificial Sequence
  source: /note="Description of Artificial Sequence: Synthetic peptide"
FQVQWSPHNK

SEQ ID NO: 25141 - protein, 10 aa, Artificial Sequence
  source: /note="Description of Artificial Sequence: Synthetic peptide"
SPHNKTILAS

SEQ ID NO: 25142 - protein, 10 aa, Artificial Sequence
  source: /note="Description of Artificial Sequence: Synthetic peptide"
VQWSPHNKTI

SEQ ID NO: 25143 - protein, 9 aa, Artificial Sequence
  source: /note="Description of Artificial Sequence: Synthetic peptide"
LVDAHTAKV

SEQ ID NO: 25144 - protein, 9 aa, Artificial Sequence
  source: /note="Description of Artificial Sequence: Synthetic peptide"
HLVDAHTAK

SEQ ID NO: 25145 - protein, 9 aa, Artificial Sequence
  source: /note="Description of Artificial Sequence: Synthetic peptide"
HTAKVNCLS

SEQ ID NO: 25146 - protein, 9 aa, Artificial Sequence
  source: /note="Description of Artificial Sequence: Synthetic peptide"
TAKVNCLSF

SEQ ID NO: 25147 - protein, 10 aa, Artificial Sequence
  source: /note="Description of Artificial Sequence: Synthetic peptide"
HLVDAHTAKV

SEQ ID NO: 25148 - protein, 10 aa, Artificial Sequence
  source: /note="Description of Artificial Sequence: Synthetic peptide"
KVNCLSFNPY

SEQ ID NO: 25149 - protein, 10 aa, Artificial Sequence
  source: /note="Description of Artificial Sequence: Synthetic peptide"
HTAKVNCLSF

SEQ ID NO: 25150 - protein, 9 aa, Artificial Sequence
  source: /note="Description of Artificial Sequence: Synthetic peptide"
KLHTFKSHK

SEQ ID NO: 25151 - protein, 9 aa, Artificial Sequence
  source: /note="Description of Artificial Sequence: Synthetic peptide"
KLKLHTFKS

SEQ ID NO: 25152 - protein, 9 aa, Artificial Sequence
  source: /note="Description of Artificial Sequence: Synthetic peptide"
LKLHTFKSH

SEQ ID NO: 25153 - protein, 9 aa, Artificial Sequence
  source: /note="Description of Artificial Sequence: Synthetic peptide"
FKSHKDEIF

SEQ ID NO: 25154 - protein, 10 aa, Artificial Sequence
  source: /note="Description of Artificial Sequence: Synthetic peptide"
NLKLKLHTFK

SEQ ID NO: 25155 - protein, 10 aa, Artificial Sequence
  source: /note="Description of Artificial Sequence: Synthetic peptide"
KLKLHTFKSH

SEQ ID NO: 25156 - protein, 10 aa, Artificial Sequence
  source: /note="Description of Artificial Sequence: Synthetic peptide"
KSHKDEIFQV

SEQ ID NO: 25157 - protein, 10 aa, Artificial Sequence
  source: /note="Description of Artificial Sequence: Synthetic peptide"
HTFKSHKDEI

SEQ ID NO: 25158 - protein, 9 aa, Artificial Sequence
  source: /note="Description of Artificial Sequence: Synthetic peptide"
ATFRGAHLR

SEQ ID NO: 25159 - protein, 9 aa, Artificial Sequence
  source: /note="Description of Artificial Sequence: Synthetic peptide"
AATTAATFR

SEQ ID NO: 25160 - protein, 9 aa, Artificial Sequence
  source: /note="Description of Artificial Sequence: Synthetic peptide"
TTAATFRGA

SEQ ID NO: 25161 - protein, 9 aa, Artificial Sequence
  source: /note="Description of Artificial Sequence: Synthetic peptide"
TAATTAATF

SEQ ID NO: 25162 - protein, 10 aa, Artificial Sequence
  source: /note="Description of Artificial Sequence: Synthetic peptide"
TAATTAATFR

SEQ ID NO: 25163 - protein, 10 aa, Artificial Sequence
  source: /note="Description of Artificial Sequence: Synthetic peptide"
TFRGAHLRGR

SEQ ID NO: 25164 - protein, 10 aa, Artificial Sequence
  source: /note="Description of Artificial Sequence: Synthetic peptide"
AATFRGAHLR

SEQ ID NO: 25165 - protein, 10 aa, Artificial Sequence
  source: /note="Description of Artificial Sequence: Synthetic peptide"
YPTAATTAAT

SEQ ID NO: 25166 - protein, 10 aa, Artificial Sequence
  source: /note="Description of Artificial Sequence: Synthetic peptide"
PTAATTAATF

SEQ ID NO: 25167 - protein, 9 aa, Artificial Sequence
  source: /note="Description of Artificial Sequence: Synthetic peptide"
SLIKFFNKM

SEQ ID NO: 25168 - protein, 9 aa, Artificial Sequence
  source: /note="Description of Artificial Sequence: Synthetic peptide"
QSLIKFFNK

SEQ ID NO: 25169 - protein, 9 aa, Artificial Sequence
  source: /note="Description of Artificial Sequence: Synthetic peptide"
LIKFFNKMK

SEQ ID NO: 25170 - protein, 9 aa, Artificial Sequence
  source: /note="Description of Artificial Sequence: Synthetic peptide"
KFFNKMKKW

SEQ ID NO: 25171 - protein, 9 aa, Artificial Sequence
  source: /note="Description of Artificial Sequence: Synthetic peptide"
CSEQSLIKF

SEQ ID NO: 25172 - protein, 9 aa, Artificial Sequence
  source: /note="Description of Artificial Sequence: Synthetic peptide"
SEQSLIKFF

SEQ ID NO: 25173 - protein, 10 aa, Artificial Sequence
  source: /note="Description of Artificial Sequence: Synthetic peptide"
SLIKFFNKMK

SEQ ID NO: 25174 - protein, 10 aa, Artificial Sequence
  source: /note="Description of Artificial Sequence: Synthetic peptide"
LIKFFNKMKK

SEQ ID NO: 25175 - protein, 10 aa, Artificial Sequence
  source: /note="Description of Artificial Sequence: Synthetic peptide"
EQSLIKFFNK

SEQ ID NO: 25176 - protein, 10 aa, Artificial Sequence
  source: /note="Description of Artificial Sequence: Synthetic peptide"
KCSEQSLIKF

SEQ ID NO: 25177 - protein, 10 aa, Artificial Sequence
  source: /note="Description of Artificial Sequence: Synthetic peptide"
IKFFNKMKKW

SEQ ID NO: 25178 - protein, 9 aa, Artificial Sequence
  source: /note="Description of Artificial Sequence: Synthetic peptide"
GAAATAAAV

SEQ ID NO: 25179 - protein, 9 aa, Artificial Sequence
  source: /note="Description of Artificial Sequence: Synthetic peptide"
ATAAAVTAA

SEQ ID NO: 25180 - protein, 9 aa, Artificial Sequence
  source: /note="Description of Artificial Sequence: Synthetic peptide"
TAAAVTAAS

SEQ ID NO: 25181 - protein, 10 aa, Artificial Sequence
  source: /note="Description of Artificial Sequence: Synthetic peptide"
SGAAATAAAV

SEQ ID NO: 25182 - protein, 10 aa, Artificial Sequence
  source: /note="Description of Artificial Sequence: Synthetic peptide"
TAAAVTAAST

SEQ ID NO: 25183 - protein, 9 aa, Artificial Sequence
  source: /note="Description of Artificial Sequence: Synthetic peptide"
KSWQGRILW

SEQ ID NO: 25184 - protein, 9 aa, Artificial Sequence
  source: /note="Description of Artificial Sequence: Synthetic peptide"
WENEEEEDL

SEQ ID NO: 25185 - protein, 10 aa, Artificial Sequence
  source: /note="Description of Artificial Sequence: Synthetic peptide"
TKSWQGRILW

SEQ ID NO: 25186 - protein, 9 aa, Artificial Sequence
  source: /note="Description of Artificial Sequence: Synthetic peptide"
SVKERLGAV

SEQ ID NO: 25187 - protein, 9 aa, Artificial Sequence
  source: /note="Description of Artificial Sequence: Synthetic peptide"
KERLGAVPS

SEQ ID NO: 25188 - protein, 9 aa, Artificial Sequence
  source: /note="Description of Artificial Sequence: Synthetic peptide"
LGAVPSSTI

SEQ ID NO: 25189 - protein, 10 aa, Artificial Sequence
  source: /note="Description of Artificial Sequence: Synthetic peptide"
RLGAVPSSTI

SEQ ID NO: 25190 - protein, 10 aa, Artificial Sequence
  source: /note="Description of Artificial Sequence: Synthetic peptide"
KERLGAVPSS

SEQ ID NO: 25191 - protein, 9 aa, Artificial Sequence
  source: /note="Description of Artificial Sequence: Synthetic peptide"
LGITGRLQL

SEQ ID NO: 25192 - protein, 10 aa, Artificial Sequence
  source: /note="Description of Artificial Sequence: Synthetic peptide"
ITGRLQLMAR

SEQ ID NO: 25193 - protein, 10 aa, Artificial Sequence
  source: /note="Description of Artificial Sequence: Synthetic peptide"
LERTGIDLGI

SEQ ID NO: 25194 - protein, 10 aa, Artificial Sequence
  source: /note="Description of Artificial Sequence: Synthetic peptide"
LGITGRLQLM

SEQ ID NO: 25195 - protein, 10 aa, Artificial Sequence
  source: /note="Description of Artificial Sequence: Synthetic peptide"
ASAAAAAAAV

SEQ ID NO: 25196 - protein, 10 aa, Artificial Sequence
  source: /note="Description of Artificial Sequence: Synthetic peptide"
SAAAAAAAVI

SEQ ID NO: 25197 - protein, 9 aa, Artificial Sequence
  source: /note="Description of Artificial Sequence: Synthetic peptide"
VIVEGLEPY

SEQ ID NO: 25198 - protein, 10 aa, Artificial Sequence
  source: /note="Description of Artificial Sequence: Synthetic peptide"
VIVEGLEPYV

SEQ ID NO: 25199 - protein, 10 aa, Artificial Sequence
  source: /note="Description of Artificial Sequence: Synthetic peptide"
EVIVEGLEPY

SEQ ID NO: 25200 - protein, 9 aa, Artificial Sequence
  source: /note="Description of Artificial Sequence: Synthetic peptide"
FRGGRFFVF

SEQ ID NO: 25201 - protein, 9 aa, Artificial Sequence
  source: /note="Description of Artificial Sequence: Synthetic peptide"
HDFRGGRFF

SEQ ID NO: 25202 - protein, 10 aa, Artificial Sequence
  source: /note="Description of Artificial Sequence: Synthetic peptide"
DFRGGRFFVF

SEQ ID NO: 25203 - protein, 10 aa, Artificial Sequence
  source: /note="Description of Artificial Sequence: Synthetic peptide"
HDFRGGRFFV

SEQ ID NO: 25204 - protein, 9 aa, Artificial Sequence
  source: /note="Description of Artificial Sequence: Synthetic peptide"
FMKHQLKIV

SEQ ID NO: 25205 - protein, 9 aa, Artificial Sequence
  source: /note="Description of Artificial Sequence: Synthetic peptide"
QLKIVLRGV

SEQ ID NO: 25206 - protein, 9 aa, Artificial Sequence
  source: /note="Description of Artificial Sequence: Synthetic peptide"
PFMKHQLKI

SEQ ID NO: 25207 - protein, 9 aa, Artificial Sequence
  source: /note="Description of Artificial Sequence: Synthetic peptide"
APFMKHQLK

SEQ ID NO: 25208 - protein, 9 aa, Artificial Sequence
  source: /note="Description of Artificial Sequence: Synthetic peptide"
MKHQLKIVL

SEQ ID NO: 25209 - protein, 10 aa, Artificial Sequence
  source: /note="Description of Artificial Sequence: Synthetic peptide"
CLAPFMKHQL

SEQ ID NO: 25210 - protein, 10 aa, Artificial Sequence
  source: /note="Description of Artificial Sequence: Synthetic peptide"
HQLKIVLRGV

SEQ ID NO: 25211 - protein, 10 aa, Artificial Sequence
  source: /note="Description of Artificial Sequence: Synthetic peptide"
FMKHQLKIVL

SEQ ID NO: 25212 - protein, 10 aa, Artificial Sequence
  source: /note="Description of Artificial Sequence: Synthetic peptide"
LAPFMKHQLK

SEQ ID NO: 25213 - protein, 10 aa, Artificial Sequence
  source: /note="Description of Artificial Sequence: Synthetic peptide"
APFMKHQLKI

SEQ ID NO: 25214 - protein, 9 aa, Artificial Sequence
  source: /note="Description of Artificial Sequence: Synthetic peptide"
KLLVQVSMA

SEQ ID NO: 25215 - protein, 9 aa, Artificial Sequence
  source: /note="Description of Artificial Sequence: Synthetic peptide"
LVQVSMAEF

SEQ ID NO: 25216 - protein, 9 aa, Artificial Sequence
  source: /note="Description of Artificial Sequence: Synthetic peptide"
TEFEGKLLV

SEQ ID NO: 25217 - protein, 9 aa, Artificial Sequence
  source: /note="Description of Artificial Sequence: Synthetic peptide"
GKLLVQVSM

SEQ ID NO: 25218 - protein, 9 aa, Artificial Sequence
  source: /note="Description of Artificial Sequence: Synthetic peptide"
FEGKLLVQV

SEQ ID NO: 25219 - protein, 10 aa, Artificial Sequence
  source: /note="Description of Artificial Sequence: Synthetic peptide"
VTEFEGKLLV

SEQ ID NO: 25220 - protein, 10 aa, Artificial Sequence
  source: /note="Description of Artificial Sequence: Synthetic peptide"
LLVQVSMAEF

SEQ ID NO: 25221 - protein, 10 aa, Artificial Sequence
  source: /note="Description of Artificial Sequence: Synthetic peptide"
VQVSMAEFPG

SEQ ID NO: 25222 - protein, 10 aa, Artificial Sequence
  source: /note="Description of Artificial Sequence: Synthetic peptide"
TEFEGKLLVQ

SEQ ID NO: 25223 - protein, 10 aa, Artificial Sequence
  source: /note="Description of Artificial Sequence: Synthetic peptide"
FEGKLLVQVS

SEQ ID NO: 25224 - protein, 9 aa, Artificial Sequence
  source: /note="Description of Artificial Sequence: Synthetic peptide"
ETLVDADLY

SEQ ID NO: 25225 - protein, 9 aa, Artificial Sequence
  source: /note="Description of Artificial Sequence: Synthetic peptide"
YFNEDPETL

SEQ ID NO: 25226 - protein, 10 aa, Artificial Sequence
  source: /note="Description of Artificial Sequence: Synthetic peptide"
YYFNEDPETL

SEQ ID NO: 25227 - protein, 9 aa, Artificial Sequence
  source: /note="Description of Artificial Sequence: Synthetic peptide"
CQNINSGNL

SEQ ID NO: 25228 - protein, 10 aa, Artificial Sequence
  source: /note="Description of Artificial Sequence: Synthetic peptide"
NINSGNLVSV

SEQ ID NO: 25229 - protein, 10 aa, Artificial Sequence
  source: /note="Description of Artificial Sequence: Synthetic peptide"
CQNINSGNLV

SEQ ID NO: 25230 - protein, 10 aa, Artificial Sequence
  source: /note="Description of Artificial Sequence: Synthetic peptide"
INSGNLVSVL

SEQ ID NO: 25231 - protein, 9 aa, Artificial Sequence
  source: /note="Description of Artificial Sequence: Synthetic peptide"
SLLRSTAFL

SEQ ID NO: 25232 - protein, 9 aa, Artificial Sequence
  source: /note="Description of Artificial Sequence: Synthetic peptide"
LLRSTAFLR

SEQ ID NO: 25233 - protein, 9 aa, Artificial Sequence
  source: /note="Description of Artificial Sequence: Synthetic peptide"
SPGHCASLL

SEQ ID NO: 25234 - protein, 9 aa, Artificial Sequence
  source: /note="Description of Artificial Sequence: Synthetic peptide"
ASLLRSTAF

SEQ ID NO: 25235 - protein, 9 aa, Artificial Sequence
  source: /note="Description of Artificial Sequence: Synthetic peptide"
LRSTAFLRW

SEQ ID NO: 25236 - protein, 10 aa, Artificial Sequence
  source: /note="Description of Artificial Sequence: Synthetic peptide"
SLLRSTAFLR

SEQ ID NO: 25237 - protein, 10 aa, Artificial Sequence
  source: /note="Description of Artificial Sequence: Synthetic peptide"
ASLLRSTAFL

SEQ ID NO: 25238 - protein, 10 aa, Artificial Sequence
  source: /note="Description of Artificial Sequence: Synthetic peptide"
CASLLRSTAF

SEQ ID NO: 25239 - protein, 10 aa, Artificial Sequence
  source: /note="Description of Artificial Sequence: Synthetic peptide"
LLRSTAFLRW

SEQ ID NO: 25240 - protein, 9 aa, Artificial Sequence
  source: /note="Description of Artificial Sequence: Synthetic peptide"
WIDVAMYLY

SEQ ID NO: 25241 - protein, 9 aa, Artificial Sequence
  source: /note="Description of Artificial Sequence: Synthetic peptide"
QWIDVAMYL

SEQ ID NO: 25242 - protein, 9 aa, Artificial Sequence
  source: /note="Description of Artificial Sequence: Synthetic peptide"
WQWIDVAMY

SEQ ID NO: 25243 - protein, 9 aa, Artificial Sequence
  source: /note="Description of Artificial Sequence: Synthetic peptide"
RQQWQWIDV

SEQ ID NO: 25244 - protein, 9 aa, Artificial Sequence
  source: /note="Description of Artificial Sequence: Synthetic peptide"
QQWQWIDVA

SEQ ID NO: 25245 - protein, 9 aa, Artificial Sequence
  source: /note="Description of Artificial Sequence: Synthetic peptide"
QWQWIDVAM

SEQ ID NO: 25246 - protein, 9 aa, Artificial Sequence
  source: /note="Description of Artificial Sequence: Synthetic peptide"
VAMYLYRSW

SEQ ID NO: 25247 - protein, 10 aa, Artificial Sequence
  source: /note="Description of Artificial Sequence: Synthetic peptide"
WQWIDVAMYL

SEQ ID NO: 25248 - protein, 10 aa, Artificial Sequence
  source: /note="Description of Artificial Sequence: Synthetic peptide"
WIDVAMYLYR

SEQ ID NO: 25249 - protein, 10 aa, Artificial Sequence
  source: /note="Description of Artificial Sequence: Synthetic peptide"
QWQWIDVAMY

SEQ ID NO: 25250 - protein, 10 aa, Artificial Sequence
  source: /note="Description of Artificial Sequence: Synthetic peptide"
QWIDVAMYLY

SEQ ID NO: 25251 - protein, 10 aa, Artificial Sequence
  source: /note="Description of Artificial Sequence: Synthetic peptide"
QQWQWIDVAM

SEQ ID NO: 25252 - protein, 10 aa, Artificial Sequence
  source: /note="Description of Artificial Sequence: Synthetic peptide"
RQQWQWIDVA

SEQ ID NO: 25253 - protein, 10 aa, Artificial Sequence
  source: /note="Description of Artificial Sequence: Synthetic peptide"
MPRWGLLLLW

SEQ ID NO: 25254 - protein, 9 aa, Artificial Sequence
  source: /note="Description of Artificial Sequence: Synthetic peptide"
GSNRDHLLM

SEQ ID NO: 25255 - protein, 10 aa, Artificial Sequence
  source: /note="Description of Artificial Sequence: Synthetic peptide"
AGRGPVGSNR

SEQ ID NO: 25256 - protein, 10 aa, Artificial Sequence
  source: /note="Description of Artificial Sequence: Synthetic peptide"
GPVGSNRDHL

SEQ ID NO: 25257 - protein, 9 aa, Artificial Sequence
  source: /note="Description of Artificial Sequence: Synthetic peptide"
SPVKKVPVV

SEQ ID NO: 25258 - protein, 9 aa, Artificial Sequence
  source: /note="Description of Artificial Sequence: Synthetic peptide"
CQSPLTQSP

SEQ ID NO: 25259 - protein, 10 aa, Artificial Sequence
  source: /note="Description of Artificial Sequence: Synthetic peptide"
CQSPLTQSPV

SEQ ID NO: 25260 - protein, 10 aa, Artificial Sequence
  source: /note="Description of Artificial Sequence: Synthetic peptide"
TQSPVKKVPV

SEQ ID NO: 25261 - protein, 9 aa, Artificial Sequence
  source: /note="Description of Artificial Sequence: Synthetic peptide"
TPSKKKNEI

SEQ ID NO: 25262 - protein, 9 aa, Artificial Sequence
  source: /note="Description of Artificial Sequence: Synthetic peptide"
KKKNEISTI

SEQ ID NO: 25263 - protein, 9 aa, Artificial Sequence
  source: /note="Description of Artificial Sequence: Synthetic peptide"
KKNEISTIA

SEQ ID NO: 25264 - protein, 10 aa, Artificial Sequence
  source: /note="Description of Artificial Sequence: Synthetic peptide"
NEISTIASNY

SEQ ID NO: 25265 - protein, 10 aa, Artificial Sequence
  source: /note="Description of Artificial Sequence: Synthetic peptide"
SKKKNEISTI

SEQ ID NO: 25266 - protein, 10 aa, Artificial Sequence
  source: /note="Description of Artificial Sequence: Synthetic peptide"
IMKACNEESR

SEQ ID NO: 25267 - protein, 10 aa, Artificial Sequence
  source: /note="Description of Artificial Sequence: Synthetic peptide"
NEESRSCDIF

SEQ ID NO: 25268 - protein, 9 aa, Artificial Sequence
  source: /note="Description of Artificial Sequence: Synthetic peptide"
RPGLCPPPL

SEQ ID NO: 25269 - protein, 9 aa, Artificial Sequence
  source: /note="Description of Artificial Sequence: Synthetic peptide"
VEQRRRPGL

SEQ ID NO: 25270 - protein, 10 aa, Artificial Sequence
  source: /note="Description of Artificial Sequence: Synthetic peptide"
RRPGLCPPPL

SEQ ID NO: 25271 - protein, 9 aa, Artificial Sequence
  source: /note="Description of Artificial Sequence: Synthetic peptide"
FLLAVQDLK

SEQ ID NO: 25272 - protein, 9 aa, Artificial Sequence
  source: /note="Description of Artificial Sequence: Synthetic peptide"
LLAVQDLKK

SEQ ID NO: 25273 - protein, 9 aa, Artificial Sequence
  source: /note="Description of Artificial Sequence: Synthetic peptide"
RFLLAVQDL

SEQ ID NO: 25274 - protein, 9 aa, Artificial Sequence
  source: /note="Description of Artificial Sequence: Synthetic peptide"
FSSENLRFL

SEQ ID NO: 25275 - protein, 9 aa, Artificial Sequence
  source: /note="Description of Artificial Sequence: Synthetic peptide"
SENLRFLLA

SEQ ID NO: 25276 - protein, 10 aa, Artificial Sequence
  source: /note="Description of Artificial Sequence: Synthetic peptide"
FLLAVQDLKK

SEQ ID NO: 25277 - protein, 10 aa, Artificial Sequence
  source: /note="Description of Artificial Sequence: Synthetic peptide"
RFLLAVQDLK

SEQ ID NO: 25278 - protein, 10 aa, Artificial Sequence
  source: /note="Description of Artificial Sequence: Synthetic peptide"
FSSENLRFLL

SEQ ID NO: 25279 - protein, 10 aa, Artificial Sequence
  source: /note="Description of Artificial Sequence: Synthetic peptide"
SENLRFLLAV

SEQ ID NO: 25280 - protein, 10 aa, Artificial Sequence
  source: /note="Description of Artificial Sequence: Synthetic peptide"
LRFLLAVQDL

SEQ ID NO: 25281 - protein, 9 aa, Artificial Sequence
  source: /note="Description of Artificial Sequence: Synthetic peptide"
CTVKSFLSK

SEQ ID NO: 25282 - protein, 9 aa, Artificial Sequence
  source: /note="Description of Artificial Sequence: Synthetic peptide"
IPICTVKSF

SEQ ID NO: 25283 - protein, 10 aa, Artificial Sequence
  source: /note="Description of Artificial Sequence: Synthetic peptide"
KNGIPICTVK

SEQ ID NO: 25284 - protein, 10 aa, Artificial Sequence
  source: /note="Description of Artificial Sequence: Synthetic peptide"
CTVKSFLSKI

SEQ ID NO: 25285 - protein, 10 aa, Artificial Sequence
  source: /note="Description of Artificial Sequence: Synthetic peptide"
IPICTVKSFL

SEQ ID NO: 25286 - protein, 9 aa, Artificial Sequence
  source: /note="Description of Artificial Sequence: Synthetic peptide"
RSLELGAAF

SEQ ID NO: 25287 - protein, 9 aa, Artificial Sequence
  source: /note="Description of Artificial Sequence: Synthetic peptide"
LEADMRRSL

SEQ ID NO: 25288 - protein, 9 aa, Artificial Sequence
  source: /note="Description of Artificial Sequence: Synthetic peptide"
ADMRRSLEL

SEQ ID NO: 25289 - protein, 10 aa, Artificial Sequence
  source: /note="Description of Artificial Sequence: Synthetic peptide"
SLELGAAFPL

SEQ ID NO: 25290 - protein, 10 aa, Artificial Sequence
  source: /note="Description of Artificial Sequence: Synthetic peptide"
RRSLELGAAF

SEQ ID NO: 25291 - protein, 9 aa, Artificial Sequence
  source: /note="Description of Artificial Sequence: Synthetic peptide"
RLYSICYTH

SEQ ID NO: 25292 - protein, 9 aa, Artificial Sequence
  source: /note="Description of Artificial Sequence: Synthetic peptide"
EYETRLYSI

SEQ ID NO: 25293 - protein, 9 aa, Artificial Sequence
  source: /note="Description of Artificial Sequence: Synthetic peptide"
LYSICYTHI

SEQ ID NO: 25294 - protein, 9 aa, Artificial Sequence
  source: /note="Description of Artificial Sequence: Synthetic peptide"
ETRLYSICY

SEQ ID NO: 25295 - protein, 9 aa, Artificial Sequence
  source: /note="Description of Artificial Sequence: Synthetic peptide"
YETRLYSIC

SEQ ID NO: 25296 - protein, 10 aa, Artificial Sequence
  source: /note="Description of Artificial Sequence: Synthetic peptide"
RLYSICYTHI

SEQ ID NO: 25297 - protein, 10 aa, Artificial Sequence
  source: /note="Description of Artificial Sequence: Synthetic peptide"
SICYTHIGGL

SEQ ID NO: 25298 - protein, 10 aa, Artificial Sequence
  source: /note="Description of Artificial Sequence: Synthetic peptide"
QEYETRLYSI

SEQ ID NO: 25299 - protein, 10 aa, Artificial Sequence
  source: /note="Description of Artificial Sequence: Synthetic peptide"
YETRLYSICY

SEQ ID NO: 25300 - protein, 9 aa, Artificial Sequence
  source: /note="Description of Artificial Sequence: Synthetic peptide"
AVAGPLAGA

SEQ ID NO: 25301 - protein, 9 aa, Artificial Sequence
  source: /note="Description of Artificial Sequence: Synthetic peptide"
GLAAGVPPG

SEQ ID NO: 25302 - protein, 9 aa, Artificial Sequence
  source: /note="Description of Artificial Sequence: Synthetic peptide"
EIPACLSPA

SEQ ID NO: 25303 - protein, 9 aa, Artificial Sequence
  source: /note="Description of Artificial Sequence: Synthetic peptide"
SAAGRPWAV

SEQ ID NO: 25304 - protein, 9 aa, Artificial Sequence
  source: /note="Description of Artificial Sequence: Synthetic peptide"
CSRQLWIHA

SEQ ID NO: 25305 - protein, 9 aa, Artificial Sequence
  source: /note="Description of Artificial Sequence: Synthetic peptide"
WAAGSAAGR

SEQ ID NO: 25306 - protein, 9 aa, Artificial Sequence
  source: /note="Description of Artificial Sequence: Synthetic peptide"
RPWAVQCSR

SEQ ID NO: 25307 - protein, 9 aa, Artificial Sequence
  source: /note="Description of Artificial Sequence: Synthetic peptide"
GPRPGPGPG

SEQ ID NO: 25308 - protein, 9 aa, Artificial Sequence
  source: /note="Description of Artificial Sequence: Synthetic peptide"
RPGPGPGAV

SEQ ID NO: 25309 - protein, 9 aa, Artificial Sequence
  source: /note="Description of Artificial Sequence: Synthetic peptide"
GPGAVAGPL

SEQ ID NO: 25310 - protein, 9 aa, Artificial Sequence
  source: /note="Description of Artificial Sequence: Synthetic peptide"
GPLAGAPAA

SEQ ID NO: 25311 - protein, 9 aa, Artificial Sequence
  source: /note="Description of Artificial Sequence: Synthetic peptide"
GPHGPARPA

SEQ ID NO: 25312 - protein, 9 aa, Artificial Sequence
  source: /note="Description of Artificial Sequence: Synthetic peptide"
APAHCGLAA

SEQ ID NO: 25313 - protein, 9 aa, Artificial Sequence
  source: /note="Description of Artificial Sequence: Synthetic peptide"
SPARPGFWA

SEQ ID NO: 25314 - protein, 9 aa, Artificial Sequence
  source: /note="Description of Artificial Sequence: Synthetic peptide"
CLSPARPGF

SEQ ID NO: 25315 - protein, 9 aa, Artificial Sequence
  source: /note="Description of Artificial Sequence: Synthetic peptide"
AEIPACLSP

SEQ ID NO: 25316 - protein, 9 aa, Artificial Sequence
  source: /note="Description of Artificial Sequence: Synthetic peptide"
GFWAAGSAA

SEQ ID NO: 25317 - protein, 9 aa, Artificial Sequence
  source: /note="Description of Artificial Sequence: Synthetic peptide"
AGSAAGRPW

SEQ ID NO: 25318 - protein, 9 aa, Artificial Sequence
  source: /note="Description of Artificial Sequence: Synthetic peptide"
WAVQCSRQL

SEQ ID NO: 25319 - protein, 9 aa, Artificial Sequence
  source: /note="Description of Artificial Sequence: Synthetic peptide"
VQCSRQLWI

SEQ ID NO: 25320 - protein, 9 aa, Artificial Sequence
  source: /note="Description of Artificial Sequence: Synthetic peptide"
RQLWIHACP

SEQ ID NO: 25321 - protein, 10 aa, Artificial Sequence
  source: /note="Description of Artificial Sequence: Synthetic peptide"
WIHACPPGHA

SEQ ID NO: 25322 - protein, 10 aa, Artificial Sequence
  source: /note="Description of Artificial Sequence: Synthetic peptide"
TLWLVGAGPR

SEQ ID NO: 25323 - protein, 10 aa, Artificial Sequence
  source: /note="Description of Artificial Sequence: Synthetic peptide"
EIPACLSPAR

SEQ ID NO: 25324 - protein, 10 aa, Artificial Sequence
  source: /note="Description of Artificial Sequence: Synthetic peptide"
FWAAGSAAGR

SEQ ID NO: 25325 - protein, 10 aa, Artificial Sequence
  source: /note="Description of Artificial Sequence: Synthetic peptide"
EPAAPAHCGL

SEQ ID NO: 25326 - protein, 10 aa, Artificial Sequence
  source: /note="Description of Artificial Sequence: Synthetic peptide"
GPRPGPGPGA

SEQ ID NO: 25327 - protein, 10 aa, Artificial Sequence
  source: /note="Description of Artificial Sequence: Synthetic peptide"
RPGPGPGAVA

SEQ ID NO: 25328 - protein, 10 aa, Artificial Sequence
  source: /note="Description of Artificial Sequence: Synthetic peptide"
GPARPAPEPA

SEQ ID NO: 25329 - protein, 10 aa, Artificial Sequence
  source: /note="Description of Artificial Sequence: Synthetic peptide"
RPAPEPAAPA

SEQ ID NO: 25330 - protein, 10 aa, Artificial Sequence
  source: /note="Description of Artificial Sequence: Synthetic peptide"
SPARPGFWAA

SEQ ID NO: 25331 - protein, 10 aa, Artificial Sequence
  source: /note="Description of Artificial Sequence: Synthetic peptide"
RPGFWAAGSA

SEQ ID NO: 25332 - protein, 10 aa, Artificial Sequence
  source: /note="Description of Artificial Sequence: Synthetic peptide"
AEIPACLSPA

SEQ ID NO: 25333 - protein, 10 aa, Artificial Sequence
  source: /note="Description of Artificial Sequence: Synthetic peptide"
ACLSPARPGF

SEQ ID NO: 25334 - protein, 10 aa, Artificial Sequence
  source: /note="Description of Artificial Sequence: Synthetic peptide"
AAGSAAGRPW

SEQ ID NO: 25335 - protein, 10 aa, Artificial Sequence
  source: /note="Description of Artificial Sequence: Synthetic peptide"
WAVQCSRQLW

SEQ ID NO: 25336 - protein, 10 aa, Artificial Sequence
  source: /note="Description of Artificial Sequence: Synthetic peptide"
RQLWIHACPP

SEQ ID NO: 25337 - protein, 10 aa, Artificial Sequence
  source: /note="Description of Artificial Sequence: Synthetic peptide"
HACPPGHAGW

SEQ ID NO: 25338 - protein, 9 aa, Artificial Sequence
  source: /note="Description of Artificial Sequence: Synthetic peptide"
FVDSNDPTI

SEQ ID NO: 25339 - protein, 10 aa, Artificial Sequence
  source: /note="Description of Artificial Sequence: Synthetic peptide"
GQFVDSNDPT

SEQ ID NO: 25340 - protein, 10 aa, Artificial Sequence
  source: /note="Description of Artificial Sequence: Synthetic peptide"
SNDPTIENTF

SEQ ID NO: 25341 - protein, 9 aa, Artificial Sequence
  source: /note="Description of Artificial Sequence: Synthetic peptide"
VFQNYVADI

SEQ ID NO: 25342 - protein, 9 aa, Artificial Sequence
  source: /note="Description of Artificial Sequence: Synthetic peptide"
YVPTVFQNY

SEQ ID NO: 25343 - protein, 9 aa, Artificial Sequence
  source: /note="Description of Artificial Sequence: Synthetic peptide"
VPTVFQNYV

SEQ ID NO: 25344 - protein, 10 aa, Artificial Sequence
  source: /note="Description of Artificial Sequence: Synthetic peptide"
YVPTVFQNYV

SEQ ID NO: 25345 - protein, 10 aa, Artificial Sequence
  source: /note="Description of Artificial Sequence: Synthetic peptide"
FQNYVADIEV

SEQ ID NO: 25346 - protein, 10 aa, Artificial Sequence
  source: /note="Description of Artificial Sequence: Synthetic peptide"
VYVPTVFQNY

SEQ ID NO: 25347 - protein, 10 aa, Artificial Sequence
  source: /note="Description of Artificial Sequence: Synthetic peptide"
TVFQNYVADI

SEQ ID NO: 25348 - protein, 10 aa, Artificial Sequence
  source: /note="Description of Artificial Sequence: Synthetic peptide"
VPTVFQNYVA

SEQ ID NO: 25349 - protein, 9 aa, Artificial Sequence
  source: /note="Description of Artificial Sequence: Synthetic peptide"
VPTVFENCV

SEQ ID NO: 25350 - protein, 10 aa, Artificial Sequence
  source: /note="Description of Artificial Sequence: Synthetic peptide"
YVPTVFENCV

SEQ ID NO: 25351 - protein, 10 aa, Artificial Sequence
  source: /note="Description of Artificial Sequence: Synthetic peptide"
TVFENCVADI

SEQ ID NO: 25352 - protein, 10 aa, Artificial Sequence
  source: /note="Description of Artificial Sequence: Synthetic peptide"
CVADIEVDGK

SEQ ID NO: 25353 - protein, 10 aa, Artificial Sequence
  source: /note="Description of Artificial Sequence: Synthetic peptide"
VYVPTVFENC

SEQ ID NO: 25354 - protein, 10 aa, Artificial Sequence
  source: /note="Description of Artificial Sequence: Synthetic peptide"
FENCVADIEV

SEQ ID NO: 25355 - protein, 9 aa, Artificial Sequence
  source: /note="Description of Artificial Sequence: Synthetic peptide"
FMNQEIMKA

SEQ ID NO: 25356 - protein, 9 aa, Artificial Sequence
  source: /note="Description of Artificial Sequence: Synthetic peptide"
IMKAFHVRK

SEQ ID NO: 25357 - protein, 9 aa, Artificial Sequence
  source: /note="Description of Artificial Sequence: Synthetic peptide"
AFMNQEIMK

SEQ ID NO: 25358 - protein, 9 aa, Artificial Sequence
  source: /note="Description of Artificial Sequence: Synthetic peptide"
EIMKAFHVR

SEQ ID NO: 25359 - protein, 9 aa, Artificial Sequence
  source: /note="Description of Artificial Sequence: Synthetic peptide"
MNQEIMKAF

SEQ ID NO: 25360 - protein, 9 aa, Artificial Sequence
  source: /note="Description of Artificial Sequence: Synthetic peptide"
MKAFHVRKA

SEQ ID NO: 25361 - protein, 9 aa, Artificial Sequence
  source: /note="Description of Artificial Sequence: Synthetic peptide"
EAFMNQEIM

SEQ ID NO: 25362 - protein, 9 aa, Artificial Sequence
  source: /note="Description of Artificial Sequence: Synthetic peptide"
QEIMKAFHV

SEQ ID NO: 25363 - protein, 10 aa, Artificial Sequence
  source: /note="Description of Artificial Sequence: Synthetic peptide"
FMNQEIMKAF

SEQ ID NO: 25364 - protein, 10 aa, Artificial Sequence
  source: /note="Description of Artificial Sequence: Synthetic peptide"
IMKAFHVRKA

SEQ ID NO: 25365 - protein, 10 aa, Artificial Sequence
  source: /note="Description of Artificial Sequence: Synthetic peptide"
EAFMNQEIMK

SEQ ID NO: 25366 - protein, 10 aa, Artificial Sequence
  source: /note="Description of Artificial Sequence: Synthetic peptide"
EIMKAFHVRK

SEQ ID NO: 25367 - protein, 10 aa, Artificial Sequence
  source: /note="Description of Artificial Sequence: Synthetic peptide"
KEAFMNQEIM

SEQ ID NO: 25368 - protein, 9 aa, Artificial Sequence
  source: /note="Description of Artificial Sequence: Synthetic peptide"
QMRLELSFV

SEQ ID NO: 25369 - protein, 9 aa, Artificial Sequence
  source: /note="Description of Artificial Sequence: Synthetic peptide"
KVREQMRLE

SEQ ID NO: 25370 - protein, 9 aa, Artificial Sequence
  source: /note="Description of Artificial Sequence: Synthetic peptide"
NSKVREQMR

SEQ ID NO: 25371 - protein, 9 aa, Artificial Sequence
  source: /note="Description of Artificial Sequence: Synthetic peptide"
EQMRLELSF

SEQ ID NO: 25372 - protein, 9 aa, Artificial Sequence
  source: /note="Description of Artificial Sequence: Synthetic peptide"
SKVREQMRL

SEQ ID NO: 25373 - protein, 9 aa, Artificial Sequence
  source: /note="Description of Artificial Sequence: Synthetic peptide"
VREQMRLEL

SEQ ID NO: 25374 - protein, 9 aa, Artificial Sequence
  source: /note="Description of Artificial Sequence: Synthetic peptide"
REQMRLELS

SEQ ID NO: 25375 - protein, 10 aa, Artificial Sequence
  source: /note="Description of Artificial Sequence: Synthetic peptide"
EQMRLELSFV

SEQ ID NO: 25376 - protein, 10 aa, Artificial Sequence
  source: /note="Description of Artificial Sequence: Synthetic peptide"
KVREQMRLEL

SEQ ID NO: 25377 - protein, 10 aa, Artificial Sequence
  source: /note="Description of Artificial Sequence: Synthetic peptide"
REQMRLELSF

SEQ ID NO: 25378 - protein, 9 aa, Artificial Sequence
  source: /note="Description of Artificial Sequence: Synthetic peptide"
SGIKRLFRF

SEQ ID NO: 25379 - protein, 9 aa, Artificial Sequence
  source: /note="Description of Artificial Sequence: Synthetic peptide"
GIKRLFRFF

SEQ ID NO: 25380 - protein, 9 aa, Artificial Sequence
  source: /note="Description of Artificial Sequence: Synthetic peptide"
KRLFRFFSR

SEQ ID NO: 25381 - protein, 9 aa, Artificial Sequence
  source: /note="Description of Artificial Sequence: Synthetic peptide"
LFRFFSRDK

SEQ ID NO: 25382 - protein, 9 aa, Artificial Sequence
  source: /note="Description of Artificial Sequence: Synthetic peptide"
ESGIKRLFR

SEQ ID NO: 25383 - protein, 9 aa, Artificial Sequence
  source: /note="Description of Artificial Sequence: Synthetic peptide"
RFFSRDKKR

SEQ ID NO: 25384 - protein, 10 aa, Artificial Sequence
  source: /note="Description of Artificial Sequence: Synthetic peptide"
RLFRFFSRDK

SEQ ID NO: 25385 - protein, 10 aa, Artificial Sequence
  source: /note="Description of Artificial Sequence: Synthetic peptide"
SGIKRLFRFF

SEQ ID NO: 25386 - protein, 10 aa, Artificial Sequence
  source: /note="Description of Artificial Sequence: Synthetic peptide"
GIKRLFRFFS

SEQ ID NO: 25387 - protein, 10 aa, Artificial Sequence
  source: /note="Description of Artificial Sequence: Synthetic peptide"
IKRLFRFFSR

SEQ ID NO: 25388 - protein, 10 aa, Artificial Sequence
  source: /note="Description of Artificial Sequence: Synthetic peptide"
LFRFFSRDKK

SEQ ID NO: 25389 - protein, 9 aa, Artificial Sequence
  source: /note="Description of Artificial Sequence: Synthetic peptide"
RDHLSPDFY

SEQ ID NO: 25390 - protein, 10 aa, Artificial Sequence
  source: /note="Description of Artificial Sequence: Synthetic peptide"
YGRDHLSPDF

SEQ ID NO: 25391 - protein, 9 aa, Artificial Sequence
  source: /note="Description of Artificial Sequence: Synthetic peptide"
RCYTLQENK

SEQ ID NO: 25392 - protein, 9 aa, Artificial Sequence
  source: /note="Description of Artificial Sequence: Synthetic peptide"
TLQENKQLR

SEQ ID NO: 25393 - protein, 9 aa, Artificial Sequence
  source: /note="Description of Artificial Sequence: Synthetic peptide"
QENKQLRRA

SEQ ID NO: 25394 - protein, 10 aa, Artificial Sequence
  source: /note="Description of Artificial Sequence: Synthetic peptide"
YTLQENKQLR

SEQ ID NO: 25395 - protein, 9 aa, Artificial Sequence
  source: /note="Description of Artificial Sequence: Synthetic peptide"
LLEFSQLRV

SEQ ID NO: 25396 - protein, 9 aa, Artificial Sequence
  source: /note="Description of Artificial Sequence: Synthetic peptide"
TLLEFSQLR

SEQ ID NO: 25397 - protein, 9 aa, Artificial Sequence
  source: /note="Description of Artificial Sequence: Synthetic peptide"
SQLRVPLTW

SEQ ID NO: 25398 - protein, 9 aa, Artificial Sequence
  source: /note="Description of Artificial Sequence: Synthetic peptide"
LEFSQLRVP

SEQ ID NO: 25399 - protein, 10 aa, Artificial Sequence
  source: /note="Description of Artificial Sequence: Synthetic peptide"
TLLEFSQLRV

SEQ ID NO: 25400 - protein, 10 aa, Artificial Sequence
  source: /note="Description of Artificial Sequence: Synthetic peptide"
QLRVPLTWQK

SEQ ID NO: 25401 - protein, 10 aa, Artificial Sequence
  source: /note="Description of Artificial Sequence: Synthetic peptide"
STLLEFSQLR

SEQ ID NO: 25402 - protein, 10 aa, Artificial Sequence
  source: /note="Description of Artificial Sequence: Synthetic peptide"
FSQLRVPLTW

SEQ ID NO: 25403 - protein, 10 aa, Artificial Sequence
  source: /note="Description of Artificial Sequence: Synthetic peptide"
LEFSQLRVPL

SEQ ID NO: 25404 - protein, 9 aa, Artificial Sequence
  source: /note="Description of Artificial Sequence: Synthetic peptide"
FITKVKKEV

SEQ ID NO: 25405 - protein, 9 aa, Artificial Sequence
  source: /note="Description of Artificial Sequence: Synthetic peptide"
LSQHEPQFY

SEQ ID NO: 25406 - protein, 9 aa, Artificial Sequence
  source: /note="Description of Artificial Sequence: Synthetic peptide"
SPSDYADRL

SEQ ID NO: 25407 - protein, 9 aa, Artificial Sequence
  source: /note="Description of Artificial Sequence: Synthetic peptide"
RLSQHEPQF

SEQ ID NO: 25408 - protein, 10 aa, Artificial Sequence
  source: /note="Description of Artificial Sequence: Synthetic peptide"
RLSQHEPQFY

SEQ ID NO: 25409 - protein, 9 aa, Artificial Sequence
  source: /note="Description of Artificial Sequence: Synthetic peptide"
FIYSPVHQR

SEQ ID NO: 25410 - protein, 9 aa, Artificial Sequence
  source: /note="Description of Artificial Sequence: Synthetic peptide"
HQREFRERM

SEQ ID NO: 25411 - protein, 10 aa, Artificial Sequence
  source: /note="Description of Artificial Sequence: Synthetic peptide"
IYSPVHQREF

SEQ ID NO: 25412 - protein, 10 aa, Artificial Sequence
  source: /note="Description of Artificial Sequence: Synthetic peptide"
TFIYSPVHQR

SEQ ID NO: 25413 - protein, 10 aa, Artificial Sequence
  source: /note="Description of Artificial Sequence: Synthetic peptide"
YSPVHQREFR

SEQ ID NO: 25414 - protein, 10 aa, Artificial Sequence
  source: /note="Description of Artificial Sequence: Synthetic peptide"
HQREFRERML

SEQ ID NO: 25415 - protein, 9 aa, Artificial Sequence
  source: /note="Description of Artificial Sequence: Synthetic peptide"
SMPEVPRTA

SEQ ID NO: 25416 - protein, 10 aa, Artificial Sequence
  source: /note="Description of Artificial Sequence: Synthetic peptide"
SMPEVPRTAK

SEQ ID NO: 25417 - protein, 10 aa, Artificial Sequence
  source: /note="Description of Artificial Sequence: Synthetic peptide"
HSMPEVPRTA

SEQ ID NO: 25418 - protein, 10 aa, Artificial Sequence
  source: /note="Description of Artificial Sequence: Synthetic peptide"
VPRTAKQPPV

SEQ ID NO: 25419 - protein, 9 aa, Artificial Sequence
  source: /note="Description of Artificial Sequence: Synthetic peptide"
HQIHSKDGL

SEQ ID NO: 25420 - protein, 9 aa, Artificial Sequence
  source: /note="Description of Artificial Sequence: Synthetic peptide"
SKDGLLQQL

SEQ ID NO: 25421 - protein, 10 aa, Artificial Sequence
  source: /note="Description of Artificial Sequence: Synthetic peptide"
HQIHSKDGLL

SEQ ID NO: 25422 - protein, 9 aa, Artificial Sequence
  source: /note="Description of Artificial Sequence: Synthetic peptide"
QTTTMSGGK

SEQ ID NO: 25423 - protein, 10 aa, Artificial Sequence
  source: /note="Description of Artificial Sequence: Synthetic peptide"
GGKESPGREK

SEQ ID NO: 25424 - protein, 10 aa, Artificial Sequence
  source: /note="Description of Artificial Sequence: Synthetic peptide"
KESPGREKGM

SEQ ID NO: 25425 - protein, 9 aa, Artificial Sequence
  source: /note="Description of Artificial Sequence: Synthetic peptide"
SLAPALRSR

SEQ ID NO: 25426 - protein, 9 aa, Artificial Sequence
  source: /note="Description of Artificial Sequence: Synthetic peptide"
GPGPEGQSL

SEQ ID NO: 25427 - protein, 9 aa, Artificial Sequence
  source: /note="Description of Artificial Sequence: Synthetic peptide"
PEGQSLAPA

SEQ ID NO: 25428 - protein, 10 aa, Artificial Sequence
  source: /note="Description of Artificial Sequence: Synthetic peptide"
SLAPALRSRI

SEQ ID NO: 25429 - protein, 10 aa, Artificial Sequence
  source: /note="Description of Artificial Sequence: Synthetic peptide"
EGQSLAPALR

SEQ ID NO: 25430 - protein, 10 aa, Artificial Sequence
  source: /note="Description of Artificial Sequence: Synthetic peptide"
PEGQSLAPAL

SEQ ID NO: 25431 - protein, 9 aa, Artificial Sequence
  source: /note="Description of Artificial Sequence: Synthetic peptide"
MQKNQSNFL

SEQ ID NO: 25432 - protein, 9 aa, Artificial Sequence
  source: /note="Description of Artificial Sequence: Synthetic peptide"
KLISSAPLT

SEQ ID NO: 25433 - protein, 9 aa, Artificial Sequence
  source: /note="Description of Artificial Sequence: Synthetic peptide"
FLISFWSRK

SEQ ID NO: 25434 - protein, 9 aa, Artificial Sequence
  source: /note="Description of Artificial Sequence: Synthetic peptide"
KMQKNQSNF

SEQ ID NO: 25435 - protein, 9 aa, Artificial Sequence
  source: /note="Description of Artificial Sequence: Synthetic peptide"
RIRSALKMQ

SEQ ID NO: 25436 - protein, 9 aa, Artificial Sequence
  source: /note="Description of Artificial Sequence: Synthetic peptide"
ISFWSRKLI

SEQ ID NO: 25437 - protein, 9 aa, Artificial Sequence
  source: /note="Description of Artificial Sequence: Synthetic peptide"
WSRKLISSA

SEQ ID NO: 25438 - protein, 9 aa, Artificial Sequence
  source: /note="Description of Artificial Sequence: Synthetic peptide"
NFLISFWSR

SEQ ID NO: 25439 - protein, 9 aa, Artificial Sequence
  source: /note="Description of Artificial Sequence: Synthetic peptide"
NQSNFLISF

SEQ ID NO: 25440 - protein, 9 aa, Artificial Sequence
  source: /note="Description of Artificial Sequence: Synthetic peptide"
KRIRSALKM

SEQ ID NO: 25441 - protein, 9 aa, Artificial Sequence
  source: /note="Description of Artificial Sequence: Synthetic peptide"
QKNQSNFLI

SEQ ID NO: 25442 - protein, 9 aa, Artificial Sequence
  source: /note="Description of Artificial Sequence: Synthetic peptide"
RKLISSAPL

SEQ ID NO: 25443 - protein, 9 aa, Artificial Sequence
  source: /note="Description of Artificial Sequence: Synthetic peptide"
ISSAPLTAI

SEQ ID NO: 25444 - protein, 10 aa, Artificial Sequence
  source: /note="Description of Artificial Sequence: Synthetic peptide"
KMQKNQSNFL

SEQ ID NO: 25445 - protein, 10 aa, Artificial Sequence
  source: /note="Description of Artificial Sequence: Synthetic peptide"
FLISFWSRKL

SEQ ID NO: 25446 - protein, 10 aa, Artificial Sequence
  source: /note="Description of Artificial Sequence: Synthetic peptide"
KLISSAPLTA

SEQ ID NO: 25447 - protein, 10 aa, Artificial Sequence
  source: /note="Description of Artificial Sequence: Synthetic peptide"
LISSAPLTAI

SEQ ID NO: 25448 - protein, 10 aa, Artificial Sequence
  source: /note="Description of Artificial Sequence: Synthetic peptide"
MQKNQSNFLI

SEQ ID NO: 25449 - protein, 10 aa, Artificial Sequence
  source: /note="Description of Artificial Sequence: Synthetic peptide"
RIRSALKMQK

SEQ ID NO: 25450 - protein, 10 aa, Artificial Sequence
  source: /note="Description of Artificial Sequence: Synthetic peptide"
SNFLISFWSR

SEQ ID NO: 25451 - protein, 10 aa, Artificial Sequence
  source: /note="Description of Artificial Sequence: Synthetic peptide"
KNQSNFLISF

SEQ ID NO: 25452 - protein, 10 aa, Artificial Sequence
  source: /note="Description of Artificial Sequence: Synthetic peptide"
NFLISFWSRK

SEQ ID NO: 25453 - protein, 10 aa, Artificial Sequence
  source: /note="Description of Artificial Sequence: Synthetic peptide"
SRKLISSAPL

SEQ ID NO: 25454 - protein, 10 aa, Artificial Sequence
  source: /note="Description of Artificial Sequence: Synthetic peptide"
LKMQKNQSNF

SEQ ID NO: 25455 - protein, 10 aa, Artificial Sequence
  source: /note="Description of Artificial Sequence: Synthetic peptide"
NQSNFLISFW

SEQ ID NO: 25456 - protein, 9 aa, Artificial Sequence
  source: /note="Description of Artificial Sequence: Synthetic peptide"
FTAMRDQYI

SEQ ID NO: 25457 - protein, 9 aa, Artificial Sequence
  source: /note="Description of Artificial Sequence: Synthetic peptide"
AMRDQYIRA

SEQ ID NO: 25458 - protein, 9 aa, Artificial Sequence
  source: /note="Description of Artificial Sequence: Synthetic peptide"
YIRAGEGFI

SEQ ID NO: 25459 - protein, 9 aa, Artificial Sequence
  source: /note="Description of Artificial Sequence: Synthetic peptide"
QYIRAGEGF

SEQ ID NO: 25460 - protein, 9 aa, Artificial Sequence
  source: /note="Description of Artificial Sequence: Synthetic peptide"
TAMRDQYIR

SEQ ID NO: 25461 - protein, 9 aa, Artificial Sequence
  source: /note="Description of Artificial Sequence: Synthetic peptide"
IRAGEGFII

SEQ ID NO: 25462 - protein, 10 aa, Artificial Sequence
  source: /note="Description of Artificial Sequence: Synthetic peptide"
YIRAGEGFII

SEQ ID NO: 25463 - protein, 10 aa, Artificial Sequence
  source: /note="Description of Artificial Sequence: Synthetic peptide"
QYIRAGEGFI

SEQ ID NO: 25464 - protein, 10 aa, Artificial Sequence
  source: /note="Description of Artificial Sequence: Synthetic peptide"
AMRDQYIRAG

SEQ ID NO: 25465 - protein, 10 aa, Artificial Sequence
  source: /note="Description of Artificial Sequence: Synthetic peptide"
FTAMRDQYIR

SEQ ID NO: 25466 - protein, 10 aa, Artificial Sequence
  source: /note="Description of Artificial Sequence: Synthetic peptide"
DQYIRAGEGF

SEQ ID NO: 25467 - protein, 9 aa, Artificial Sequence
  source: /note="Description of Artificial Sequence: Synthetic peptide"
GQAEFTAML

SEQ ID NO: 25468 - protein, 9 aa, Artificial Sequence
  source: /note="Description of Artificial Sequence: Synthetic peptide"
TAMLEQYMR

SEQ ID NO: 25469 - protein, 9 aa, Artificial Sequence
  source: /note="Description of Artificial Sequence: Synthetic peptide"
FTAMLEQYM

SEQ ID NO: 25470 - protein, 9 aa, Artificial Sequence
  source: /note="Description of Artificial Sequence: Synthetic peptide"
AEFTAMLEQ

SEQ ID NO: 25471 - protein, 10 aa, Artificial Sequence
  source: /note="Description of Artificial Sequence: Synthetic peptide"
FTAMLEQYMR

SEQ ID NO: 25472 - protein, 10 aa, Artificial Sequence
  source: /note="Description of Artificial Sequence: Synthetic peptide"
AEFTAMLEQY

SEQ ID NO: 25473 - protein, 9 aa, Artificial Sequence
  source: /note="Description of Artificial Sequence: Synthetic peptide"
RELQEMVQV

SEQ ID NO: 25474 - protein, 9 aa, Artificial Sequence
  source: /note="Description of Artificial Sequence: Synthetic peptide"
QEMVQVQAA

SEQ ID NO: 25475 - protein, 9 aa, Artificial Sequence
  source: /note="Description of Artificial Sequence: Synthetic peptide"
VQAASGEEL

SEQ ID NO: 25476 - protein, 10 aa, Artificial Sequence
  source: /note="Description of Artificial Sequence: Synthetic peptide"
LQEMVQVQAA

SEQ ID NO: 25477 - protein, 10 aa, Artificial Sequence
  source: /note="Description of Artificial Sequence: Synthetic peptide"
VQAASGEELA

SEQ ID NO: 25478 - protein, 10 aa, Artificial Sequence
  source: /note="Description of Artificial Sequence: Synthetic peptide"
QEMVQVQAAS

SEQ ID NO: 25479 - protein, 9 aa, Artificial Sequence
  source: /note="Description of Artificial Sequence: Synthetic peptide"
FYQEINENI

SEQ ID NO: 25480 - protein, 9 aa, Artificial Sequence
  source: /note="Description of Artificial Sequence: Synthetic peptide"
YQEINENIL

SEQ ID NO: 25481 - protein, 9 aa, Artificial Sequence
  source: /note="Description of Artificial Sequence: Synthetic peptide"
NENILPSDF

SEQ ID NO: 25482 - protein, 10 aa, Artificial Sequence
  source: /note="Description of Artificial Sequence: Synthetic peptide"
GFYQEINENI

SEQ ID NO: 25483 - protein, 10 aa, Artificial Sequence
  source: /note="Description of Artificial Sequence: Synthetic peptide"
FYQEINENIL

SEQ ID NO: 25484 - protein, 10 aa, Artificial Sequence
  source: /note="Description of Artificial Sequence: Synthetic peptide"
QEINENILPS

SEQ ID NO: 25485 - protein, 9 aa, Artificial Sequence
  source: /note="Description of Artificial Sequence: Synthetic peptide"
SLSSGSSGA

SEQ ID NO: 25486 - protein, 9 aa, Artificial Sequence
  source: /note="Description of Artificial Sequence: Synthetic peptide"
FEGSNEGSL

SEQ ID NO: 25487 - protein, 9 aa, Artificial Sequence
  source: /note="Description of Artificial Sequence: Synthetic peptide"
LIRNRQCEA

SEQ ID NO: 25488 - protein, 9 aa, Artificial Sequence
  source: /note="Description of Artificial Sequence: Synthetic peptide"
RQCEAADSS

SEQ ID NO: 25489 - protein, 9 aa, Artificial Sequence
  source: /note="Description of Artificial Sequence: Synthetic peptide"
CEAADSSPS

SEQ ID NO: 25490 - protein, 10 aa, Artificial Sequence
  source: /note="Description of Artificial Sequence: Synthetic peptide"
KLIRNRQCEA

SEQ ID NO: 25491 - protein, 10 aa, Artificial Sequence
  source: /note="Description of Artificial Sequence: Synthetic peptide"
LIRNRQCEAA

SEQ ID NO: 25492 - protein, 10 aa, Artificial Sequence
  source: /note="Description of Artificial Sequence: Synthetic peptide"
RQCEAADSSP

SEQ ID NO: 25493 - protein, 9 aa, Artificial Sequence
  source: /note="Description of Artificial Sequence: Synthetic peptide"
QVDVLNSQK

SEQ ID NO: 25494 - protein, 9 aa, Artificial Sequence
  source: /note="Description of Artificial Sequence: Synthetic peptide"
VLNSQKKYF

SEQ ID NO: 25495 - protein, 10 aa, Artificial Sequence
  source: /note="Description of Artificial Sequence: Synthetic peptide"
AQVDVLNSQK

SEQ ID NO: 25496 - protein, 10 aa, Artificial Sequence
  source: /note="Description of Artificial Sequence: Synthetic peptide"
QVDVLNSQKK

SEQ ID NO: 25497 - protein, 9 aa, Artificial Sequence
  source: /note="Description of Artificial Sequence: Synthetic peptide"
TMVMGIIFM

SEQ ID NO: 25498 - protein, 9 aa, Artificial Sequence
  source: /note="Description of Artificial Sequence: Synthetic peptide"
VMGIIFMCL

SEQ ID NO: 25499 - protein, 9 aa, Artificial Sequence
  source: /note="Description of Artificial Sequence: Synthetic peptide"
HIGCTQTMV

SEQ ID NO: 25500 - protein, 9 aa, Artificial Sequence
  source: /note="Description of Artificial Sequence: Synthetic peptide"
RLCPHILDR

SEQ ID NO: 25501 - protein, 9 aa, Artificial Sequence
  source: /note="Description of Artificial Sequence: Synthetic peptide"
QTMVMGIIF

SEQ ID NO: 25502 - protein, 9 aa, Artificial Sequence
  source: /note="Description of Artificial Sequence: Synthetic peptide"
RGLPGNWEL

SEQ ID NO: 25503 - protein, 9 aa, Artificial Sequence
  source: /note="Description of Artificial Sequence: Synthetic peptide"
RAHERPHPI

SEQ ID NO: 25504 - protein, 9 aa, Artificial Sequence
  source: /note="Description of Artificial Sequence: Synthetic peptide"
MGIIFMCLR

SEQ ID NO: 25505 - protein, 9 aa, Artificial Sequence
  source: /note="Description of Artificial Sequence: Synthetic peptide"
CTQTMVMGI

SEQ ID NO: 25506 - protein, 9 aa, Artificial Sequence
  source: /note="Description of Artificial Sequence: Synthetic peptide"
MVMGIIFMC

SEQ ID NO: 25507 - protein, 9 aa, Artificial Sequence
  source: /note="Description of Artificial Sequence: Synthetic peptide"
CLRLCPHIL

SEQ ID NO: 25508 - protein, 9 aa, Artificial Sequence
  source: /note="Description of Artificial Sequence: Synthetic peptide"
HERPHPIHI

SEQ ID NO: 25509 - protein, 9 aa, Artificial Sequence
  source: /note="Description of Artificial Sequence: Synthetic peptide"
IHIGCTQTM

SEQ ID NO: 25510 - protein, 9 aa, Artificial Sequence
  source: /note="Description of Artificial Sequence: Synthetic peptide"
IGCTQTMVM

SEQ ID NO: 25511 - protein, 9 aa, Artificial Sequence
  source: /note="Description of Artificial Sequence: Synthetic peptide"
FMCLRLCPH

SEQ ID NO: 25512 - protein, 9 aa, Artificial Sequence
  source: /note="Description of Artificial Sequence: Synthetic peptide"
LQRGLPGNW

SEQ ID NO: 25513 - protein, 9 aa, Artificial Sequence
  source: /note="Description of Artificial Sequence: Synthetic peptide"
LPGNWELKL

SEQ ID NO: 25514 - protein, 10 aa, Artificial Sequence
  source: /note="Description of Artificial Sequence: Synthetic peptide"
MVMGIIFMCL

SEQ ID NO: 25515 - protein, 10 aa, Artificial Sequence
  source: /note="Description of Artificial Sequence: Synthetic peptide"
FMCLRLCPHI

SEQ ID NO: 25516 - protein, 10 aa, Artificial Sequence
  source: /note="Description of Artificial Sequence: Synthetic peptide"
RLCPHILDRL

SEQ ID NO: 25517 - protein, 10 aa, Artificial Sequence
  source: /note="Description of Artificial Sequence: Synthetic peptide"
VMGIIFMCLR

SEQ ID NO: 25518 - protein, 10 aa, Artificial Sequence
  source: /note="Description of Artificial Sequence: Synthetic peptide"
RGLPGNWELK

SEQ ID NO: 25519 - protein, 10 aa, Artificial Sequence
  source: /note="Description of Artificial Sequence: Synthetic peptide"
RAHERPHPIH

SEQ ID NO: 25520 - protein, 10 aa, Artificial Sequence
  source: /note="Description of Artificial Sequence: Synthetic peptide"
QTMVMGIIFM

SEQ ID NO: 25521 - protein, 10 aa, Artificial Sequence
  source: /note="Description of Artificial Sequence: Synthetic peptide"
RPHPIHIGCT

SEQ ID NO: 25522 - protein, 10 aa, Artificial Sequence
  source: /note="Description of Artificial Sequence: Synthetic peptide"
HIGCTQTMVM

SEQ ID NO: 25523 - protein, 10 aa, Artificial Sequence
  source: /note="Description of Artificial Sequence: Synthetic peptide"
TQTMVMGIIF

SEQ ID NO: 25524 - protein, 10 aa, Artificial Sequence
  source: /note="Description of Artificial Sequence: Synthetic peptide"
RLQRGLPGNW

SEQ ID NO: 25525 - protein, 9 aa, Artificial Sequence
  source: /note="Description of Artificial Sequence: Synthetic peptide"
NSSSGMVRK

SEQ ID NO: 25526 - protein, 10 aa, Artificial Sequence
  source: /note="Description of Artificial Sequence: Synthetic peptide"
SMGNSSSGMV

SEQ ID NO: 25527 - protein, 9 aa, Artificial Sequence
  source: /note="Description of Artificial Sequence: Synthetic peptide"
AWRRREAGV

SEQ ID NO: 25528 - protein, 9 aa, Artificial Sequence
  source: /note="Description of Artificial Sequence: Synthetic peptide"
MAWRRREAG

SEQ ID NO: 25529 - protein, 10 aa, Artificial Sequence
  source: /note="Description of Artificial Sequence: Synthetic peptide"
RRREAGVGAR

SEQ ID NO: 25530 - protein, 10 aa, Artificial Sequence
  source: /note="Description of Artificial Sequence: Synthetic peptide"
MAWRRREAGV

SEQ ID NO: 25531 - protein, 10 aa, Artificial Sequence
  source: /note="Description of Artificial Sequence: Synthetic peptide"
REAGVGARGV

SEQ ID NO: 25532 - protein, 9 aa, Artificial Sequence
  source: /note="Description of Artificial Sequence: Synthetic peptide"
RTLVVFVSI

SEQ ID NO: 25533 - protein, 9 aa, Artificial Sequence
  source: /note="Description of Artificial Sequence: Synthetic peptide"
KYVSRTLVV

SEQ ID NO: 25534 - protein, 9 aa, Artificial Sequence
  source: /note="Description of Artificial Sequence: Synthetic peptide"
YVSRTLVVF

SEQ ID NO: 25535 - protein, 9 aa, Artificial Sequence
  source: /note="Description of Artificial Sequence: Synthetic peptide"
VSRTLVVFV

SEQ ID NO: 25536 - protein, 9 aa, Artificial Sequence
  source: /note="Description of Artificial Sequence: Synthetic peptide"
LQKYVSRTL

SEQ ID NO: 25537 - protein, 9 aa, Artificial Sequence
  source: /note="Description of Artificial Sequence: Synthetic peptide"
LVVFVSISF

SEQ ID NO: 25538 - protein, 9 aa, Artificial Sequence
  source: /note="Description of Artificial Sequence: Synthetic peptide"
QKYVSRTLV

SEQ ID NO: 25539 - protein, 10 aa, Artificial Sequence
  source: /note="Description of Artificial Sequence: Synthetic peptide"
YVSRTLVVFV

SEQ ID NO: 25540 - protein, 10 aa, Artificial Sequence
  source: /note="Description of Artificial Sequence: Synthetic peptide"
NLQKYVSRTL

SEQ ID NO: 25541 - protein, 10 aa, Artificial Sequence
  source: /note="Description of Artificial Sequence: Synthetic peptide"
LQKYVSRTLV

SEQ ID NO: 25542 - protein, 10 aa, Artificial Sequence
  source: /note="Description of Artificial Sequence: Synthetic peptide"
LVVFVSISFI

SEQ ID NO: 25543 - protein, 10 aa, Artificial Sequence
  source: /note="Description of Artificial Sequence: Synthetic peptide"
KYVSRTLVVF

SEQ ID NO: 25544 - protein, 10 aa, Artificial Sequence
  source: /note="Description of Artificial Sequence: Synthetic peptide"
RTLVVFVSIS

SEQ ID NO: 25545 - protein, 10 aa, Artificial Sequence
  source: /note="Description of Artificial Sequence: Synthetic peptide"
TLVVFVSISF

SEQ ID NO: 25546 - protein, 10 aa, Artificial Sequence
  source: /note="Description of Artificial Sequence: Synthetic peptide"
QKYVSRTLVV

SEQ ID NO: 25547 - protein, 9 aa, Artificial Sequence
  source: /note="Description of Artificial Sequence: Synthetic peptide"
FYYIQRFQY

SEQ ID NO: 25548 - protein, 9 aa, Artificial Sequence
  source: /note="Description of Artificial Sequence: Synthetic peptide"
YYIQRFQYA

SEQ ID NO: 25549 - protein, 9 aa, Artificial Sequence
  source: /note="Description of Artificial Sequence: Synthetic peptide"
IQRFQYANA

SEQ ID NO: 25550 - protein, 10 aa, Artificial Sequence
  source: /note="Description of Artificial Sequence: Synthetic peptide"
YIQRFQYANA

SEQ ID NO: 25551 - protein, 10 aa, Artificial Sequence
  source: /note="Description of Artificial Sequence: Synthetic peptide"
FYYIQRFQYA

SEQ ID NO: 25552 - protein, 10 aa, Artificial Sequence
  source: /note="Description of Artificial Sequence: Synthetic peptide"
YYIQRFQYAN

SEQ ID NO: 25553 - protein, 10 aa, Artificial Sequence
  source: /note="Description of Artificial Sequence: Synthetic peptide"
IQRFQYANAR

SEQ ID NO: 25554 - protein, 10 aa, Artificial Sequence
  source: /note="Description of Artificial Sequence: Synthetic peptide"
VFYYIQRFQY

SEQ ID NO: 25555 - protein, 10 aa, Artificial Sequence
  source: /note="Description of Artificial Sequence: Synthetic peptide"
FQYANARDRN

SEQ ID NO: 25556 - protein, 9 aa, Artificial Sequence
  source: /note="Description of Artificial Sequence: Synthetic peptide"
KLSSNGCYM

SEQ ID NO: 25557 - protein, 9 aa, Artificial Sequence
  source: /note="Description of Artificial Sequence: Synthetic peptide"
IKLSSNGCY

SEQ ID NO: 25558 - protein, 9 aa, Artificial Sequence
  source: /note="Description of Artificial Sequence: Synthetic peptide"
LSSNGCYML

SEQ ID NO: 25559 - protein, 10 aa, Artificial Sequence
  source: /note="Description of Artificial Sequence: Synthetic peptide"
KLSSNGCYML

SEQ ID NO: 25560 - protein, 10 aa, Artificial Sequence
  source: /note="Description of Artificial Sequence: Synthetic peptide"
FIKLSSNGCY

SEQ ID NO: 25561 - protein, 10 aa, Artificial Sequence
  source: /note="Description of Artificial Sequence: Synthetic peptide"
IKLSSNGCYM

SEQ ID NO: 25562 - protein, 10 aa, Artificial Sequence
  source: /note="Description of Artificial Sequence: Synthetic peptide"
SSNGCYMLPL

SEQ ID NO: 25563 - protein, 9 aa, Artificial Sequence
  source: /note="Description of Artificial Sequence: Synthetic peptide"
KKKVDMCVL

SEQ ID NO: 25564 - protein, 10 aa, Artificial Sequence
  source: /note="Description of Artificial Sequence: Synthetic peptide"
SPGQSTQLPL

SEQ ID NO: 25565 - protein, 10 aa, Artificial Sequence
  source: /note="Description of Artificial Sequence: Synthetic peptide"
GQSTQLPLDL

SEQ ID NO: 25566 - protein, 10 aa, Artificial Sequence
  source: /note="Description of Artificial Sequence: Synthetic peptide"
TQLPLDLLPS

SEQ ID NO: 25567 - protein, 10 aa, Artificial Sequence
  source: /note="Description of Artificial Sequence: Synthetic peptide"
GTPAPPDCPK

SEQ ID NO: 25568 - protein, 9 aa, Artificial Sequence
  source: /note="Description of Artificial Sequence: Synthetic peptide"
RMQLCTQLA

SEQ ID NO: 25569 - protein, 9 aa, Artificial Sequence
  source: /note="Description of Artificial Sequence: Synthetic peptide"
TQLARFFPI

SEQ ID NO: 25570 - protein, 9 aa, Artificial Sequence
  source: /note="Description of Artificial Sequence: Synthetic peptide"
RFFPITPPV

SEQ ID NO: 25571 - protein, 9 aa, Artificial Sequence
  source: /note="Description of Artificial Sequence: Synthetic peptide"
FFPITPPVW

SEQ ID NO: 25572 - protein, 9 aa, Artificial Sequence
  source: /note="Description of Artificial Sequence: Synthetic peptide"
ITPPVWHIL

SEQ ID NO: 25573 - protein, 9 aa, Artificial Sequence
  source: /note="Description of Artificial Sequence: Synthetic peptide"
RGVPPSPPL

SEQ ID NO: 25574 - protein, 9 aa, Artificial Sequence
  source: /note="Description of Artificial Sequence: Synthetic peptide"
MQLCTQLAR

SEQ ID NO: 25575 - protein, 9 aa, Artificial Sequence
  source: /note="Description of Artificial Sequence: Synthetic peptide"
HPQRKRRGV

SEQ ID NO: 25576 - protein, 9 aa, Artificial Sequence
  source: /note="Description of Artificial Sequence: Synthetic peptide"
VPPSPPLAL

SEQ ID NO: 25577 - protein, 9 aa, Artificial Sequence
  source: /note="Description of Artificial Sequence: Synthetic peptide"
RKRRGVPPS

SEQ ID NO: 25578 - protein, 9 aa, Artificial Sequence
  source: /note="Description of Artificial Sequence: Synthetic peptide"
LALGPRMQL

SEQ ID NO: 25579 - protein, 9 aa, Artificial Sequence
  source: /note="Description of Artificial Sequence: Synthetic peptide"
QLCTQLARF

SEQ ID NO: 25580 - protein, 9 aa, Artificial Sequence
  source: /note="Description of Artificial Sequence: Synthetic peptide"
FPITPPVWH

SEQ ID NO: 25581 - protein, 10 aa, Artificial Sequence
  source: /note="Description of Artificial Sequence: Synthetic peptide"
RMQLCTQLAR

SEQ ID NO: 25582 - protein, 10 aa, Artificial Sequence
  source: /note="Description of Artificial Sequence: Synthetic peptide"
MQLCTQLARF

SEQ ID NO: 25583 - protein, 10 aa, Artificial Sequence
  source: /note="Description of Artificial Sequence: Synthetic peptide"
CTQLARFFPI

SEQ ID NO: 25584 - protein, 10 aa, Artificial Sequence
  source: /note="Description of Artificial Sequence: Synthetic peptide"
RFFPITPPVW

SEQ ID NO: 25585 - protein, 10 aa, Artificial Sequence
  source: /note="Description of Artificial Sequence: Synthetic peptide"
RGVPPSPPLA

SEQ ID NO: 25586 - protein, 10 aa, Artificial Sequence
  source: /note="Description of Artificial Sequence: Synthetic peptide"
FPITPPVWHI

SEQ ID NO: 25587 - protein, 10 aa, Artificial Sequence
  source: /note="Description of Artificial Sequence: Synthetic peptide"
SPPLALGPRM

SEQ ID NO: 25588 - protein, 10 aa, Artificial Sequence
  source: /note="Description of Artificial Sequence: Synthetic peptide"
GPRMQLCTQL

SEQ ID NO: 25589 - protein, 10 aa, Artificial Sequence
  source: /note="Description of Artificial Sequence: Synthetic peptide"
RRGVPPSPPL

SEQ ID NO: 25590 - protein, 10 aa, Artificial Sequence
  source: /note="Description of Artificial Sequence: Synthetic peptide"
QLCTQLARFF

SEQ ID NO: 25591 - protein, 10 aa, Artificial Sequence
  source: /note="Description of Artificial Sequence: Synthetic peptide"
TQLARFFPIT

SEQ ID NO: 25592 - protein, 10 aa, Artificial Sequence
  source: /note="Description of Artificial Sequence: Synthetic peptide"
ARFFPITPPV

SEQ ID NO: 25593 - protein, 9 aa, Artificial Sequence
  source: /note="Description of Artificial Sequence: Synthetic peptide"
SPRRAPPPL

SEQ ID NO: 25594 - protein, 9 aa, Artificial Sequence
  source: /note="Description of Artificial Sequence: Synthetic peptide"
RRAPPPLPV

SEQ ID NO: 25595 - protein, 9 aa, Artificial Sequence
  source: /note="Description of Artificial Sequence: Synthetic peptide"
IILALVLRI

SEQ ID NO: 25596 - protein, 9 aa, Artificial Sequence
  source: /note="Description of Artificial Sequence: Synthetic peptide"
IFVIILALV

SEQ ID NO: 25597 - protein, 9 aa, Artificial Sequence
  source: /note="Description of Artificial Sequence: Synthetic peptide"
VIILALVLR

SEQ ID NO: 25598 - protein, 9 aa, Artificial Sequence
  source: /note="Description of Artificial Sequence: Synthetic peptide"
TIFVIILAL

SEQ ID NO: 25599 - protein, 9 aa, Artificial Sequence
  source: /note="Description of Artificial Sequence: Synthetic peptide"
FVIILALVL

SEQ ID NO: 25600 - protein, 10 aa, Artificial Sequence
  source: /note="Description of Artificial Sequence: Synthetic peptide"
TIFVIILALV

SEQ ID NO: 25601 - protein, 10 aa, Artificial Sequence
  source: /note="Description of Artificial Sequence: Synthetic peptide"
VIILALVLRI

SEQ ID NO: 25602 - protein, 10 aa, Artificial Sequence
  source: /note="Description of Artificial Sequence: Synthetic peptide"
IFVIILALVL

SEQ ID NO: 25603 - protein, 10 aa, Artificial Sequence
  source: /note="Description of Artificial Sequence: Synthetic peptide"
LVLRIRCRPR

SEQ ID NO: 25604 - protein, 10 aa, Artificial Sequence
  source: /note="Description of Artificial Sequence: Synthetic peptide"
FVIILALVLR

SEQ ID NO: 25605 - protein, 10 aa, Artificial Sequence
  source: /note="Description of Artificial Sequence: Synthetic peptide"
IILALVLRIR

SEQ ID NO: 25606 - protein, 10 aa, Artificial Sequence
  source: /note="Description of Artificial Sequence: Synthetic peptide"
LALVLRIRCR

SEQ ID NO: 25607 - protein, 10 aa, Artificial Sequence
  source: /note="Description of Artificial Sequence: Synthetic peptide"
GTIFVIILAL

SEQ ID NO: 25608 - protein, 9 aa, Artificial Sequence
  source: /note="Description of Artificial Sequence: Synthetic peptide"
VYKKHFWNS

SEQ ID NO: 25609 - protein, 9 aa, Artificial Sequence
  source: /note="Description of Artificial Sequence: Synthetic peptide"
KKHFWNSTK

SEQ ID NO: 25610 - protein, 9 aa, Artificial Sequence
  source: /note="Description of Artificial Sequence: Synthetic peptide"
KHFWNSTKK

SEQ ID NO: 25611 - protein, 9 aa, Artificial Sequence
  source: /note="Description of Artificial Sequence: Synthetic peptide"
STKKRLRTM

SEQ ID NO: 25612 - protein, 9 aa, Artificial Sequence
  source: /note="Description of Artificial Sequence: Synthetic peptide"
KKRLRTMKI

SEQ ID NO: 25613 - protein, 9 aa, Artificial Sequence
  source: /note="Description of Artificial Sequence: Synthetic peptide"
RLRTMKIKC

SEQ ID NO: 25614 - protein, 9 aa, Artificial Sequence
  source: /note="Description of Artificial Sequence: Synthetic peptide"
HFWNSTKKR

SEQ ID NO: 25615 - protein, 9 aa, Artificial Sequence
  source: /note="Description of Artificial Sequence: Synthetic peptide"
MKLVYKKHF

SEQ ID NO: 25616 - protein, 9 aa, Artificial Sequence
  source: /note="Description of Artificial Sequence: Synthetic peptide"
YKKHFWNST

SEQ ID NO: 25617 - protein, 10 aa, Artificial Sequence
  source: /note="Description of Artificial Sequence: Synthetic peptide"
STKKRLRTMK

SEQ ID NO: 25618 - protein, 10 aa, Artificial Sequence
  source: /note="Description of Artificial Sequence: Synthetic peptide"
KKHFWNSTKK

SEQ ID NO: 25619 - protein, 10 aa, Artificial Sequence
  source: /note="Description of Artificial Sequence: Synthetic peptide"
KKRLRTMKIK

SEQ ID NO: 25620 - protein, 10 aa, Artificial Sequence
  source: /note="Description of Artificial Sequence: Synthetic peptide"
RLRTMKIKCS

SEQ ID NO: 25621 - protein, 10 aa, Artificial Sequence
  source: /note="Description of Artificial Sequence: Synthetic peptide"
FWNSTKKRLR

SEQ ID NO: 25622 - protein, 10 aa, Artificial Sequence
  source: /note="Description of Artificial Sequence: Synthetic peptide"
NMKLVYKKHF

SEQ ID NO: 25623 - protein, 10 aa, Artificial Sequence
  source: /note="Description of Artificial Sequence: Synthetic peptide"
MKLVYKKHFW

SEQ ID NO: 25624 - protein, 9 aa, Artificial Sequence
  source: /note="Description of Artificial Sequence: Synthetic peptide"
GLMTLSKMI

SEQ ID NO: 25625 - protein, 9 aa, Artificial Sequence
  source: /note="Description of Artificial Sequence: Synthetic peptide"
LMTLSKMIK

SEQ ID NO: 25626 - protein, 9 aa, Artificial Sequence
  source: /note="Description of Artificial Sequence: Synthetic peptide"
MTLSKMIKK

SEQ ID NO: 25627 - protein, 9 aa, Artificial Sequence
  source: /note="Description of Artificial Sequence: Synthetic peptide"
TLSKMIKKK

SEQ ID NO: 25628 - protein, 9 aa, Artificial Sequence
  source: /note="Description of Artificial Sequence: Synthetic peptide"
LSKMIKKKK

SEQ ID NO: 25629 - protein, 9 aa, Artificial Sequence
  source: /note="Description of Artificial Sequence: Synthetic peptide"
MIKKKKNLV

SEQ ID NO: 25630 - protein, 9 aa, Artificial Sequence
  source: /note="Description of Artificial Sequence: Synthetic peptide"
KGLMTLSKM

SEQ ID NO: 25631 - protein, 9 aa, Artificial Sequence
  source: /note="Description of Artificial Sequence: Synthetic peptide"
IKKKKNLVI

SEQ ID NO: 25632 - protein, 10 aa, Artificial Sequence
  source: /note="Description of Artificial Sequence: Synthetic peptide"
KMIKKKKNLV

SEQ ID NO: 25633 - protein, 10 aa, Artificial Sequence
  source: /note="Description of Artificial Sequence: Synthetic peptide"
GLMTLSKMIK

SEQ ID NO: 25634 - protein, 10 aa, Artificial Sequence
  source: /note="Description of Artificial Sequence: Synthetic peptide"
LMTLSKMIKK

SEQ ID NO: 25635 - protein, 10 aa, Artificial Sequence
  source: /note="Description of Artificial Sequence: Synthetic peptide"
MTLSKMIKKK

SEQ ID NO: 25636 - protein, 10 aa, Artificial Sequence
  source: /note="Description of Artificial Sequence: Synthetic peptide"
TLSKMIKKKK

SEQ ID NO: 25637 - protein, 10 aa, Artificial Sequence
  source: /note="Description of Artificial Sequence: Synthetic peptide"
KKKGLMTLSK

SEQ ID NO: 25638 - protein, 10 aa, Artificial Sequence
  source: /note="Description of Artificial Sequence: Synthetic peptide"
MIKKKKNLVI

SEQ ID NO: 25639 - protein, 10 aa, Artificial Sequence
  source: /note="Description of Artificial Sequence: Synthetic peptide"
SKMIKKKKNL

SEQ ID NO: 25640 - protein, 10 aa, Artificial Sequence
  source: /note="Description of Artificial Sequence: Synthetic peptide"
SEKKKGLMTL

SEQ ID NO: 25641 - protein, 10 aa, Artificial Sequence
  source: /note="Description of Artificial Sequence: Synthetic peptide"
KKGLMTLSKM

SEQ ID NO: 25642 - protein, 9 aa, Artificial Sequence
  source: /note="Description of Artificial Sequence: Synthetic peptide"
SIHELAVNL

SEQ ID NO: 25643 - protein, 9 aa, Artificial Sequence
  source: /note="Description of Artificial Sequence: Synthetic peptide"
HELAVNLPD

SEQ ID NO: 25644 - protein, 10 aa, Artificial Sequence
  source: /note="Description of Artificial Sequence: Synthetic peptide"
AVNLPDPQWK

SEQ ID NO: 25645 - protein, 10 aa, Artificial Sequence
  source: /note="Description of Artificial Sequence: Synthetic peptide"
NSIHELAVNL

SEQ ID NO: 25646 - protein, 10 aa, Artificial Sequence
  source: /note="Description of Artificial Sequence: Synthetic peptide"
LAVNLPDPQW

SEQ ID NO: 25647 - protein, 10 aa, Artificial Sequence
  source: /note="Description of Artificial Sequence: Synthetic peptide"
HELAVNLPDP

SEQ ID NO: 25648 - protein, 9 aa, Artificial Sequence
  source: /note="Description of Artificial Sequence: Synthetic peptide"
TLCSGTTRK

SEQ ID NO: 25649 - protein, 9 aa, Artificial Sequence
  source: /note="Description of Artificial Sequence: Synthetic peptide"
GTLCSGTTR

SEQ ID NO: 25650 - protein, 9 aa, Artificial Sequence
  source: /note="Description of Artificial Sequence: Synthetic peptide"
SPAPSWHGA

SEQ ID NO: 25651 - protein, 9 aa, Artificial Sequence
  source: /note="Description of Artificial Sequence: Synthetic peptide"
APSWHGAGT

SEQ ID NO: 25652 - protein, 10 aa, Artificial Sequence
  source: /note="Description of Artificial Sequence: Synthetic peptide"
GTLCSGTTRK

SEQ ID NO: 25653 - protein, 10 aa, Artificial Sequence
  source: /note="Description of Artificial Sequence: Synthetic peptide"
VPLPPPPSPA

SEQ ID NO: 25654 - protein, 10 aa, Artificial Sequence
  source: /note="Description of Artificial Sequence: Synthetic peptide"
SPAPSWHGAG

SEQ ID NO: 25655 - protein, 10 aa, Artificial Sequence
  source: /note="Description of Artificial Sequence: Synthetic peptide"
APSWHGAGTL

SEQ ID NO: 25656 - protein, 9 aa, Artificial Sequence
  source: /note="Description of Artificial Sequence: Synthetic peptide"
WTNNQHCLI

SEQ ID NO: 25657 - protein, 10 aa, Artificial Sequence
  source: /note="Description of Artificial Sequence: Synthetic peptide"
REGGWTNNQH

SEQ ID NO: 25658 - protein, 9 aa, Artificial Sequence
  source: /note="Description of Artificial Sequence: Synthetic peptide"
EVSSLKDQL

SEQ ID NO: 25659 - protein, 10 aa, Artificial Sequence
  source: /note="Description of Artificial Sequence: Synthetic peptide"
NVENEVSSLK

SEQ ID NO: 25660 - protein, 10 aa, Artificial Sequence
  source: /note="Description of Artificial Sequence: Synthetic peptide"
RNVENEVSSL

SEQ ID NO: 25661 - protein, 10 aa, Artificial Sequence
  source: /note="Description of Artificial Sequence: Synthetic peptide"
NEVSSLKDQL

SEQ ID NO: 25662 - protein, 9 aa, Artificial Sequence
  source: /note="Description of Artificial Sequence: Synthetic peptide"
NSDIWSYGV

SEQ ID NO: 25663 - protein, 9 aa, Artificial Sequence
  source: /note="Description of Artificial Sequence: Synthetic peptide"
KFSINSDIW

SEQ ID NO: 25664 - protein, 9 aa, Artificial Sequence
  source: /note="Description of Artificial Sequence: Synthetic peptide"
SINSDIWSY

SEQ ID NO: 25665 - protein, 9 aa, Artificial Sequence
  source: /note="Description of Artificial Sequence: Synthetic peptide"
IMYGKFSIN

SEQ ID NO: 25666 - protein, 9 aa, Artificial Sequence
  source: /note="Description of Artificial Sequence: Synthetic peptide"
GKFSINSDI

SEQ ID NO: 25667 - protein, 10 aa, Artificial Sequence
  source: /note="Description of Artificial Sequence: Synthetic peptide"
FSINSDIWSY

SEQ ID NO: 25668 - protein, 10 aa, Artificial Sequence
  source: /note="Description of Artificial Sequence: Synthetic peptide"
NSDIWSYGVV

SEQ ID NO: 25669 - protein, 10 aa, Artificial Sequence
  source: /note="Description of Artificial Sequence: Synthetic peptide"
IMYGKFSINS

SEQ ID NO: 25670 - protein, 10 aa, Artificial Sequence
  source: /note="Description of Artificial Sequence: Synthetic peptide"
INSDIWSYGV

SEQ ID NO: 25671 - protein, 10 aa, Artificial Sequence
  source: /note="Description of Artificial Sequence: Synthetic peptide"
GKFSINSDIW

SEQ ID NO: 25672 - protein, 9 aa, Artificial Sequence
  source: /note="Description of Artificial Sequence: Synthetic peptide"
AVKFWRMSK

SEQ ID NO: 25673 - protein, 9 aa, Artificial Sequence
  source: /note="Description of Artificial Sequence: Synthetic peptide"
MSRDAVKFW

SEQ ID NO: 25674 - protein, 10 aa, Artificial Sequence
  source: /note="Description of Artificial Sequence: Synthetic peptide"
AVKFWRMSKK

SEQ ID NO: 25675 - protein, 10 aa, Artificial Sequence
  source: /note="Description of Artificial Sequence: Synthetic peptide"
MSRDAVKFWR

SEQ ID NO: 25676 - protein, 10 aa, Artificial Sequence
  source: /note="Description of Artificial Sequence: Synthetic peptide"
DAVKFWRMSK

SEQ ID NO: 25677 - protein, 10 aa, Artificial Sequence
  source: /note="Description of Artificial Sequence: Synthetic peptide"
GMSRDAVKFW

SEQ ID NO: 25678 - protein, 9 aa, Artificial Sequence
  source: /note="Description of Artificial Sequence: Synthetic peptide"
GTQITSFQF

SEQ ID NO: 25679 - protein, 9 aa, Artificial Sequence
  source: /note="Description of Artificial Sequence: Synthetic peptide"
TQITSFQFY

SEQ ID NO: 25680 - protein, 9 aa, Artificial Sequence
  source: /note="Description of Artificial Sequence: Synthetic peptide"
QKLDAGTQI

SEQ ID NO: 25681 - protein, 10 aa, Artificial Sequence
  source: /note="Description of Artificial Sequence: Synthetic peptide"
GTQITSFQFY

SEQ ID NO: 25682 - protein, 10 aa, Artificial Sequence
  source: /note="Description of Artificial Sequence: Synthetic peptide"
ITSFQFYSTL

SEQ ID NO: 25683 - protein, 10 aa, Artificial Sequence
  source: /note="Description of Artificial Sequence: Synthetic peptide"
NQKLDAGTQI

SEQ ID NO: 25684 - protein, 10 aa, Artificial Sequence
  source: /note="Description of Artificial Sequence: Synthetic peptide"
LDAGTQITSF

SEQ ID NO: 25685 - protein, 10 aa, Artificial Sequence
  source: /note="Description of Artificial Sequence: Synthetic peptide"
AGTQITSFQF

SEQ ID NO: 25686 - protein, 9 aa, Artificial Sequence
  source: /note="Description of Artificial Sequence: Synthetic peptide"
DTTLVDTLL

SEQ ID NO: 25687 - protein, 10 aa, Artificial Sequence
  source: /note="Description of Artificial Sequence: Synthetic peptide"
GMCGNADTTL

SEQ ID NO: 25688 - protein, 9 aa, Artificial Sequence
  source: /note="Description of Artificial Sequence: Synthetic peptide"
LQVINIHPI

SEQ ID NO: 25689 - protein, 10 aa, Artificial Sequence
  source: /note="Description of Artificial Sequence: Synthetic peptide"
ILQVINIHPI

SEQ ID NO: 25690 - protein, 10 aa, Artificial Sequence
  source: /note="Description of Artificial Sequence: Synthetic peptide"
LQVINIHPIT

SEQ ID NO: 25691 - protein, 9 aa, Artificial Sequence
  source: /note="Description of Artificial Sequence: Synthetic peptide"
DEFEDMVAT

SEQ ID NO: 25692 - protein, 10 aa, Artificial Sequence
  source: /note="Description of Artificial Sequence: Synthetic peptide"
DEFEDMVATK

SEQ ID NO: 25693 - protein, 10 aa, Artificial Sequence
  source: /note="Description of Artificial Sequence: Synthetic peptide"
FEDMVATKCL

SEQ ID NO: 25694 - protein, 9 aa, Artificial Sequence
  source: /note="Description of Artificial Sequence: Synthetic peptide"
VFDRIPPPY

SEQ ID NO: 25695 - protein, 9 aa, Artificial Sequence
  source: /note="Description of Artificial Sequence: Synthetic peptide"
RIPPPYDKK

SEQ ID NO: 25696 - protein, 9 aa, Artificial Sequence
  source: /note="Description of Artificial Sequence: Synthetic peptide"
KVFDRIPPP

SEQ ID NO: 25697 - protein, 10 aa, Artificial Sequence
  source: /note="Description of Artificial Sequence: Synthetic peptide"
KVFDRIPPPY

SEQ ID NO: 25698 - protein, 10 aa, Artificial Sequence
  source: /note="Description of Artificial Sequence: Synthetic peptide"
RIPPPYDKKK

SEQ ID NO: 25699 - protein, 9 aa, Artificial Sequence
  source: /note="Description of Artificial Sequence: Synthetic peptide"
KLKADKACK

SEQ ID NO: 25700 - protein, 10 aa, Artificial Sequence
  source: /note="Description of Artificial Sequence: Synthetic peptide"
KLKADKACKK

SEQ ID NO: 25701 - protein, 10 aa, Artificial Sequence
  source: /note="Description of Artificial Sequence: Synthetic peptide"
VVKGGKKRSK

SEQ ID NO: 25702 - protein, 10 aa, Artificial Sequence
  source: /note="Description of Artificial Sequence: Synthetic peptide"
VKGGKKRSKF

SEQ ID NO: 25703 - protein, 9 aa, Artificial Sequence
  source: /note="Description of Artificial Sequence: Synthetic peptide"
HLSDCLCPY

SEQ ID NO: 25704 - protein, 9 aa, Artificial Sequence
  source: /note="Description of Artificial Sequence: Synthetic peptide"
RSVCTRTAK

SEQ ID NO: 25705 - protein, 9 aa, Artificial Sequence
  source: /note="Description of Artificial Sequence: Synthetic peptide"
MIVRVTNRY

SEQ ID NO: 25706 - protein, 9 aa, Artificial Sequence
  source: /note="Description of Artificial Sequence: Synthetic peptide"
IVRVTNRYH

SEQ ID NO: 25707 - protein, 9 aa, Artificial Sequence
  source: /note="Description of Artificial Sequence: Synthetic peptide"
RVTNRYHLS

SEQ ID NO: 25708 - protein, 9 aa, Artificial Sequence
  source: /note="Description of Artificial Sequence: Synthetic peptide"
RTAKIWCEG

SEQ ID NO: 25709 - protein, 9 aa, Artificial Sequence
  source: /note="Description of Artificial Sequence: Synthetic peptide"
CLCPYRGGY

SEQ ID NO: 25710 - protein, 9 aa, Artificial Sequence
  source: /note="Description of Artificial Sequence: Synthetic peptide"
DSLRSVCTR

SEQ ID NO: 25711 - protein, 9 aa, Artificial Sequence
  source: /note="Description of Artificial Sequence: Synthetic peptide"
VRVTNRYHL

SEQ ID NO: 25712 - protein, 9 aa, Artificial Sequence
  source: /note="Description of Artificial Sequence: Synthetic peptide"
KLCCSILYW

SEQ ID NO: 25713 - protein, 9 aa, Artificial Sequence
  source: /note="Description of Artificial Sequence: Synthetic peptide"
CSILYWPAA

SEQ ID NO: 25714 - protein, 9 aa, Artificial Sequence
  source: /note="Description of Artificial Sequence: Synthetic peptide"
DKLCCSILY

SEQ ID NO: 25715 - protein, 9 aa, Artificial Sequence
  source: /note="Description of Artificial Sequence: Synthetic peptide"
WPAAGPQAS

SEQ ID NO: 25716 - protein, 9 aa, Artificial Sequence
  source: /note="Description of Artificial Sequence: Synthetic peptide"
WPDKLCCSI

SEQ ID NO: 25717 - protein, 10 aa, Artificial Sequence
  source: /note="Description of Artificial Sequence: Synthetic peptide"
SLRSVCTRTA

SEQ ID NO: 25718 - protein, 10 aa, Artificial Sequence
  source: /note="Description of Artificial Sequence: Synthetic peptide"
RMIVRVTNRY

SEQ ID NO: 25719 - protein, 10 aa, Artificial Sequence
  source: /note="Description of Artificial Sequence: Synthetic peptide"
KIWCEGWPDK

SEQ ID NO: 25720 - protein, 10 aa, Artificial Sequence
  source: /note="Description of Artificial Sequence: Synthetic peptide"
HLSDCLCPYR

SEQ ID NO: 25721 - protein, 10 aa, Artificial Sequence
  source: /note="Description of Artificial Sequence: Synthetic peptide"
IWCEGWPDKL

SEQ ID NO: 25722 - protein, 10 aa, Artificial Sequence
  source: /note="Description of Artificial Sequence: Synthetic peptide"
IVRVTNRYHL

SEQ ID NO: 25723 - protein, 10 aa, Artificial Sequence
  source: /note="Description of Artificial Sequence: Synthetic peptide"
RSVCTRTAKI

SEQ ID NO: 25724 - protein, 10 aa, Artificial Sequence
  source: /note="Description of Artificial Sequence: Synthetic peptide"
YHLSDCLCPY

SEQ ID NO: 25725 - protein, 10 aa, Artificial Sequence
  source: /note="Description of Artificial Sequence: Synthetic peptide"
CPYRGGYDSL

SEQ ID NO: 25726 - protein, 10 aa, Artificial Sequence
  source: /note="Description of Artificial Sequence: Synthetic peptide"
WPDKLCCSIL

SEQ ID NO: 25727 - protein, 10 aa, Artificial Sequence
  source: /note="Description of Artificial Sequence: Synthetic peptide"
RTAKIWCEGW

SEQ ID NO: 25728 - protein, 9 aa, Artificial Sequence
  source: /note="Description of Artificial Sequence: Synthetic peptide"
CVIATSTKI

SEQ ID NO: 25729 - protein, 9 aa, Artificial Sequence
  source: /note="Description of Artificial Sequence: Synthetic peptide"
RTHQKCVIA

SEQ ID NO: 25730 - protein, 9 aa, Artificial Sequence
  source: /note="Description of Artificial Sequence: Synthetic peptide"
KCVIATSTK

SEQ ID NO: 25731 - protein, 9 aa, Artificial Sequence
  source: /note="Description of Artificial Sequence: Synthetic peptide"
HQKCVIATS

SEQ ID NO: 25732 - protein, 10 aa, Artificial Sequence
  source: /note="Description of Artificial Sequence: Synthetic peptide"
RTHQKCVIAT

SEQ ID NO: 25733 - protein, 10 aa, Artificial Sequence
  source: /note="Description of Artificial Sequence: Synthetic peptide"
HQKCVIATST

SEQ ID NO: 25734 - protein, 9 aa, Artificial Sequence
  source: /note="Description of Artificial Sequence: Synthetic peptide"
AIIFSESFA

SEQ ID NO: 25735 - protein, 9 aa, Artificial Sequence
  source: /note="Description of Artificial Sequence: Synthetic peptide"
NAIIFSESF

SEQ ID NO: 25736 - protein, 9 aa, Artificial Sequence
  source: /note="Description of Artificial Sequence: Synthetic peptide"
FSESFADVL

SEQ ID NO: 25737 - protein, 10 aa, Artificial Sequence
  source: /note="Description of Artificial Sequence: Synthetic peptide"
IIFSESFADV

SEQ ID NO: 25738 - protein, 10 aa, Artificial Sequence
  source: /note="Description of Artificial Sequence: Synthetic peptide"
IFSESFADVL

SEQ ID NO: 25739 - protein, 10 aa, Artificial Sequence
  source: /note="Description of Artificial Sequence: Synthetic peptide"
NAIIFSESFA

SEQ ID NO: 25740 - protein, 10 aa, Artificial Sequence
  source: /note="Description of Artificial Sequence: Synthetic peptide"
KNAIIFSESF

SEQ ID NO: 25741 - protein, 9 aa, Artificial Sequence
  source: /note="Description of Artificial Sequence: Synthetic peptide"
RLIPAPGGT

SEQ ID NO: 25742 - protein, 9 aa, Artificial Sequence
  source: /note="Description of Artificial Sequence: Synthetic peptide"
LVRLIPAPG

SEQ ID NO: 25743 - protein, 9 aa, Artificial Sequence
  source: /note="Description of Artificial Sequence: Synthetic peptide"
IPAPGGTGI

SEQ ID NO: 25744 - protein, 10 aa, Artificial Sequence
  source: /note="Description of Artificial Sequence: Synthetic peptide"
LIPAPGGTGI

SEQ ID NO: 25745 - protein, 10 aa, Artificial Sequence
  source: /note="Description of Artificial Sequence: Synthetic peptide"
IPAPGGTGIV

SEQ ID NO: 25746 - protein, 9 aa, Artificial Sequence
  source: /note="Description of Artificial Sequence: Synthetic peptide"
VLALKHLHK

SEQ ID NO: 25747 - protein, 9 aa, Artificial Sequence
  source: /note="Description of Artificial Sequence: Synthetic peptide"
LALKHLHKL

SEQ ID NO: 25748 - protein, 9 aa, Artificial Sequence
  source: /note="Description of Artificial Sequence: Synthetic peptide"
LKHLHKLGI

SEQ ID NO: 25749 - protein, 10 aa, Artificial Sequence
  source: /note="Description of Artificial Sequence: Synthetic peptide"
VLALKHLHKL

SEQ ID NO: 25750 - protein, 10 aa, Artificial Sequence
  source: /note="Description of Artificial Sequence: Synthetic peptide"
ALKHLHKLGI

SEQ ID NO: 25751 - protein, 10 aa, Artificial Sequence
  source: /note="Description of Artificial Sequence: Synthetic peptide"
IVLALKHLHK

SEQ ID NO: 25752 - protein, 10 aa, Artificial Sequence
  source: /note="Description of Artificial Sequence: Synthetic peptide"
YVGEIVLALK

SEQ ID NO: 25753 - protein, 10 aa, Artificial Sequence
  source: /note="Description of Artificial Sequence: Synthetic peptide"
KHLHKLGIIY

SEQ ID NO: 25754 - protein, 10 aa, Artificial Sequence
  source: /note="Description of Artificial Sequence: Synthetic peptide"
GEIVLALKHL

SEQ ID NO: 25755 - protein, 10 aa, Artificial Sequence
  source: /note="Description of Artificial Sequence: Synthetic peptide"
LKHLHKLGII

SEQ ID NO: 25756 - protein, 9 aa, Artificial Sequence
  source: /note="Description of Artificial Sequence: Synthetic peptide"
ENAAQFGEV

SEQ ID NO: 25757 - protein, 9 aa, Artificial Sequence
  source: /note="Description of Artificial Sequence: Synthetic peptide"
QINENAAQF

SEQ ID NO: 25758 - protein, 9 aa, Artificial Sequence
  source: /note="Description of Artificial Sequence: Synthetic peptide"
VQINENAAQ

SEQ ID NO: 25759 - protein, 10 aa, Artificial Sequence
  source: /note="Description of Artificial Sequence: Synthetic peptide"
VQINENAAQF

SEQ ID NO: 25760 - protein, 10 aa, Artificial Sequence
  source: /note="Description of Artificial Sequence: Synthetic peptide"
ENAAQFGEVY

SEQ ID NO: 25761 - protein, 10 aa, Artificial Sequence
  source: /note="Description of Artificial Sequence: Synthetic peptide"
NENAAQFGEV

SEQ ID NO: 25762 - protein, 10 aa, Artificial Sequence
  source: /note="Description of Artificial Sequence: Synthetic peptide"
LPIVQINENA

SEQ ID NO: 25763 - protein, 9 aa, Artificial Sequence
  source: /note="Description of Artificial Sequence: Synthetic peptide"
ILVEVNHHL

SEQ ID NO: 25764 - protein, 9 aa, Artificial Sequence
  source: /note="Description of Artificial Sequence: Synthetic peptide"
LLSNCTMPF

SEQ ID NO: 25765 - protein, 9 aa, Artificial Sequence
  source: /note="Description of Artificial Sequence: Synthetic peptide"
LSNCTMPFR

SEQ ID NO: 25766 - protein, 9 aa, Artificial Sequence
  source: /note="Description of Artificial Sequence: Synthetic peptide"
HHLLSNCTM

SEQ ID NO: 25767 - protein, 10 aa, Artificial Sequence
  source: /note="Description of Artificial Sequence: Synthetic peptide"
ILVEVNHHLL

SEQ ID NO: 25768 - protein, 10 aa, Artificial Sequence
  source: /note="Description of Artificial Sequence: Synthetic peptide"
LLSNCTMPFR

SEQ ID NO: 25769 - protein, 10 aa, Artificial Sequence
  source: /note="Description of Artificial Sequence: Synthetic peptide"
SNCTMPFRLK

SEQ ID NO: 25770 - protein, 10 aa, Artificial Sequence
  source: /note="Description of Artificial Sequence: Synthetic peptide"
HLLSNCTMPF

SEQ ID NO: 25771 - protein, 10 aa, Artificial Sequence
  source: /note="Description of Artificial Sequence: Synthetic peptide"
NHHLLSNCTM

SEQ ID NO: 25772 - protein, 9 aa, Artificial Sequence
  source: /note="Description of Artificial Sequence: Synthetic peptide"
FTNEIQAAF

SEQ ID NO: 25773 - protein, 9 aa, Artificial Sequence
  source: /note="Description of Artificial Sequence: Synthetic peptide"
TPGTFTNEI

SEQ ID NO: 25774 - protein, 10 aa, Artificial Sequence
  source: /note="Description of Artificial Sequence: Synthetic peptide"
FTPGTFTNEI

SEQ ID NO: 25775 - protein, 10 aa, Artificial Sequence
  source: /note="Description of Artificial Sequence: Synthetic peptide"
TFTNEIQAAF

SEQ ID NO: 25776 - protein, 10 aa, Artificial Sequence
  source: /note="Description of Artificial Sequence: Synthetic peptide"
EIQAAFWEPR

SEQ ID NO: 25777 - protein, 10 aa, Artificial Sequence
  source: /note="Description of Artificial Sequence: Synthetic peptide"
NEIQAAFWEP

SEQ ID NO: 25778 - protein, 10 aa, Artificial Sequence
  source: /note="Description of Artificial Sequence: Synthetic peptide"
FTNEIQAAFW

SEQ ID NO: 25779 - protein, 9 aa, Artificial Sequence
  source: /note="Description of Artificial Sequence: Synthetic peptide"
SSHYSQPNR

SEQ ID NO: 25780 - protein, 10 aa, Artificial Sequence
  source: /note="Description of Artificial Sequence: Synthetic peptide"
TNRQGQSSHY

SEQ ID NO: 25781 - protein, 10 aa, Artificial Sequence
  source: /note="Description of Artificial Sequence: Synthetic peptide"
GQSSHYSQPN

SEQ ID NO: 25782 - protein, 9 aa, Artificial Sequence
  source: /note="Description of Artificial Sequence: Synthetic peptide"
GQSSHYSQI

SEQ ID NO: 25783 - protein, 9 aa, Artificial Sequence
  source: /note="Description of Artificial Sequence: Synthetic peptide"
SSHYSQIDR

SEQ ID NO: 25784 - protein, 10 aa, Artificial Sequence
  source: /note="Description of Artificial Sequence: Synthetic peptide"
SQIDRQGQSS

SEQ ID NO: 25785 - protein, 10 aa, Artificial Sequence
  source: /note="Description of Artificial Sequence: Synthetic peptide"
IDRQGQSSHY

SEQ ID NO: 25786 - protein, 10 aa, Artificial Sequence
  source: /note="Description of Artificial Sequence: Synthetic peptide"
SQTDRQDQSY

SEQ ID NO: 25787 - protein, 9 aa, Artificial Sequence
  source: /note="Description of Artificial Sequence: Synthetic peptide"
KEKRFLGRI

SEQ ID NO: 25788 - protein, 10 aa, Artificial Sequence
  source: /note="Description of Artificial Sequence: Synthetic peptide"
KEKRFLGRIV

SEQ ID NO: 25789 - protein, 9 aa, Artificial Sequence
  source: /note="Description of Artificial Sequence: Synthetic peptide"
GVHKGRKPF

SEQ ID NO: 25790 - protein, 10 aa, Artificial Sequence
  source: /note="Description of Artificial Sequence: Synthetic peptide"
CGRGLGGVHK

SEQ ID NO: 25791 - protein, 9 aa, Artificial Sequence
  source: /note="Description of Artificial Sequence: Synthetic peptide"
MAAPLLHTC

SEQ ID NO: 25792 - protein, 10 aa, Artificial Sequence
  source: /note="Description of Artificial Sequence: Synthetic peptide"
LLHTCLPGDA

SEQ ID NO: 25793 - protein, 10 aa, Artificial Sequence
  source: /note="Description of Artificial Sequence: Synthetic peptide"
MAAPLLHTCL

SEQ ID NO: 25794 - protein, 10 aa, Artificial Sequence
  source: /note="Description of Artificial Sequence: Synthetic peptide"
HTCLPGDAAA

SEQ ID NO: 25795 - protein, 9 aa, Artificial Sequence
  source: /note="Description of Artificial Sequence: Synthetic peptide"
HTRLSGDAA

SEQ ID NO: 25796 - protein, 10 aa, Artificial Sequence
  source: /note="Description of Artificial Sequence: Synthetic peptide"
LLHTRLSGDA

SEQ ID NO: 25797 - protein, 10 aa, Artificial Sequence
  source: /note="Description of Artificial Sequence: Synthetic peptide"
HTRLSGDAAA

SEQ ID NO: 25798 - protein, 9 aa, Artificial Sequence
  source: /note="Description of Artificial Sequence: Synthetic peptide"
SKKDFISVF

SEQ ID NO: 25799 - protein, 10 aa, Artificial Sequence
  source: /note="Description of Artificial Sequence: Synthetic peptide"
VSKKDFISVF

SEQ ID NO: 25800 - protein, 10 aa, Artificial Sequence
  source: /note="Description of Artificial Sequence: Synthetic peptide"
KDFISVFRGM

SEQ ID NO: 25801 - protein, 9 aa, Artificial Sequence
  source: /note="Description of Artificial Sequence: Synthetic peptide"
GSCPRSAWK

SEQ ID NO: 25802 - protein, 9 aa, Artificial Sequence
  source: /note="Description of Artificial Sequence: Synthetic peptide"
STSCGSCPR

SEQ ID NO: 25803 - protein, 9 aa, Artificial Sequence
  source: /note="Description of Artificial Sequence: Synthetic peptide"
RRRPSYRPW

SEQ ID NO: 25804 - protein, 9 aa, Artificial Sequence
  source: /note="Description of Artificial Sequence: Synthetic peptide"
SYRPWRGTT

SEQ ID NO: 25805 - protein, 9 aa, Artificial Sequence
  source: /note="Description of Artificial Sequence: Synthetic peptide"
LLASDRNPR

SEQ ID NO: 25806 - protein, 9 aa, Artificial Sequence
  source: /note="Description of Artificial Sequence: Synthetic peptide"
APDPRRRPS

SEQ ID NO: 25807 - protein, 9 aa, Artificial Sequence
  source: /note="Description of Artificial Sequence: Synthetic peptide"
CGSCPRSAW

SEQ ID NO: 25808 - protein, 10 aa, Artificial Sequence
  source: /note="Description of Artificial Sequence: Synthetic peptide"
SSTSCGSCPR

SEQ ID NO: 25809 - protein, 10 aa, Artificial Sequence
  source: /note="Description of Artificial Sequence: Synthetic peptide"
CGSCPRSAWK

SEQ ID NO: 25810 - protein, 10 aa, Artificial Sequence
  source: /note="Description of Artificial Sequence: Synthetic peptide"
GSCPRSAWKR

SEQ ID NO: 25811 - protein, 10 aa, Artificial Sequence
  source: /note="Description of Artificial Sequence: Synthetic peptide"
RRRPSYRPWR

SEQ ID NO: 25812 - protein, 10 aa, Artificial Sequence
  source: /note="Description of Artificial Sequence: Synthetic peptide"
SYRPWRGTTR

SEQ ID NO: 25813 - protein, 10 aa, Artificial Sequence
  source: /note="Description of Artificial Sequence: Synthetic peptide"
NLLASDRNPR

SEQ ID NO: 25814 - protein, 10 aa, Artificial Sequence
  source: /note="Description of Artificial Sequence: Synthetic peptide"
APDPRRRPSY

SEQ ID NO: 25815 - protein, 10 aa, Artificial Sequence
  source: /note="Description of Artificial Sequence: Synthetic peptide"
RPSYRPWRGT

SEQ ID NO: 25816 - protein, 10 aa, Artificial Sequence
  source: /note="Description of Artificial Sequence: Synthetic peptide"
RPWRGTTRNC

SEQ ID NO: 25817 - protein, 9 aa, Artificial Sequence
  source: /note="Description of Artificial Sequence: Synthetic peptide"
RTSEPRKVL

SEQ ID NO: 25818 - protein, 10 aa, Artificial Sequence
  source: /note="Description of Artificial Sequence: Synthetic peptide"
RTSEPRKVLF

SEQ ID NO: 25819 - protein, 10 aa, Artificial Sequence
  source: /note="Description of Artificial Sequence: Synthetic peptide"
LPRTSEPRKV

SEQ ID NO: 25820 - protein, 10 aa, Artificial Sequence
  source: /note="Description of Artificial Sequence: Synthetic peptide"
QAKIPLKNEK

SEQ ID NO: 25821 - protein, 10 aa, Artificial Sequence
  source: /note="Description of Artificial Sequence: Synthetic peptide"
AKIPLKNEKL

SEQ ID NO: 25822 - protein, 9 aa, Artificial Sequence
  source: /note="Description of Artificial Sequence: Synthetic peptide"
QGNRWRCSK

SEQ ID NO: 25823 - protein, 9 aa, Artificial Sequence
  source: /note="Description of Artificial Sequence: Synthetic peptide"
RWRCSKRAS

SEQ ID NO: 25824 - protein, 9 aa, Artificial Sequence
  source: /note="Description of Artificial Sequence: Synthetic peptide"
RCSKRASYV

SEQ ID NO: 25825 - protein, 9 aa, Artificial Sequence
  source: /note="Description of Artificial Sequence: Synthetic peptide"
WRCSKRASY

SEQ ID NO: 25826 - protein, 10 aa, Artificial Sequence
  source: /note="Description of Artificial Sequence: Synthetic peptide"
CQGNRWRCSK

SEQ ID NO: 25827 - protein, 10 aa, Artificial Sequence
  source: /note="Description of Artificial Sequence: Synthetic peptide"
RWRCSKRASY

SEQ ID NO: 25828 - protein, 10 aa, Artificial Sequence
  source: /note="Description of Artificial Sequence: Synthetic peptide"
QGNRWRCSKR

SEQ ID NO: 25829 - protein, 9 aa, Artificial Sequence
  source: /note="Description of Artificial Sequence: Synthetic peptide"
EGWCYTSLI

SEQ ID NO: 25830 - protein, 9 aa, Artificial Sequence
  source: /note="Description of Artificial Sequence: Synthetic peptide"
GEGWCYTSL

SEQ ID NO: 25831 - protein, 10 aa, Artificial Sequence
  source: /note="Description of Artificial Sequence: Synthetic peptide"
TSKDGEGWCY

SEQ ID NO: 25832 - protein, 10 aa, Artificial Sequence
  source: /note="Description of Artificial Sequence: Synthetic peptide"
GEGWCYTSLI

SEQ ID NO: 25833 - protein, 9 aa, Artificial Sequence
  source: /note="Description of Artificial Sequence: Synthetic peptide"
VQRGPTPLL

SEQ ID NO: 25834 - protein, 9 aa, Artificial Sequence
  source: /note="Description of Artificial Sequence: Synthetic peptide"
PLLLSSGFY

SEQ ID NO: 25835 - protein, 9 aa, Artificial Sequence
  source: /note="Description of Artificial Sequence: Synthetic peptide"
WVQRGPTPL

SEQ ID NO: 25836 - protein, 9 aa, Artificial Sequence
  source: /note="Description of Artificial Sequence: Synthetic peptide"
TPLLLSSGF

SEQ ID NO: 25837 - protein, 10 aa, Artificial Sequence
  source: /note="Description of Artificial Sequence: Synthetic peptide"
VQRGPTPLLL

SEQ ID NO: 25838 - protein, 10 aa, Artificial Sequence
  source: /note="Description of Artificial Sequence: Synthetic peptide"
GWVQRGPTPL

SEQ ID NO: 25839 - protein, 10 aa, Artificial Sequence
  source: /note="Description of Artificial Sequence: Synthetic peptide"
TPLLLSSGFY

SEQ ID NO: 25840 - protein, 9 aa, Artificial Sequence
  source: /note="Description of Artificial Sequence: Synthetic peptide"
VVALGGCSR

SEQ ID NO: 25841 - protein, 9 aa, Artificial Sequence
  source: /note="Description of Artificial Sequence: Synthetic peptide"
VALGGCSRW

SEQ ID NO: 25842 - protein, 10 aa, Artificial Sequence
  source: /note="Description of Artificial Sequence: Synthetic peptide"
KVVALGGCSR

SEQ ID NO: 25843 - protein, 10 aa, Artificial Sequence
  source: /note="Description of Artificial Sequence: Synthetic peptide"
RWHSGHCDGW

SEQ ID NO: 25844 - protein, 9 aa, Artificial Sequence
  source: /note="Description of Artificial Sequence: Synthetic peptide"
LGFVGRSGR

SEQ ID NO: 25845 - protein, 9 aa, Artificial Sequence
  source: /note="Description of Artificial Sequence: Synthetic peptide"
VARFNDLGF

SEQ ID NO: 25846 - protein, 10 aa, Artificial Sequence
  source: /note="Description of Artificial Sequence: Synthetic peptide"
VARFNDLGFV

SEQ ID NO: 25847 - protein, 10 aa, Artificial Sequence
  source: /note="Description of Artificial Sequence: Synthetic peptide"
RFNDLGFVGR

SEQ ID NO: 25848 - protein, 10 aa, Artificial Sequence
  source: /note="Description of Artificial Sequence: Synthetic peptide"
DLGFVGRSGR

SEQ ID NO: 25849 - protein, 10 aa, Artificial Sequence
  source: /note="Description of Artificial Sequence: Synthetic peptide"
QVARFNDLGF

SEQ ID NO: 25850 - protein, 9 aa, Artificial Sequence
  source: /note="Description of Artificial Sequence: Synthetic peptide"
KLHSDHHCL

SEQ ID NO: 25851 - protein, 9 aa, Artificial Sequence
  source: /note="Description of Artificial Sequence: Synthetic peptide"
CLHKPTASR

SEQ ID NO: 25852 - protein, 9 aa, Artificial Sequence
  source: /note="Description of Artificial Sequence: Synthetic peptide"
HSDHHCLHK

SEQ ID NO: 25853 - protein, 9 aa, Artificial Sequence
  source: /note="Description of Artificial Sequence: Synthetic peptide"
SGWAPRTSK

SEQ ID NO: 25854 - protein, 9 aa, Artificial Sequence
  source: /note="Description of Artificial Sequence: Synthetic peptide"
VGRSGKREK

SEQ ID NO: 25855 - protein, 9 aa, Artificial Sequence
  source: /note="Description of Artificial Sequence: Synthetic peptide"
ASRHLPQSH

SEQ ID NO: 25856 - protein, 9 aa, Artificial Sequence
  source: /note="Description of Artificial Sequence: Synthetic peptide"
RTSKTSAET

SEQ ID NO: 25857 - protein, 9 aa, Artificial Sequence
  source: /note="Description of Artificial Sequence: Synthetic peptide"
RFVGRSGKR

SEQ ID NO: 25858 - protein, 9 aa, Artificial Sequence
  source: /note="Description of Artificial Sequence: Synthetic peptide"
QNHSGWAPR

SEQ ID NO: 25859 - protein, 9 aa, Artificial Sequence
  source: /note="Description of Artificial Sequence: Synthetic peptide"
APRTSKTSA

SEQ ID NO: 25860 - protein, 9 aa, Artificial Sequence
  source: /note="Description of Artificial Sequence: Synthetic peptide"
QSHQNHSGW

SEQ ID NO: 25861 - protein, 9 aa, Artificial Sequence
  source: /note="Description of Artificial Sequence: Synthetic peptide"
HQNHSGWAP

SEQ ID NO: 25862 - protein, 10 aa, Artificial Sequence
  source: /note="Description of Artificial Sequence: Synthetic peptide"
HSGWAPRTSK

SEQ ID NO: 25863 - protein, 10 aa, Artificial Sequence
  source: /note="Description of Artificial Sequence: Synthetic peptide"
RTSKTSAETR

SEQ ID NO: 25864 - protein, 10 aa, Artificial Sequence
  source: /note="Description of Artificial Sequence: Synthetic peptide"
KLHSDHHCLH

SEQ ID NO: 25865 - protein, 10 aa, Artificial Sequence
  source: /note="Description of Artificial Sequence: Synthetic peptide"
HQNHSGWAPR

SEQ ID NO: 25866 - protein, 10 aa, Artificial Sequence
  source: /note="Description of Artificial Sequence: Synthetic peptide"
HCLHKPTASR

SEQ ID NO: 25867 - protein, 10 aa, Artificial Sequence
  source: /note="Description of Artificial Sequence: Synthetic peptide"
LHKPTASRHL

SEQ ID NO: 25868 - protein, 9 aa, Artificial Sequence
  source: /note="Description of Artificial Sequence: Synthetic peptide"
AITDVPMRI

SEQ ID NO: 25869 - protein, 9 aa, Artificial Sequence
  source: /note="Description of Artificial Sequence: Synthetic peptide"
LPAITDVPM

SEQ ID NO: 25870 - protein, 10 aa, Artificial Sequence
  source: /note="Description of Artificial Sequence: Synthetic peptide"
GLPAITDVPM

SEQ ID NO: 25871 - protein, 9 aa, Artificial Sequence
  source: /note="Description of Artificial Sequence: Synthetic peptide"
RSHSRMLPP

SEQ ID NO: 25872 - protein, 9 aa, Artificial Sequence
  source: /note="Description of Artificial Sequence: Synthetic peptide"
HSRMLPPCT

SEQ ID NO: 25873 - protein, 10 aa, Artificial Sequence
  source: /note="Description of Artificial Sequence: Synthetic peptide"
RSHSRMLPPC

SEQ ID NO: 25874 - protein, 10 aa, Artificial Sequence
  source: /note="Description of Artificial Sequence: Synthetic peptide"
HSRMLPPCTT

SEQ ID NO: 25875 - protein, 9 aa, Artificial Sequence
  source: /note="Description of Artificial Sequence: Synthetic peptide"
QQQQEEAAA

SEQ ID NO: 25876 - protein, 9 aa, Artificial Sequence
  source: /note="Description of Artificial Sequence: Synthetic peptide"
QQQEEAAAA

SEQ ID NO: 25877 - protein, 9 aa, Artificial Sequence
  source: /note="Description of Artificial Sequence: Synthetic peptide"
QQEEAAAAA

SEQ ID NO: 25878 - protein, 10 aa, Artificial Sequence
  source: /note="Description of Artificial Sequence: Synthetic peptide"
QQQQEEAAAA

SEQ ID NO: 25879 - protein, 10 aa, Artificial Sequence
  source: /note="Description of Artificial Sequence: Synthetic peptide"
QQQEEAAAAA

SEQ ID NO: 25880 - protein, 10 aa, Artificial Sequence
  source: /note="Description of Artificial Sequence: Synthetic peptide"
QQEEAAAAAA

SEQ ID NO: 25881 - protein, 10 aa, Artificial Sequence
  source: /note="Description of Artificial Sequence: Synthetic peptide"
QEEAAAAAAA

SEQ ID NO: 25882 - protein, 9 aa, Artificial Sequence
  source: /note="Description of Artificial Sequence: Synthetic peptide"
AMIAACSAA

SEQ ID NO: 25883 - protein, 9 aa, Artificial Sequence
  source: /note="Description of Artificial Sequence: Synthetic peptide"
MIAACSAAL

SEQ ID NO: 25884 - protein, 9 aa, Artificial Sequence
  source: /note="Description of Artificial Sequence: Synthetic peptide"
AALLSAWAR

SEQ ID NO: 25885 - protein, 9 aa, Artificial Sequence
  source: /note="Description of Artificial Sequence: Synthetic peptide"
ALLSAWARW

SEQ ID NO: 25886 - protein, 9 aa, Artificial Sequence
  source: /note="Description of Artificial Sequence: Synthetic peptide"
NTSPPTSAL

SEQ ID NO: 25887 - protein, 9 aa, Artificial Sequence
  source: /note="Description of Artificial Sequence: Synthetic peptide"
SALDVSAPA

SEQ ID NO: 25888 - protein, 9 aa, Artificial Sequence
  source: /note="Description of Artificial Sequence: Synthetic peptide"
DVSAPAAMI

SEQ ID NO: 25889 - protein, 9 aa, Artificial Sequence
  source: /note="Description of Artificial Sequence: Synthetic peptide"
SAPAAMIAA

SEQ ID NO: 25890 - protein, 9 aa, Artificial Sequence
  source: /note="Description of Artificial Sequence: Synthetic peptide"
IAACSAALL

SEQ ID NO: 25891 - protein, 9 aa, Artificial Sequence
  source: /note="Description of Artificial Sequence: Synthetic peptide"
SAALLSAWA

SEQ ID NO: 25892 - protein, 9 aa, Artificial Sequence
  source: /note="Description of Artificial Sequence: Synthetic peptide"
LSAWARWNV

SEQ ID NO: 25893 - protein, 9 aa, Artificial Sequence
  source: /note="Description of Artificial Sequence: Synthetic peptide"
APAAMIAAC

SEQ ID NO: 25894 - protein, 9 aa, Artificial Sequence
  source: /note="Description of Artificial Sequence: Synthetic peptide"
LDVSAPAAM

SEQ ID NO: 25895 - protein, 9 aa, Artificial Sequence
  source: /note="Description of Artificial Sequence: Synthetic peptide"
CSAALLSAW

SEQ ID NO: 25896 - protein, 10 aa, Artificial Sequence
  source: /note="Description of Artificial Sequence: Synthetic peptide"
AMIAACSAAL

SEQ ID NO: 25897 - protein, 10 aa, Artificial Sequence
  source: /note="Description of Artificial Sequence: Synthetic peptide"
MIAACSAALL

SEQ ID NO: 25898 - protein, 10 aa, Artificial Sequence
  source: /note="Description of Artificial Sequence: Synthetic peptide"
LLSAWARWNV

SEQ ID NO: 25899 - protein, 10 aa, Artificial Sequence
  source: /note="Description of Artificial Sequence: Synthetic peptide"
SAALLSAWAR

SEQ ID NO: 25900 - protein, 10 aa, Artificial Sequence
  source: /note="Description of Artificial Sequence: Synthetic peptide"
YTNTSPPTSA

SEQ ID NO: 25901 - protein, 10 aa, Artificial Sequence
  source: /note="Description of Artificial Sequence: Synthetic peptide"
TSALDVSAPA

SEQ ID NO: 25902 - protein, 10 aa, Artificial Sequence
  source: /note="Description of Artificial Sequence: Synthetic peptide"
DVSAPAAMIA

SEQ ID NO: 25903 - protein, 10 aa, Artificial Sequence
  source: /note="Description of Artificial Sequence: Synthetic peptide"
CSAALLSAWA

SEQ ID NO: 25904 - protein, 10 aa, Artificial Sequence
  source: /note="Description of Artificial Sequence: Synthetic peptide"
ALDVSAPAAM

SEQ ID NO: 25905 - protein, 10 aa, Artificial Sequence
  source: /note="Description of Artificial Sequence: Synthetic peptide"
AAMIAACSAA

SEQ ID NO: 25906 - protein, 10 aa, Artificial Sequence
  source: /note="Description of Artificial Sequence: Synthetic peptide"
ACSAALLSAW

SEQ ID NO: 25907 - protein, 10 aa, Artificial Sequence
  source: /note="Description of Artificial Sequence: Synthetic peptide"
AALLSAWARW

SEQ ID NO: 25908 - protein, 9 aa, Artificial Sequence
  source: /note="Description of Artificial Sequence: Synthetic peptide"
HVKEISELF

SEQ ID NO: 25909 - protein, 9 aa, Artificial Sequence
  source: /note="Description of Artificial Sequence: Synthetic peptide"
VKEISELFY

SEQ ID NO: 25910 - protein, 9 aa, Artificial Sequence
  source: /note="Description of Artificial Sequence: Synthetic peptide"
IEKEHVKEI

SEQ ID NO: 25911 - protein, 10 aa, Artificial Sequence
  source: /note="Description of Artificial Sequence: Synthetic peptide"
HVKEISELFY

SEQ ID NO: 25912 - protein, 10 aa, Artificial Sequence
  source: /note="Description of Artificial Sequence: Synthetic peptide"
KEHVKEISEL

SEQ ID NO: 25913 - protein, 10 aa, Artificial Sequence
  source: /note="Description of Artificial Sequence: Synthetic peptide"
KEISELFYDA

SEQ ID NO: 25914 - protein, 9 aa, Artificial Sequence
  source: /note="Description of Artificial Sequence: Synthetic peptide"
VLMENFCRA

SEQ ID NO: 25915 - protein, 9 aa, Artificial Sequence
  source: /note="Description of Artificial Sequence: Synthetic peptide"
EVLMENFCR

SEQ ID NO: 25916 - protein, 9 aa, Artificial Sequence
  source: /note="Description of Artificial Sequence: Synthetic peptide"
NFCRAIGLR

SEQ ID NO: 25917 - protein, 9 aa, Artificial Sequence
  source: /note="Description of Artificial Sequence: Synthetic peptide"
LMENFCRAI

SEQ ID NO: 25918 - protein, 10 aa, Artificial Sequence
  source: /note="Description of Artificial Sequence: Synthetic peptide"
VLMENFCRAI

SEQ ID NO: 25919 - protein, 10 aa, Artificial Sequence
  source: /note="Description of Artificial Sequence: Synthetic peptide"
NFCRAIGLRI

SEQ ID NO: 25920 - protein, 10 aa, Artificial Sequence
  source: /note="Description of Artificial Sequence: Synthetic peptide"
FCRAIGLRIK

SEQ ID NO: 25921 - protein, 10 aa, Artificial Sequence
  source: /note="Description of Artificial Sequence: Synthetic peptide"
ENFCRAIGLR

SEQ ID NO: 25922 - protein, 10 aa, Artificial Sequence
  source: /note="Description of Artificial Sequence: Synthetic peptide"
EVLMENFCRA

SEQ ID NO: 25923 - protein, 10 aa, Artificial Sequence
  source: /note="Description of Artificial Sequence: Synthetic peptide"
MENFCRAIGL

SEQ ID NO: 25924 - protein, 9 aa, Artificial Sequence
  source: /note="Description of Artificial Sequence: Synthetic peptide"
ILIHHREDI

SEQ ID NO: 25925 - protein, 9 aa, Artificial Sequence
  source: /note="Description of Artificial Sequence: Synthetic peptide"
IHHREDIPF

SEQ ID NO: 25926 - protein, 10 aa, Artificial Sequence
  source: /note="Description of Artificial Sequence: Synthetic peptide"
KLNWKRILIH

SEQ ID NO: 25927 - protein, 10 aa, Artificial Sequence
  source: /note="Description of Artificial Sequence: Synthetic peptide"
RILIHHREDI

SEQ ID NO: 25928 - protein, 10 aa, Artificial Sequence
  source: /note="Description of Artificial Sequence: Synthetic peptide"
NWKRILIHHR

SEQ ID NO: 25929 - protein, 10 aa, Artificial Sequence
  source: /note="Description of Artificial Sequence: Synthetic peptide"
LIHHREDIPF

SEQ ID NO: 25930 - protein, 9 aa, Artificial Sequence
  source: /note="Description of Artificial Sequence: Synthetic peptide"
GLNYLILLV

SEQ ID NO: 25931 - protein, 9 aa, Artificial Sequence
  source: /note="Description of Artificial Sequence: Synthetic peptide"
TFYGLNYLI

SEQ ID NO: 25932 - protein, 9 aa, Artificial Sequence
  source: /note="Description of Artificial Sequence: Synthetic peptide"
FYGLNYLIL

SEQ ID NO: 25933 - protein, 9 aa, Artificial Sequence
  source: /note="Description of Artificial Sequence: Synthetic peptide"
YGLNYLILL

SEQ ID NO: 25934 - protein, 9 aa, Artificial Sequence
  source: /note="Description of Artificial Sequence: Synthetic peptide"
NYLILLVLM

SEQ ID NO: 25935 - protein, 9 aa, Artificial Sequence
  source: /note="Description of Artificial Sequence: Synthetic peptide"
LNYLILLVL

SEQ ID NO: 25936 - protein, 10 aa, Artificial Sequence
  source: /note="Description of Artificial Sequence: Synthetic peptide"
YGLNYLILLV

SEQ ID NO: 25937 - protein, 10 aa, Artificial Sequence
  source: /note="Description of Artificial Sequence: Synthetic peptide"
GLNYLILLVL

SEQ ID NO: 25938 - protein, 10 aa, Artificial Sequence
  source: /note="Description of Artificial Sequence: Synthetic peptide"
TFYGLNYLIL

SEQ ID NO: 25939 - protein, 10 aa, Artificial Sequence
  source: /note="Description of Artificial Sequence: Synthetic peptide"
FYGLNYLILL

SEQ ID NO: 25940 - protein, 10 aa, Artificial Sequence
  source: /note="Description of Artificial Sequence: Synthetic peptide"
LNYLILLVLM

SEQ ID NO: 25941 - protein, 10 aa, Artificial Sequence
  source: /note="Description of Artificial Sequence: Synthetic peptide"
SPPTFYGLNY

SEQ ID NO: 25942 - protein, 9 aa, Artificial Sequence
  source: /note="Description of Artificial Sequence: Synthetic peptide"
LLRLPALRY

SEQ ID NO: 25943 - protein, 9 aa, Artificial Sequence
  source: /note="Description of Artificial Sequence: Synthetic peptide"
LPALRYIGL

SEQ ID NO: 25944 - protein, 9 aa, Artificial Sequence
  source: /note="Description of Artificial Sequence: Synthetic peptide"
LRYIGLKCL

SEQ ID NO: 25945 - protein, 10 aa, Artificial Sequence
  source: /note="Description of Artificial Sequence: Synthetic peptide"
RLPALRYIGL

SEQ ID NO: 25946 - protein, 10 aa, Artificial Sequence
  source: /note="Description of Artificial Sequence: Synthetic peptide"
LLRLPALRYI

SEQ ID NO: 25947 - protein, 10 aa, Artificial Sequence
  source: /note="Description of Artificial Sequence: Synthetic peptide"
ALRYIGLKCL

SEQ ID NO: 25948 - protein, 10 aa, Artificial Sequence
  source: /note="Description of Artificial Sequence: Synthetic peptide"
YIGLKCLEHL

SEQ ID NO: 25949 - protein, 10 aa, Artificial Sequence
  source: /note="Description of Artificial Sequence: Synthetic peptide"
LLLRLPALRY

SEQ ID NO: 25950 - protein, 9 aa, Artificial Sequence
  source: /note="Description of Artificial Sequence: Synthetic peptide"
LPALRFIGL

SEQ ID NO: 25951 - protein, 9 aa, Artificial Sequence
  source: /note="Description of Artificial Sequence: Synthetic peptide"
LLRLPALRF

SEQ ID NO: 25952 - protein, 9 aa, Artificial Sequence
  source: /note="Description of Artificial Sequence: Synthetic peptide"
LRFIGLKCL

SEQ ID NO: 25953 - protein, 10 aa, Artificial Sequence
  source: /note="Description of Artificial Sequence: Synthetic peptide"
RLPALRFIGL

SEQ ID NO: 25954 - protein, 10 aa, Artificial Sequence
  source: /note="Description of Artificial Sequence: Synthetic peptide"
FIGLKCLEHL

SEQ ID NO: 25955 - protein, 10 aa, Artificial Sequence
  source: /note="Description of Artificial Sequence: Synthetic peptide"
LLRLPALRFI

SEQ ID NO: 25956 - protein, 10 aa, Artificial Sequence
  source: /note="Description of Artificial Sequence: Synthetic peptide"
LLLRLPALRF

SEQ ID NO: 25957 - protein, 9 aa, Artificial Sequence
  source: /note="Description of Artificial Sequence: Synthetic peptide"
MVYEVTPFL

SEQ ID NO: 25958 - protein, 9 aa, Artificial Sequence
  source: /note="Description of Artificial Sequence: Synthetic peptide"
KWYFEVMVY

SEQ ID NO: 25959 - protein, 9 aa, Artificial Sequence
  source: /note="Description of Artificial Sequence: Synthetic peptide"
VMVYEVTPF

SEQ ID NO: 25960 - protein, 9 aa, Artificial Sequence
  source: /note="Description of Artificial Sequence: Synthetic peptide"
YEVTPFLTA

SEQ ID NO: 25961 - protein, 9 aa, Artificial Sequence
  source: /note="Description of Artificial Sequence: Synthetic peptide"
FEVMVYEVT

SEQ ID NO: 25962 - protein, 10 aa, Artificial Sequence
  source: /note="Description of Artificial Sequence: Synthetic peptide"
WYFEVMVYEV

SEQ ID NO: 25963 - protein, 10 aa, Artificial Sequence
  source: /note="Description of Artificial Sequence: Synthetic peptide"
VMVYEVTPFL

SEQ ID NO: 25964 - protein, 10 aa, Artificial Sequence
  source: /note="Description of Artificial Sequence: Synthetic peptide"
MVYEVTPFLT

SEQ ID NO: 25965 - protein, 10 aa, Artificial Sequence
  source: /note="Description of Artificial Sequence: Synthetic peptide"
EVMVYEVTPF

SEQ ID NO: 25966 - protein, 10 aa, Artificial Sequence
  source: /note="Description of Artificial Sequence: Synthetic peptide"
SKWYFEVMVY

SEQ ID NO: 25967 - protein, 10 aa, Artificial Sequence
  source: /note="Description of Artificial Sequence: Synthetic peptide"
YEVTPFLTAQ

SEQ ID NO: 25968 - protein, 10 aa, Artificial Sequence
  source: /note="Description of Artificial Sequence: Synthetic peptide"
FEVMVYEVTP

SEQ ID NO: 25969 - protein, 9 aa, Artificial Sequence
  source: /note="Description of Artificial Sequence: Synthetic peptide"
RTIMVDSML

SEQ ID NO: 25970 - protein, 9 aa, Artificial Sequence
  source: /note="Description of Artificial Sequence: Synthetic peptide"
HRTIMVDSM

SEQ ID NO: 25971 - protein, 10 aa, Artificial Sequence
  source: /note="Description of Artificial Sequence: Synthetic peptide"
RTIMVDSMLH

SEQ ID NO: 25972 - protein, 10 aa, Artificial Sequence
  source: /note="Description of Artificial Sequence: Synthetic peptide"
LFAGTEHRTI

SEQ ID NO: 25973 - protein, 10 aa, Artificial Sequence
  source: /note="Description of Artificial Sequence: Synthetic peptide"
FAGTEHRTIM

SEQ ID NO: 25974 - protein, 9 aa, Artificial Sequence
  source: /note="Description of Artificial Sequence: Synthetic peptide"
KVAELLANI

SEQ ID NO: 25975 - protein, 9 aa, Artificial Sequence
  source: /note="Description of Artificial Sequence: Synthetic peptide"
LLANIPDPT

SEQ ID NO: 25976 - protein, 9 aa, Artificial Sequence
  source: /note="Description of Artificial Sequence: Synthetic peptide"
IPDPTQDEV

SEQ ID NO: 25977 - protein, 10 aa, Artificial Sequence
  source: /note="Description of Artificial Sequence: Synthetic peptide"
NIPDPTQDEV

SEQ ID NO: 25978 - protein, 10 aa, Artificial Sequence
  source: /note="Description of Artificial Sequence: Synthetic peptide"
IKVAELLANI

SEQ ID NO: 25979 - protein, 10 aa, Artificial Sequence
  source: /note="Description of Artificial Sequence: Synthetic peptide"
AELLANIPDP

SEQ ID NO: 25980 - protein, 9 aa, Artificial Sequence
  source: /note="Description of Artificial Sequence: Synthetic peptide"
KEWGGNGVG

SEQ ID NO: 25981 - protein, 10 aa, Artificial Sequence
  source: /note="Description of Artificial Sequence: Synthetic peptide"
SPYPGGGKEW

SEQ ID NO: 25982 - protein, 9 aa, Artificial Sequence
  source: /note="Description of Artificial Sequence: Synthetic peptide"
GSLDGNSDF

SEQ ID NO: 25983 - protein, 10 aa, Artificial Sequence
  source: /note="Description of Artificial Sequence: Synthetic peptide"
SLDGNSDFTI

SEQ ID NO: 25984 - protein, 10 aa, Artificial Sequence
  source: /note="Description of Artificial Sequence: Synthetic peptide"
FTIRGRLLSL

SEQ ID NO: 25985 - protein, 9 aa, Artificial Sequence
  source: /note="Description of Artificial Sequence: Synthetic peptide"
LIHAGNGEA

SEQ ID NO: 25986 - protein, 9 aa, Artificial Sequence
  source: /note="Description of Artificial Sequence: Synthetic peptide"
IHAGNGEAI

SEQ ID NO: 25987 - protein, 10 aa, Artificial Sequence
  source: /note="Description of Artificial Sequence: Synthetic peptide"
HLIHAGNGEA

SEQ ID NO: 25988 - protein, 10 aa, Artificial Sequence
  source: /note="Description of Artificial Sequence: Synthetic peptide"
LIHAGNGEAI

SEQ ID NO: 25989 - protein, 9 aa, Artificial Sequence
  source: /note="Description of Artificial Sequence: Synthetic peptide"
RFSTTCFVV

SEQ ID NO: 25990 - protein, 9 aa, Artificial Sequence
  source: /note="Description of Artificial Sequence: Synthetic peptide"
GFRFSTTCF

SEQ ID NO: 25991 - protein, 9 aa, Artificial Sequence
  source: /note="Description of Artificial Sequence: Synthetic peptide"
FRFSTTCFV

SEQ ID NO: 25992 - protein, 10 aa, Artificial Sequence
  source: /note="Description of Artificial Sequence: Synthetic peptide"
GFRFSTTCFV

SEQ ID NO: 25993 - protein, 10 aa, Artificial Sequence
  source: /note="Description of Artificial Sequence: Synthetic peptide"
PGFRFSTTCF

SEQ ID NO: 25994 - protein, 10 aa, Artificial Sequence
  source: /note="Description of Artificial Sequence: Synthetic peptide"
FRFSTTCFVV

SEQ ID NO: 25995 - protein, 9 aa, Artificial Sequence
  source: /note="Description of Artificial Sequence: Synthetic peptide"
RENEKLQSV

SEQ ID NO: 25996 - protein, 10 aa, Artificial Sequence
  source: /note="Description of Artificial Sequence: Synthetic peptide"
RENEKLQSVS

SEQ ID NO: 25997 - protein, 10 aa, Artificial Sequence
  source: /note="Description of Artificial Sequence: Synthetic peptide"
NEKLQSVSQA

SEQ ID NO: 25998 - protein, 9 aa, Artificial Sequence
  source: /note="Description of Artificial Sequence: Synthetic peptide"
QSDWNNSLM

SEQ ID NO: 25999 - protein, 9 aa, Artificial Sequence
  source: /note="Description of Artificial Sequence: Synthetic peptide"
VQSDWNNSL

SEQ ID NO: 26000 - protein, 10 aa, Artificial Sequence
  source: /note="Description of Artificial Sequence: Synthetic peptide"
VQSDWNNSLM

SEQ ID NO: 26001 - protein, 9 aa, Artificial Sequence
  source: /note="Description of Artificial Sequence: Synthetic peptide"
DSRDGWGAM

SEQ ID NO: 26002 - protein, 9 aa, Artificial Sequence
  source: /note="Description of Artificial Sequence: Synthetic peptide"
RDGWGAMAL

SEQ ID NO: 26003 - protein, 10 aa, Artificial Sequence
  source: /note="Description of Artificial Sequence: Synthetic peptide"
DGWGAMALTR

SEQ ID NO: 26004 - protein, 10 aa, Artificial Sequence
  source: /note="Description of Artificial Sequence: Synthetic peptide"
RDSRDGWGAM

SEQ ID NO: 26005 - protein, 10 aa, Artificial Sequence
  source: /note="Description of Artificial Sequence: Synthetic peptide"
SRDGWGAMAL

SEQ ID NO: 26006 - protein, 9 aa, Artificial Sequence
  source: /note="Description of Artificial Sequence: Synthetic peptide"
DSRDGWVGY

SEQ ID NO: 26007 - protein, 9 aa, Artificial Sequence
  source: /note="Description of Artificial Sequence: Synthetic peptide"
VGYGSDKRM

SEQ ID NO: 26008 - protein, 10 aa, Artificial Sequence
  source: /note="Description of Artificial Sequence: Synthetic peptide"
RDSRDGWVGY

SEQ ID NO: 26009 - protein, 9 aa, Artificial Sequence
  source: /note="Description of Artificial Sequence: Synthetic peptide"
TLRPRCINM

SEQ ID NO: 26010 - protein, 10 aa, Artificial Sequence
  source: /note="Description of Artificial Sequence: Synthetic peptide"
RPRCINMTDT

SEQ ID NO: 26011 - protein, 10 aa, Artificial Sequence
  source: /note="Description of Artificial Sequence: Synthetic peptide"
RCINMTDTGI

SEQ ID NO: 26012 - protein, 9 aa, Artificial Sequence
  source: /note="Description of Artificial Sequence: Synthetic peptide"
LYSTVPQNV

SEQ ID NO: 26013 - protein, 10 aa, Artificial Sequence
  source: /note="Description of Artificial Sequence: Synthetic peptide"
GLYSTVPQNV

SEQ ID NO: 26014 - protein, 9 aa, Artificial Sequence
  source: /note="Description of Artificial Sequence: Synthetic peptide"
SLLGGPPVT

SEQ ID NO: 26015 - protein, 9 aa, Artificial Sequence
  source: /note="Description of Artificial Sequence: Synthetic peptide"
LLGGPPVTK

SEQ ID NO: 26016 - protein, 10 aa, Artificial Sequence
  source: /note="Description of Artificial Sequence: Synthetic peptide"
LLGGPPVTKA

SEQ ID NO: 26017 - protein, 10 aa, Artificial Sequence
  source: /note="Description of Artificial Sequence: Synthetic peptide"
SLLGGPPVTK

SEQ ID NO: 26018 - protein, 9 aa, Artificial Sequence
  source: /note="Description of Artificial Sequence: Synthetic peptide"
FLPSRFPWG

SEQ ID NO: 26019 - protein, 9 aa, Artificial Sequence
  source: /note="Description of Artificial Sequence: Synthetic peptide"
GFLPSRFPW

SEQ ID NO: 26020 - protein, 9 aa, Artificial Sequence
  source: /note="Description of Artificial Sequence: Synthetic peptide"
RFPWGPPPL

SEQ ID NO: 26021 - protein, 9 aa, Artificial Sequence
  source: /note="Description of Artificial Sequence: Synthetic peptide"
ISVIQSGGF

SEQ ID NO: 26022 - protein, 9 aa, Artificial Sequence
  source: /note="Description of Artificial Sequence: Synthetic peptide"
IQSGGFLPS

SEQ ID NO: 26023 - protein, 9 aa, Artificial Sequence
  source: /note="Description of Artificial Sequence: Synthetic peptide"
SGGFLPSRF

SEQ ID NO: 26024 - protein, 9 aa, Artificial Sequence
  source: /note="Description of Artificial Sequence: Synthetic peptide"
SRFPWGPPP

SEQ ID NO: 26025 - protein, 10 aa, Artificial Sequence
  source: /note="Description of Artificial Sequence: Synthetic peptide"
FLPSRFPWGP

SEQ ID NO: 26026 - protein, 10 aa, Artificial Sequence
  source: /note="Description of Artificial Sequence: Synthetic peptide"
QSGGFLPSRF

SEQ ID NO: 26027 - protein, 10 aa, Artificial Sequence
  source: /note="Description of Artificial Sequence: Synthetic peptide"
GGFLPSRFPW

SEQ ID NO: 26028 - protein, 10 aa, Artificial Sequence
  source: /note="Description of Artificial Sequence: Synthetic peptide"
SRFPWGPPPL

SEQ ID NO: 26029 - protein, 9 aa, Artificial Sequence
  source: /note="Description of Artificial Sequence: Synthetic peptide"
ALLGTKVAV

SEQ ID NO: 26030 - protein, 9 aa, Artificial Sequence
  source: /note="Description of Artificial Sequence: Synthetic peptide"
LQALLGTKV

SEQ ID NO: 26031 - protein, 9 aa, Artificial Sequence
  source: /note="Description of Artificial Sequence: Synthetic peptide"
TLQALLGTK

SEQ ID NO: 26032 - protein, 10 aa, Artificial Sequence
  source: /note="Description of Artificial Sequence: Synthetic peptide"
TLQALLGTKV

SEQ ID NO: 26033 - protein, 10 aa, Artificial Sequence
  source: /note="Description of Artificial Sequence: Synthetic peptide"
VTLQALLGTK

SEQ ID NO: 26034 - protein, 10 aa, Artificial Sequence
  source: /note="Description of Artificial Sequence: Synthetic peptide"
NTNVTLQALL

SEQ ID NO: 26035 - protein, 10 aa, Artificial Sequence
  source: /note="Description of Artificial Sequence: Synthetic peptide"
LQALLGTKVA

SEQ ID NO: 26036 - protein, 9 aa, Artificial Sequence
  source: /note="Description of Artificial Sequence: Synthetic peptide"
ALLHAHPFL

SEQ ID NO: 26037 - protein, 9 aa, Artificial Sequence
  source: /note="Description of Artificial Sequence: Synthetic peptide"
NALLHAHPF

SEQ ID NO: 26038 - protein, 10 aa, Artificial Sequence
  source: /note="Description of Artificial Sequence: Synthetic peptide"
VNALLHAHPF

SEQ ID NO: 26039 - protein, 9 aa, Artificial Sequence
  source: /note="Description of Artificial Sequence: Synthetic peptide"
SQFTWVMGK

SEQ ID NO: 26040 - protein, 9 aa, Artificial Sequence
  source: /note="Description of Artificial Sequence: Synthetic peptide"
DIPSQFTWV

SEQ ID NO: 26041 - protein, 9 aa, Artificial Sequence
  source: /note="Description of Artificial Sequence: Synthetic peptide"
IPSQFTWVM

SEQ ID NO: 26042 - protein, 9 aa, Artificial Sequence
  source: /note="Description of Artificial Sequence: Synthetic peptide"
GDIPSQFTW

SEQ ID NO: 26043 - protein, 10 aa, Artificial Sequence
  source: /note="Description of Artificial Sequence: Synthetic peptide"
SQFTWVMGKV

SEQ ID NO: 26044 - protein, 10 aa, Artificial Sequence
  source: /note="Description of Artificial Sequence: Synthetic peptide"
WVMGKVCTQL

SEQ ID NO: 26045 - protein, 10 aa, Artificial Sequence
  source: /note="Description of Artificial Sequence: Synthetic peptide"
PSQFTWVMGK

SEQ ID NO: 26046 - protein, 10 aa, Artificial Sequence
  source: /note="Description of Artificial Sequence: Synthetic peptide"
DIPSQFTWVM

SEQ ID NO: 26047 - protein, 9 aa, Artificial Sequence
  source: /note="Description of Artificial Sequence: Synthetic peptide"
STGASRPLR

SEQ ID NO: 26048 - protein, 9 aa, Artificial Sequence
  source: /note="Description of Artificial Sequence: Synthetic peptide"
ASRPLRTRR

SEQ ID NO: 26049 - protein, 9 aa, Artificial Sequence
  source: /note="Description of Artificial Sequence: Synthetic peptide"
RTRRTRSQC

SEQ ID NO: 26050 - protein, 9 aa, Artificial Sequence
  source: /note="Description of Artificial Sequence: Synthetic peptide"
RTRSQCRRS

SEQ ID NO: 26051 - protein, 9 aa, Artificial Sequence
  source: /note="Description of Artificial Sequence: Synthetic peptide"
RSQCRRSWS

SEQ ID NO: 26052 - protein, 10 aa, Artificial Sequence
  source: /note="Description of Artificial Sequence: Synthetic peptide"
VTRKKYNPPA

SEQ ID NO: 26053 - protein, 10 aa, Artificial Sequence
  source: /note="Description of Artificial Sequence: Synthetic peptide"
ASRPLRTRRT

SEQ ID NO: 26054 - protein, 10 aa, Artificial Sequence
  source: /note="Description of Artificial Sequence: Synthetic peptide"
RTRRTRSQCR

SEQ ID NO: 26055 - protein, 10 aa, Artificial Sequence
  source: /note="Description of Artificial Sequence: Synthetic peptide"
RTRSQCRRSW

SEQ ID NO: 26056 - protein, 10 aa, Artificial Sequence
  source: /note="Description of Artificial Sequence: Synthetic peptide"
RSQCRRSWSP

SEQ ID NO: 26057 - protein, 10 aa, Artificial Sequence
  source: /note="Description of Artificial Sequence: Synthetic peptide"
QCRRSWSPAR

SEQ ID NO: 26058 - protein, 10 aa, Artificial Sequence
  source: /note="Description of Artificial Sequence: Synthetic peptide"
RPLRTRRTRS

SEQ ID NO: 26059 - protein, 10 aa, Artificial Sequence
  source: /note="Description of Artificial Sequence: Synthetic peptide"
KKYNPPAGST

SEQ ID NO: 26060 - protein, 10 aa, Artificial Sequence
  source: /note="Description of Artificial Sequence: Synthetic peptide"
SQCRRSWSPA

SEQ ID NO: 26061 - protein, 9 aa, Artificial Sequence
  source: /note="Description of Artificial Sequence: Synthetic peptide"
AVVQNAKKK

SEQ ID NO: 26062 - protein, 9 aa, Artificial Sequence
  source: /note="Description of Artificial Sequence: Synthetic peptide"
VQNAKKKWK

SEQ ID NO: 26063 - protein, 10 aa, Artificial Sequence
  source: /note="Description of Artificial Sequence: Synthetic peptide"
VVQNAKKKWK

SEQ ID NO: 26064 - protein, 9 aa, Artificial Sequence
  source: /note="Description of Artificial Sequence: Synthetic peptide"
GQDCWHTYV

SEQ ID NO: 26065 - protein, 9 aa, Artificial Sequence
  source: /note="Description of Artificial Sequence: Synthetic peptide"
CWHTYVPAF

SEQ ID NO: 26066 - protein, 9 aa, Artificial Sequence
  source: /note="Description of Artificial Sequence: Synthetic peptide"
QGQDCWHTY

SEQ ID NO: 26067 - protein, 10 aa, Artificial Sequence
  source: /note="Description of Artificial Sequence: Synthetic peptide"
CWHTYVPAFI

SEQ ID NO: 26068 - protein, 10 aa, Artificial Sequence
  source: /note="Description of Artificial Sequence: Synthetic peptide"
PQGQDCWHTY

SEQ ID NO: 26069 - protein, 10 aa, Artificial Sequence
  source: /note="Description of Artificial Sequence: Synthetic peptide"
YSTPQGQDCW

SEQ ID NO: 26070 - protein, 9 aa, Artificial Sequence
  source: /note="Description of Artificial Sequence: Synthetic peptide"
SPSPPPTPT

SEQ ID NO: 26071 - protein, 9 aa, Artificial Sequence
  source: /note="Description of Artificial Sequence: Synthetic peptide"
TPSPTCPPI

SEQ ID NO: 26072 - protein, 9 aa, Artificial Sequence
  source: /note="Description of Artificial Sequence: Synthetic peptide"
SPTCPPIRY

SEQ ID NO: 26073 - protein, 10 aa, Artificial Sequence
  source: /note="Description of Artificial Sequence: Synthetic peptide"
CTPSPTCPPI

SEQ ID NO: 26074 - protein, 10 aa, Artificial Sequence
  source: /note="Description of Artificial Sequence: Synthetic peptide"
SPSPPPTPTA

SEQ ID NO: 26075 - protein, 10 aa, Artificial Sequence
  source: /note="Description of Artificial Sequence: Synthetic peptide"
SPTCPPIRYL

SEQ ID NO: 26076 - protein, 9 aa, Artificial Sequence
  source: /note="Description of Artificial Sequence: Synthetic peptide"
RERKENQKV

SEQ ID NO: 26077 - protein, 10 aa, Artificial Sequence
  source: /note="Description of Artificial Sequence: Synthetic peptide"
RERKENQKVV

SEQ ID NO: 26078 - protein, 9 aa, Artificial Sequence
  source: /note="Description of Artificial Sequence: Synthetic peptide"
SLVIPGCSV

SEQ ID NO: 26079 - protein, 9 aa, Artificial Sequence
  source: /note="Description of Artificial Sequence: Synthetic peptide"
LVIPGCSVA

SEQ ID NO: 26080 - protein, 10 aa, Artificial Sequence
  source: /note="Description of Artificial Sequence: Synthetic peptide"
SLVIPGCSVA

SEQ ID NO: 26081 - protein, 10 aa, Artificial Sequence
  source: /note="Description of Artificial Sequence: Synthetic peptide"
IPGCSVASNL

SEQ ID NO: 26082 - protein, 9 aa, Artificial Sequence
  source: /note="Description of Artificial Sequence: Synthetic peptide"
VQTSEISAV

SEQ ID NO: 26083 - protein, 10 aa, Artificial Sequence
  source: /note="Description of Artificial Sequence: Synthetic peptide"
YVQTSEISAV

SEQ ID NO: 26084 - protein, 10 aa, Artificial Sequence
  source: /note="Description of Artificial Sequence: Synthetic peptide"
QTSEISAVHI

SEQ ID NO: 26085 - protein, 10 aa, Artificial Sequence
  source: /note="Description of Artificial Sequence: Synthetic peptide"
RDNYVQTSEI

SEQ ID NO: 26086 - protein, 10 aa, Artificial Sequence
  source: /note="Description of Artificial Sequence: Synthetic peptide"
VQTSEISAVH

SEQ ID NO: 26087 - protein, 9 aa, Artificial Sequence
  source: /note="Description of Artificial Sequence: Synthetic peptide"
LSSPLQKPK

SEQ ID NO: 26088 - protein, 9 aa, Artificial Sequence
  source: /note="Description of Artificial Sequence: Synthetic peptide"
LQKPKRLSR

SEQ ID NO: 26089 - protein, 9 aa, Artificial Sequence
  source: /note="Description of Artificial Sequence: Synthetic peptide"
SPLQKPKRL

SEQ ID NO: 26090 - protein, 9 aa, Artificial Sequence
  source: /note="Description of Artificial Sequence: Synthetic peptide"
ELFTSLWDI

SEQ ID NO: 26091 - protein, 9 aa, Artificial Sequence
  source: /note="Description of Artificial Sequence: Synthetic peptide"
SLWDIAGAR

SEQ ID NO: 26092 - protein, 9 aa, Artificial Sequence
  source: /note="Description of Artificial Sequence: Synthetic peptide"
TSLWDIAGA

SEQ ID NO: 26093 - protein, 9 aa, Artificial Sequence
  source: /note="Description of Artificial Sequence: Synthetic peptide"
WDIAGARSL

SEQ ID NO: 26094 - protein, 10 aa, Artificial Sequence
  source: /note="Description of Artificial Sequence: Synthetic peptide"
FTSLWDIAGA

SEQ ID NO: 26095 - protein, 10 aa, Artificial Sequence
  source: /note="Description of Artificial Sequence: Synthetic peptide"
ELFTSLWDIA

SEQ ID NO: 26096 - protein, 10 aa, Artificial Sequence
  source: /note="Description of Artificial Sequence: Synthetic peptide"
TSLWDIAGAR

SEQ ID NO: 26097 - protein, 10 aa, Artificial Sequence
  source: /note="Description of Artificial Sequence: Synthetic peptide"
WDIAGARSLL

SEQ ID NO: 26098 - protein, 10 aa, Artificial Sequence
  source: /note="Description of Artificial Sequence: Synthetic peptide"
DELFTSLWDI

SEQ ID NO: 26099 - protein, 9 aa, Artificial Sequence
  source: /note="Description of Artificial Sequence: Synthetic peptide"
KNWRPFPWA

SEQ ID NO: 26100 - protein, 9 aa, Artificial Sequence
  source: /note="Description of Artificial Sequence: Synthetic peptide"
AVEKNWRPF

SEQ ID NO: 26101 - protein, 9 aa, Artificial Sequence
  source: /note="Description of Artificial Sequence: Synthetic peptide"
EKNWRPFPW

SEQ ID NO: 26102 - protein, 10 aa, Artificial Sequence
  source: /note="Description of Artificial Sequence: Synthetic peptide"
NWRPFPWAQR

SEQ ID NO: 26103 - protein, 10 aa, Artificial Sequence
  source: /note="Description of Artificial Sequence: Synthetic peptide"
VEKNWRPFPW

SEQ ID NO: 26104 - protein, 10 aa, Artificial Sequence
  source: /note="Description of Artificial Sequence: Synthetic peptide"
DAVEKNWRPF

SEQ ID NO: 26105 - protein, 9 aa, Artificial Sequence
  source: /note="Description of Artificial Sequence: Synthetic peptide"
FLAKLCQSL

SEQ ID NO: 26106 - protein, 10 aa, Artificial Sequence
  source: /note="Description of Artificial Sequence: Synthetic peptide"
FLAKLCQSLL

SEQ ID NO: 26107 - protein, 10 aa, Artificial Sequence
  source: /note="Description of Artificial Sequence: Synthetic peptide"
RFLAKLCQSL

SEQ ID NO: 26108 - protein, 10 aa, Artificial Sequence
  source: /note="Description of Artificial Sequence: Synthetic peptide"
CQSLLCDDLF

SEQ ID NO: 26109 - protein, 9 aa, Artificial Sequence
  source: /note="Description of Artificial Sequence: Synthetic peptide"
STFNHRGSF

SEQ ID NO: 26110 - protein, 9 aa, Artificial Sequence
  source: /note="Description of Artificial Sequence: Synthetic peptide"
SFHPSSSLY

SEQ ID NO: 26111 - protein, 9 aa, Artificial Sequence
  source: /note="Description of Artificial Sequence: Synthetic peptide"
GSFHPSSSL

SEQ ID NO: 26112 - protein, 10 aa, Artificial Sequence
  source: /note="Description of Artificial Sequence: Synthetic peptide"
STFNHRGSFH

SEQ ID NO: 26113 - protein, 10 aa, Artificial Sequence
  source: /note="Description of Artificial Sequence: Synthetic peptide"
GSFHPSSSLY

SEQ ID NO: 26114 - protein, 10 aa, Artificial Sequence
  source: /note="Description of Artificial Sequence: Synthetic peptide"
RGSFHPSSSL

SEQ ID NO: 26115 - protein, 10 aa, Artificial Sequence
  source: /note="Description of Artificial Sequence: Synthetic peptide"
ASTFNHRGSF

SEQ ID NO: 26116 - protein, 9 aa, Artificial Sequence
  source: /note="Description of Artificial Sequence: Synthetic peptide"
WQVHKTCYR

SEQ ID NO: 26117 - protein, 10 aa, Artificial Sequence
  source: /note="Description of Artificial Sequence: Synthetic peptide"
WQVHKTCYRI

SEQ ID NO: 26118 - protein, 10 aa, Artificial Sequence
  source: /note="Description of Artificial Sequence: Synthetic peptide"
VGWQVHKTCY

SEQ ID NO: 26119 - protein, 10 aa, Artificial Sequence
  source: /note="Description of Artificial Sequence: Synthetic peptide"
SPWDVGWQVH

SEQ ID NO: 26120 - protein, 9 aa, Artificial Sequence
  source: /note="Description of Artificial Sequence: Synthetic peptide"
SLQSYFSPM

SEQ ID NO: 26121 - protein, 9 aa, Artificial Sequence
  source: /note="Description of Artificial Sequence: Synthetic peptide"
LQSYFSPML

SEQ ID NO: 26122 - protein, 9 aa, Artificial Sequence
  source: /note="Description of Artificial Sequence: Synthetic peptide"
YFSPMLFRV

SEQ ID NO: 26123 - protein, 9 aa, Artificial Sequence
  source: /note="Description of Artificial Sequence: Synthetic peptide"
MLFRVIRLA

SEQ ID NO: 26124 - protein, 9 aa, Artificial Sequence
  source: /note="Description of Artificial Sequence: Synthetic peptide"
SYFSPMLFR

SEQ ID NO: 26125 - protein, 9 aa, Artificial Sequence
  source: /note="Description of Artificial Sequence: Synthetic peptide"
QSYFSPMLF

SEQ ID NO: 26126 - protein, 9 aa, Artificial Sequence
  source: /note="Description of Artificial Sequence: Synthetic peptide"
SPMLFRVIR

SEQ ID NO: 26127 - protein, 10 aa, Artificial Sequence
  source: /note="Description of Artificial Sequence: Synthetic peptide"
SLQSYFSPML

SEQ ID NO: 26128 - protein, 10 aa, Artificial Sequence
  source: /note="Description of Artificial Sequence: Synthetic peptide"
QSYFSPMLFR

SEQ ID NO: 26129 - protein, 10 aa, Artificial Sequence
  source: /note="Description of Artificial Sequence: Synthetic peptide"
MLFRVIRLAR

SEQ ID NO: 26130 - protein, 10 aa, Artificial Sequence
  source: /note="Description of Artificial Sequence: Synthetic peptide"
LQSYFSPMLF

SEQ ID NO: 26131 - protein, 10 aa, Artificial Sequence
  source: /note="Description of Artificial Sequence: Synthetic peptide"
SYFSPMLFRV

SEQ ID NO: 26132 - protein, 10 aa, Artificial Sequence
  source: /note="Description of Artificial Sequence: Synthetic peptide"
YFSPMLFRVI

SEQ ID NO: 26133 - protein, 10 aa, Artificial Sequence
  source: /note="Description of Artificial Sequence: Synthetic peptide"
KSLQSYFSPM

SEQ ID NO: 26134 - protein, 10 aa, Artificial Sequence
  source: /note="Description of Artificial Sequence: Synthetic peptide"
FSPMLFRVIR

SEQ ID NO: 26135 - protein, 10 aa, Artificial Sequence
  source: /note="Description of Artificial Sequence: Synthetic peptide"
SPMLFRVIRL

SEQ ID NO: 26136 - protein, 9 aa, Artificial Sequence
  source: /note="Description of Artificial Sequence: Synthetic peptide"
RIAEEKAKK

SEQ ID NO: 26137 - protein, 9 aa, Artificial Sequence
  source: /note="Description of Artificial Sequence: Synthetic peptide"
KAKKPKQER

SEQ ID NO: 26138 - protein, 10 aa, Artificial Sequence
  source: /note="Description of Artificial Sequence: Synthetic peptide"
KAKKPKQERK

SEQ ID NO: 26139 - protein, 9 aa, Artificial Sequence
  source: /note="Description of Artificial Sequence: Synthetic peptide"
TMSNPPDWK

SEQ ID NO: 26140 - protein, 9 aa, Artificial Sequence
  source: /note="Description of Artificial Sequence: Synthetic peptide"
MSNPPDWKK

SEQ ID NO: 26141 - protein, 9 aa, Artificial Sequence
  source: /note="Description of Artificial Sequence: Synthetic peptide"
WKKNVEYTF

SEQ ID NO: 26142 - protein, 10 aa, Artificial Sequence
  source: /note="Description of Artificial Sequence: Synthetic peptide"
MTMSNPPDWK

SEQ ID NO: 26143 - protein, 10 aa, Artificial Sequence
  source: /note="Description of Artificial Sequence: Synthetic peptide"
TMSNPPDWKK

SEQ ID NO: 26144 - protein, 10 aa, Artificial Sequence
  source: /note="Description of Artificial Sequence: Synthetic peptide"
DWKKNVEYTF

SEQ ID NO: 26145 - protein, 9 aa, Artificial Sequence
  source: /note="Description of Artificial Sequence: Synthetic peptide"
IIHMLHLGK

SEQ ID NO: 26146 - protein, 9 aa, Artificial Sequence
  source: /note="Description of Artificial Sequence: Synthetic peptide"
MLHLGKGPK

SEQ ID NO: 26147 - protein, 9 aa, Artificial Sequence
  source: /note="Description of Artificial Sequence: Synthetic peptide"
LSRIIHMLH

SEQ ID NO: 26148 - protein, 9 aa, Artificial Sequence
  source: /note="Description of Artificial Sequence: Synthetic peptide"
SRIIHMLHL

SEQ ID NO: 26149 - protein, 9 aa, Artificial Sequence
  source: /note="Description of Artificial Sequence: Synthetic peptide"
HLGKGPKVF

SEQ ID NO: 26150 - protein, 10 aa, Artificial Sequence
  source: /note="Description of Artificial Sequence: Synthetic peptide"
MLHLGKGPKV

SEQ ID NO: 26151 - protein, 10 aa, Artificial Sequence
  source: /note="Description of Artificial Sequence: Synthetic peptide"
RIIHMLHLGK

SEQ ID NO: 26152 - protein, 10 aa, Artificial Sequence
  source: /note="Description of Artificial Sequence: Synthetic peptide"
HMLHLGKGPK

SEQ ID NO: 26153 - protein, 10 aa, Artificial Sequence
  source: /note="Description of Artificial Sequence: Synthetic peptide"
LSRIIHMLHL

SEQ ID NO: 26154 - protein, 10 aa, Artificial Sequence
  source: /note="Description of Artificial Sequence: Synthetic peptide"
LHLGKGPKVF

SEQ ID NO: 26155 - protein, 9 aa, Artificial Sequence
  source: /note="Description of Artificial Sequence: Synthetic peptide"
IIARHQWQK

SEQ ID NO: 26156 - protein, 9 aa, Artificial Sequence
  source: /note="Description of Artificial Sequence: Synthetic peptide"
IARHQWQKA

SEQ ID NO: 26157 - protein, 9 aa, Artificial Sequence
  source: /note="Description of Artificial Sequence: Synthetic peptide"
DFFSIIARH

SEQ ID NO: 26158 - protein, 9 aa, Artificial Sequence
  source: /note="Description of Artificial Sequence: Synthetic peptide"
FSIIARHQW

SEQ ID NO: 26159 - protein, 9 aa, Artificial Sequence
  source: /note="Description of Artificial Sequence: Synthetic peptide"
HQWQKAKEW

SEQ ID NO: 26160 - protein, 10 aa, Artificial Sequence
  source: /note="Description of Artificial Sequence: Synthetic peptide"
IIARHQWQKA

SEQ ID NO: 26161 - protein, 10 aa, Artificial Sequence
  source: /note="Description of Artificial Sequence: Synthetic peptide"
SIIARHQWQK

SEQ ID NO: 26162 - protein, 10 aa, Artificial Sequence
  source: /note="Description of Artificial Sequence: Synthetic peptide"
FFSIIARHQW

SEQ ID NO: 26163 - protein, 10 aa, Artificial Sequence
  source: /note="Description of Artificial Sequence: Synthetic peptide"
IARHQWQKAK

SEQ ID NO: 26164 - protein, 10 aa, Artificial Sequence
  source: /note="Description of Artificial Sequence: Synthetic peptide"
HQWQKAKEWW

SEQ ID NO: 26165 - protein, 9 aa, Artificial Sequence
  source: /note="Description of Artificial Sequence: Synthetic peptide"
IVGCVALSV

SEQ ID NO: 26166 - protein, 9 aa, Artificial Sequence
  source: /note="Description of Artificial Sequence: Synthetic peptide"
ALPPEIVGC

SEQ ID NO: 26167 - protein, 9 aa, Artificial Sequence
  source: /note="Description of Artificial Sequence: Synthetic peptide"
LEALPPEIV

SEQ ID NO: 26168 - protein, 9 aa, Artificial Sequence
  source: /note="Description of Artificial Sequence: Synthetic peptide"
PEIVGCVAL

SEQ ID NO: 26169 - protein, 9 aa, Artificial Sequence
  source: /note="Description of Artificial Sequence: Synthetic peptide"
LPPEIVGCV

SEQ ID NO: 26170 - protein, 10 aa, Artificial Sequence
  source: /note="Description of Artificial Sequence: Synthetic peptide"
ALPPEIVGCV

SEQ ID NO: 26171 - protein, 10 aa, Artificial Sequence
  source: /note="Description of Artificial Sequence: Synthetic peptide"
EIVGCVALSV

SEQ ID NO: 26172 - protein, 10 aa, Artificial Sequence
  source: /note="Description of Artificial Sequence: Synthetic peptide"
LPPEIVGCVA

SEQ ID NO: 26173 - protein, 9 aa, Artificial Sequence
  source: /note="Description of Artificial Sequence: Synthetic peptide"
RRKASNAGA

SEQ ID NO: 26174 - protein, 9 aa, Artificial Sequence
  source: /note="Description of Artificial Sequence: Synthetic peptide"
KASNAGAAA

SEQ ID NO: 26175 - protein, 9 aa, Artificial Sequence
  source: /note="Description of Artificial Sequence: Synthetic peptide"
RKASNAGAA

SEQ ID NO: 26176 - protein, 10 aa, Artificial Sequence
  source: /note="Description of Artificial Sequence: Synthetic peptide"
KASNAGAAAA

SEQ ID NO: 26177 - protein, 10 aa, Artificial Sequence
  source: /note="Description of Artificial Sequence: Synthetic peptide"
RKASNAGAAA

SEQ ID NO: 26178 - protein, 10 aa, Artificial Sequence
  source: /note="Description of Artificial Sequence: Synthetic peptide"
AAAAPSTASA

SEQ ID NO: 26179 - protein, 9 aa, Artificial Sequence
  source: /note="Description of Artificial Sequence: Synthetic peptide"
FCKNIMGSF

SEQ ID NO: 26180 - protein, 9 aa, Artificial Sequence
  source: /note="Description of Artificial Sequence: Synthetic peptide"
CDHFCKNIM

SEQ ID NO: 26181 - protein, 10 aa, Artificial Sequence
  source: /note="Description of Artificial Sequence: Synthetic peptide"
IMGSFDCGCK

SEQ ID NO: 26182 - protein, 10 aa, Artificial Sequence
  source: /note="Description of Artificial Sequence: Synthetic peptide"
HFCKNIMGSF

SEQ ID NO: 26183 - protein, 9 aa, Artificial Sequence
  source: /note="Description of Artificial Sequence: Synthetic peptide"
KVLKKQKRR

SEQ ID NO: 26184 - protein, 9 aa, Artificial Sequence
  source: /note="Description of Artificial Sequence: Synthetic peptide"
VLKKQKRRK

SEQ ID NO: 26185 - protein, 9 aa, Artificial Sequence
  source: /note="Description of Artificial Sequence: Synthetic peptide"
KQKRRKNQR

SEQ ID NO: 26186 - protein, 9 aa, Artificial Sequence
  source: /note="Description of Artificial Sequence: Synthetic peptide"
RKNQRCLTF

SEQ ID NO: 26187 - protein, 9 aa, Artificial Sequence
  source: /note="Description of Artificial Sequence: Synthetic peptide"
QRCLTFQPF

SEQ ID NO: 26188 - protein, 10 aa, Artificial Sequence
  source: /note="Description of Artificial Sequence: Synthetic peptide"
KVLKKQKRRK

SEQ ID NO: 26189 - protein, 10 aa, Artificial Sequence
  source: /note="Description of Artificial Sequence: Synthetic peptide"
AMKVLKKQKR

SEQ ID NO: 26190 - protein, 10 aa, Artificial Sequence
  source: /note="Description of Artificial Sequence: Synthetic peptide"
NQRCLTFQPF

SEQ ID NO: 26191 - protein, 10 aa, Artificial Sequence
  source: /note="Description of Artificial Sequence: Synthetic peptide"
RRKNQRCLTF

SEQ ID NO: 26192 - protein, 9 aa, Artificial Sequence
  source: /note="Description of Artificial Sequence: Synthetic peptide"
YWRKHTLSY

SEQ ID NO: 26193 - protein, 9 aa, Artificial Sequence
  source: /note="Description of Artificial Sequence: Synthetic peptide"
QQKKPFEEY

SEQ ID NO: 26194 - protein, 9 aa, Artificial Sequence
  source: /note="Description of Artificial Sequence: Synthetic peptide"
EEYWRKHTL

SEQ ID NO: 26195 - protein, 10 aa, Artificial Sequence
  source: /note="Description of Artificial Sequence: Synthetic peptide"
EYWRKHTLSY

SEQ ID NO: 26196 - protein, 10 aa, Artificial Sequence
  source: /note="Description of Artificial Sequence: Synthetic peptide"
YWRKHTLSYV

SEQ ID NO: 26197 - protein, 10 aa, Artificial Sequence
  source: /note="Description of Artificial Sequence: Synthetic peptide"
GQQKKPFEEY

SEQ ID NO: 26198 - protein, 10 aa, Artificial Sequence
  source: /note="Description of Artificial Sequence: Synthetic peptide"
QQKKPFEEYW

SEQ ID NO: 26199 - protein, 10 aa, Artificial Sequence
  source: /note="Description of Artificial Sequence: Synthetic peptide"
FEEYWRKHTL

SEQ ID NO: 26200 - protein, 9 aa, Artificial Sequence
  source: /note="Description of Artificial Sequence: Synthetic peptide"
CWTWLSLVR

SEQ ID NO: 26201 - protein, 9 aa, Artificial Sequence
  source: /note="Description of Artificial Sequence: Synthetic peptide"
TRCWTWLSL

SEQ ID NO: 26202 - protein, 10 aa, Artificial Sequence
  source: /note="Description of Artificial Sequence: Synthetic peptide"
WTWLSLVRHV

SEQ ID NO: 26203 - protein, 10 aa, Artificial Sequence
  source: /note="Description of Artificial Sequence: Synthetic peptide"
QTRCWTWLSL

SEQ ID NO: 26204 - protein, 9 aa, Artificial Sequence
  source: /note="Description of Artificial Sequence: Synthetic peptide"
SGQTCCWTW

SEQ ID NO: 26205 - protein, 9 aa, Artificial Sequence
  source: /note="Description of Artificial Sequence: Synthetic peptide"
GQTCCWTWL

SEQ ID NO: 26206 - protein, 9 aa, Artificial Sequence
  source: /note="Description of Artificial Sequence: Synthetic peptide"
TASGQTCCW

SEQ ID NO: 26207 - protein, 9 aa, Artificial Sequence
  source: /note="Description of Artificial Sequence: Synthetic peptide"
VVFGQTCAL

SEQ ID NO: 26208 - protein, 9 aa, Artificial Sequence
  source: /note="Description of Artificial Sequence: Synthetic peptide"
FGQTCALSI

SEQ ID NO: 26209 - protein, 10 aa, Artificial Sequence
  source: /note="Description of Artificial Sequence: Synthetic peptide"
VFGQTCALSI

SEQ ID NO: 26210 - protein, 10 aa, Artificial Sequence
  source: /note="Description of Artificial Sequence: Synthetic peptide"
LVVFGQTCAL

SEQ ID NO: 26211 - protein, 9 aa, Artificial Sequence
  source: /note="Description of Artificial Sequence: Synthetic peptide"
EVSGAPKPR

SEQ ID NO: 26212 - protein, 9 aa, Artificial Sequence
  source: /note="Description of Artificial Sequence: Synthetic peptide"
KRKPHSGQW

SEQ ID NO: 26213 - protein, 9 aa, Artificial Sequence
  source: /note="Description of Artificial Sequence: Synthetic peptide"
RKPHSGQWL

SEQ ID NO: 26214 - protein, 10 aa, Artificial Sequence
  source: /note="Description of Artificial Sequence: Synthetic peptide"
APKPRHHLEK

SEQ ID NO: 26215 - protein, 10 aa, Artificial Sequence
  source: /note="Description of Artificial Sequence: Synthetic peptide"
KPRHHLEKRK

SEQ ID NO: 26216 - protein, 10 aa, Artificial Sequence
  source: /note="Description of Artificial Sequence: Synthetic peptide"
KRKPHSGQWL

SEQ ID NO: 26217 - protein, 9 aa, Artificial Sequence
  source: /note="Description of Artificial Sequence: Synthetic peptide"
DVAPTSVMV

SEQ ID NO: 26218 - protein, 10 aa, Artificial Sequence
  source: /note="Description of Artificial Sequence: Synthetic peptide"
MVRTASETSL

SEQ ID NO: 26219 - protein, 10 aa, Artificial Sequence
  source: /note="Description of Artificial Sequence: Synthetic peptide"
DVAPTSVMVR

SEQ ID NO: 26220 - protein, 10 aa, Artificial Sequence
  source: /note="Description of Artificial Sequence: Synthetic peptide"
APTSVMVRTA

SEQ ID NO: 26221 - protein, 9 aa, Artificial Sequence
  source: /note="Description of Artificial Sequence: Synthetic peptide"
HCMSDPTYY

SEQ ID NO: 26222 - protein, 9 aa, Artificial Sequence
  source: /note="Description of Artificial Sequence: Synthetic peptide"
KHSFVNHCM

SEQ ID NO: 26223 - protein, 9 aa, Artificial Sequence
  source: /note="Description of Artificial Sequence: Synthetic peptide"
NHCMSDPTY

SEQ ID NO: 26224 - protein, 10 aa, Artificial Sequence
  source: /note="Description of Artificial Sequence: Synthetic peptide"
FVNHCMSDPT

SEQ ID NO: 26225 - protein, 10 aa, Artificial Sequence
  source: /note="Description of Artificial Sequence: Synthetic peptide"
VNHCMSDPTY

SEQ ID NO: 26226 - protein, 10 aa, Artificial Sequence
  source: /note="Description of Artificial Sequence: Synthetic peptide"
MKPAGPLGAH

SEQ ID NO: 26227 - protein, 9 aa, Artificial Sequence
  source: /note="Description of Artificial Sequence: Synthetic peptide"
VGFSGTWPL

SEQ ID NO: 26228 - protein, 9 aa, Artificial Sequence
  source: /note="Description of Artificial Sequence: Synthetic peptide"
NPVGFSGTW

SEQ ID NO: 26229 - protein, 9 aa, Artificial Sequence
  source: /note="Description of Artificial Sequence: Synthetic peptide"
ITIVQAIVY

SEQ ID NO: 26230 - protein, 9 aa, Artificial Sequence
  source: /note="Description of Artificial Sequence: Synthetic peptide"
MIITIVQAI

SEQ ID NO: 26231 - protein, 9 aa, Artificial Sequence
  source: /note="Description of Artificial Sequence: Synthetic peptide"
TIVQAIVYV

SEQ ID NO: 26232 - protein, 9 aa, Artificial Sequence
  source: /note="Description of Artificial Sequence: Synthetic peptide"
GMIITIVQA

SEQ ID NO: 26233 - protein, 9 aa, Artificial Sequence
  source: /note="Description of Artificial Sequence: Synthetic peptide"
IITIVQAIV

SEQ ID NO: 26234 - protein, 9 aa, Artificial Sequence
  source: /note="Description of Artificial Sequence: Synthetic peptide"
IVQAIVYVM

SEQ ID NO: 26235 - protein, 10 aa, Artificial Sequence
  source: /note="Description of Artificial Sequence: Synthetic peptide"
KLFGMIITIV

SEQ ID NO: 26236 - protein, 10 aa, Artificial Sequence
  source: /note="Description of Artificial Sequence: Synthetic peptide"
GMIITIVQAI

SEQ ID NO: 26237 - protein, 10 aa, Artificial Sequence
  source: /note="Description of Artificial Sequence: Synthetic peptide"
MIITIVQAIV

SEQ ID NO: 26238 - protein, 10 aa, Artificial Sequence
  source: /note="Description of Artificial Sequence: Synthetic peptide"
ITIVQAIVYV

SEQ ID NO: 26239 - protein, 10 aa, Artificial Sequence
  source: /note="Description of Artificial Sequence: Synthetic peptide"
IITIVQAIVY

SEQ ID NO: 26240 - protein, 10 aa, Artificial Sequence
  source: /note="Description of Artificial Sequence: Synthetic peptide"
TIVQAIVYVM

SEQ ID NO: 26241 - protein, 9 aa, Artificial Sequence
  source: /note="Description of Artificial Sequence: Synthetic peptide"
LQRETEASH

SEQ ID NO: 26242 - protein, 9 aa, Artificial Sequence
  source: /note="Description of Artificial Sequence: Synthetic peptide"
RETEASHLA

SEQ ID NO: 26243 - protein, 9 aa, Artificial Sequence
  source: /note="Description of Artificial Sequence: Synthetic peptide"
TELQRETEA

SEQ ID NO: 26244 - protein, 10 aa, Artificial Sequence
  source: /note="Description of Artificial Sequence: Synthetic peptide"
LQRETEASHL

SEQ ID NO: 26245 - protein, 10 aa, Artificial Sequence
  source: /note="Description of Artificial Sequence: Synthetic peptide"
RETEASHLAP

SEQ ID NO: 26246 - protein, 9 aa, Artificial Sequence
  source: /note="Description of Artificial Sequence: Synthetic peptide"
VWCDNLGQW

SEQ ID NO: 26247 - protein, 9 aa, Artificial Sequence
  source: /note="Description of Artificial Sequence: Synthetic peptide"
MLRGADIVW

SEQ ID NO: 26248 - protein, 10 aa, Artificial Sequence
  source: /note="Description of Artificial Sequence: Synthetic peptide"
FMLRGADIVW

SEQ ID NO: 26249 - protein, 10 aa, Artificial Sequence
  source: /note="Description of Artificial Sequence: Synthetic peptide"
IVWCDNLGQW

SEQ ID NO: 26250 - protein, 9 aa, Artificial Sequence
  source: /note="Description of Artificial Sequence: Synthetic peptide"
FTLVGPEVV

SEQ ID NO: 26251 - protein, 9 aa, Artificial Sequence
  source: /note="Description of Artificial Sequence: Synthetic peptide"
FSCEEGFTL

SEQ ID NO: 26252 - protein, 10 aa, Artificial Sequence
  source: /note="Description of Artificial Sequence: Synthetic peptide"
FSCEEGFTLV

SEQ ID NO: 26253 - protein, 10 aa, Artificial Sequence
  source: /note="Description of Artificial Sequence: Synthetic peptide"
EGFTLVGPEV

SEQ ID NO: 26254 - protein, 9 aa, Artificial Sequence
  source: /note="Description of Artificial Sequence: Synthetic peptide"
FSFNLVNIK

SEQ ID NO: 26255 - protein, 9 aa, Artificial Sequence
  source: /note="Description of Artificial Sequence: Synthetic peptide"
IFSFNLVNI

SEQ ID NO: 26256 - protein, 9 aa, Artificial Sequence
  source: /note="Description of Artificial Sequence: Synthetic peptide"
KDHIFSFNL

SEQ ID NO: 26257 - protein, 10 aa, Artificial Sequence
  source: /note="Description of Artificial Sequence: Synthetic peptide"
HIFSFNLVNI

SEQ ID NO: 26258 - protein, 10 aa, Artificial Sequence
  source: /note="Description of Artificial Sequence: Synthetic peptide"
NLVNIKDFQK

SEQ ID NO: 26259 - protein, 10 aa, Artificial Sequence
  source: /note="Description of Artificial Sequence: Synthetic peptide"
SFNLVNIKDF

SEQ ID NO: 26260 - protein, 10 aa, Artificial Sequence
  source: /note="Description of Artificial Sequence: Synthetic peptide"
KDHIFSFNLV

SEQ ID NO: 26261 - protein, 9 aa, Artificial Sequence
  source: /note="Description of Artificial Sequence: Synthetic peptide"
VLIPQIARV

SEQ ID NO: 26262 - protein, 9 aa, Artificial Sequence
  source: /note="Description of Artificial Sequence: Synthetic peptide"
RVLIPQIAR

SEQ ID NO: 26263 - protein, 10 aa, Artificial Sequence
  source: /note="Description of Artificial Sequence: Synthetic peptide"
FVFRVLIPQI

SEQ ID NO: 26264 - protein, 10 aa, Artificial Sequence
  source: /note="Description of Artificial Sequence: Synthetic peptide"
RVLIPQIARV

SEQ ID NO: 26265 - protein, 10 aa, Artificial Sequence
  source: /note="Description of Artificial Sequence: Synthetic peptide"
VFRVLIPQIA

SEQ ID NO: 26266 - protein, 9 aa, Artificial Sequence
  source: /note="Description of Artificial Sequence: Synthetic peptide"
CTEERQLHH

SEQ ID NO: 26267 - protein, 9 aa, Artificial Sequence
  source: /note="Description of Artificial Sequence: Synthetic peptide"
HKISYPSSC

SEQ ID NO: 26268 - protein, 9 aa, Artificial Sequence
  source: /note="Description of Artificial Sequence: Synthetic peptide"
SYFIHYYCV

SEQ ID NO: 26269 - protein, 9 aa, Artificial Sequence
  source: /note="Description of Artificial Sequence: Synthetic peptide"
SSKESYFIH

SEQ ID NO: 26270 - protein, 9 aa, Artificial Sequence
  source: /note="Description of Artificial Sequence: Synthetic peptide"
KESYFIHYY

SEQ ID NO: 26271 - protein, 9 aa, Artificial Sequence
  source: /note="Description of Artificial Sequence: Synthetic peptide"
ESYFIHYYC

SEQ ID NO: 26272 - protein, 9 aa, Artificial Sequence
  source: /note="Description of Artificial Sequence: Synthetic peptide"
QNLSSKESY

SEQ ID NO: 26273 - protein, 9 aa, Artificial Sequence
  source: /note="Description of Artificial Sequence: Synthetic peptide"
NLSSKESYF

SEQ ID NO: 26274 - protein, 9 aa, Artificial Sequence
  source: /note="Description of Artificial Sequence: Synthetic peptide"
SKESYFIHY

SEQ ID NO: 26275 - protein, 10 aa, Artificial Sequence
  source: /note="Description of Artificial Sequence: Synthetic peptide"
NLSSKESYFI

SEQ ID NO: 26276 - protein, 10 aa, Artificial Sequence
  source: /note="Description of Artificial Sequence: Synthetic peptide"
SSKESYFIHY

SEQ ID NO: 26277 - protein, 10 aa, Artificial Sequence
  source: /note="Description of Artificial Sequence: Synthetic peptide"
FQNLSSKESY

SEQ ID NO: 26278 - protein, 10 aa, Artificial Sequence
  source: /note="Description of Artificial Sequence: Synthetic peptide"
SKESYFIHYY

SEQ ID NO: 26279 - protein, 10 aa, Artificial Sequence
  source: /note="Description of Artificial Sequence: Synthetic peptide"
ESYFIHYYCV

SEQ ID NO: 26280 - protein, 10 aa, Artificial Sequence
  source: /note="Description of Artificial Sequence: Synthetic peptide"
QNLSSKESYF

SEQ ID NO: 26281 - protein, 10 aa, Artificial Sequence
  source: /note="Description of Artificial Sequence: Synthetic peptide"
KESYFIHYYC

SEQ ID NO: 26282 - protein, 9 aa, Artificial Sequence
  source: /note="Description of Artificial Sequence: Synthetic peptide"
QIIEVAPQV

SEQ ID NO: 26283 - protein, 9 aa, Artificial Sequence
  source: /note="Description of Artificial Sequence: Synthetic peptide"
RIIDKPQII

SEQ ID NO: 26284 - protein, 10 aa, Artificial Sequence
  source: /note="Description of Artificial Sequence: Synthetic peptide"
IIDKPQIIEV

SEQ ID NO: 26285 - protein, 9 aa, Artificial Sequence
  source: /note="Description of Artificial Sequence: Synthetic peptide"
ESFNPESYK

SEQ ID NO: 26286 - protein, 9 aa, Artificial Sequence
  source: /note="Description of Artificial Sequence: Synthetic peptide"
SFNPESYKL

SEQ ID NO: 26287 - protein, 9 aa, Artificial Sequence
  source: /note="Description of Artificial Sequence: Synthetic peptide"
SYKLDKSFR

SEQ ID NO: 26288 - protein, 9 aa, Artificial Sequence
  source: /note="Description of Artificial Sequence: Synthetic peptide"
ESYKLDKSF

SEQ ID NO: 26289 - protein, 9 aa, Artificial Sequence
  source: /note="Description of Artificial Sequence: Synthetic peptide"
YKLDKSFRL

SEQ ID NO: 26290 - protein, 10 aa, Artificial Sequence
  source: /note="Description of Artificial Sequence: Synthetic peptide"
KLDKSFRLTR

SEQ ID NO: 26291 - protein, 10 aa, Artificial Sequence
  source: /note="Description of Artificial Sequence: Synthetic peptide"
SYKLDKSFRL

SEQ ID NO: 26292 - protein, 10 aa, Artificial Sequence
  source: /note="Description of Artificial Sequence: Synthetic peptide"
ESYKLDKSFR

SEQ ID NO: 26293 - protein, 10 aa, Artificial Sequence
  source: /note="Description of Artificial Sequence: Synthetic peptide"
ESFNPESYKL

SEQ ID NO: 26294 - protein, 9 aa, Artificial Sequence
  source: /note="Description of Artificial Sequence: Synthetic peptide"
LLANYIFFG

SEQ ID NO: 26295 - protein, 9 aa, Artificial Sequence
  source: /note="Description of Artificial Sequence: Synthetic peptide"
YIFFGARWK

SEQ ID NO: 26296 - protein, 9 aa, Artificial Sequence
  source: /note="Description of Artificial Sequence: Synthetic peptide"
NYIFFGARW

SEQ ID NO: 26297 - protein, 9 aa, Artificial Sequence
  source: /note="Description of Artificial Sequence: Synthetic peptide"
FGARWKHEF

SEQ ID NO: 26298 - protein, 9 aa, Artificial Sequence
  source: /note="Description of Artificial Sequence: Synthetic peptide"
ANYIFFGAR

SEQ ID NO: 26299 - protein, 9 aa, Artificial Sequence
  source: /note="Description of Artificial Sequence: Synthetic peptide"
LANYIFFGA

SEQ ID NO: 26300 - protein, 10 aa, Artificial Sequence
  source: /note="Description of Artificial Sequence: Synthetic peptide"
MLLANYIFFG

SEQ ID NO: 26301 - protein, 10 aa, Artificial Sequence
  source: /note="Description of Artificial Sequence: Synthetic peptide"
LLANYIFFGA

SEQ ID NO: 26302 - protein, 10 aa, Artificial Sequence
  source: /note="Description of Artificial Sequence: Synthetic peptide"
LANYIFFGAR

SEQ ID NO: 26303 - protein, 10 aa, Artificial Sequence
  source: /note="Description of Artificial Sequence: Synthetic peptide"
FFGARWKHEF

SEQ ID NO: 26304 - protein, 10 aa, Artificial Sequence
  source: /note="Description of Artificial Sequence: Synthetic peptide"
ANYIFFGARW

SEQ ID NO: 26305 - protein, 9 aa, Artificial Sequence
  source: /note="Description of Artificial Sequence: Synthetic peptide"
YQVGYDYKL

SEQ ID NO: 26306 - protein, 9 aa, Artificial Sequence
  source: /note="Description of Artificial Sequence: Synthetic peptide"
GIYQVGYDY

SEQ ID NO: 26307 - protein, 9 aa, Artificial Sequence
  source: /note="Description of Artificial Sequence: Synthetic peptide"
YDYKLSCTI

SEQ ID NO: 26308 - protein, 10 aa, Artificial Sequence
  source: /note="Description of Artificial Sequence: Synthetic peptide"
GIYQVGYDYK

SEQ ID NO: 26309 - protein, 10 aa, Artificial Sequence
  source: /note="Description of Artificial Sequence: Synthetic peptide"
IYQVGYDYKL

SEQ ID NO: 26310 - protein, 10 aa, Artificial Sequence
  source: /note="Description of Artificial Sequence: Synthetic peptide"
SGIYQVGYDY

SEQ ID NO: 26311 - protein, 10 aa, Artificial Sequence
  source: /note="Description of Artificial Sequence: Synthetic peptide"
YDYKLSCTIL

SEQ ID NO: 26312 - protein, 10 aa, Artificial Sequence
  source: /note="Description of Artificial Sequence: Synthetic peptide"
YKLSCTILEI

SEQ ID NO: 26313 - protein, 9 aa, Artificial Sequence
  source: /note="Description of Artificial Sequence: Synthetic peptide"
FTEDANRLY

SEQ ID NO: 26314 - protein, 9 aa, Artificial Sequence
  source: /note="Description of Artificial Sequence: Synthetic peptide"
NRLYGSEAF

SEQ ID NO: 26315 - protein, 10 aa, Artificial Sequence
  source: /note="Description of Artificial Sequence: Synthetic peptide"
RFTEDANRLY

SEQ ID NO: 26316 - protein, 10 aa, Artificial Sequence
  source: /note="Description of Artificial Sequence: Synthetic peptide"
ANRLYGSEAF

SEQ ID NO: 26317 - protein, 9 aa, Artificial Sequence
  source: /note="Description of Artificial Sequence: Synthetic peptide"
NADFAFCFY

SEQ ID NO: 26318 - protein, 9 aa, Artificial Sequence
  source: /note="Description of Artificial Sequence: Synthetic peptide"
FAFCFYYLI

SEQ ID NO: 26319 - protein, 9 aa, Artificial Sequence
  source: /note="Description of Artificial Sequence: Synthetic peptide"
DFAFCFYYL

SEQ ID NO: 26320 - protein, 9 aa, Artificial Sequence
  source: /note="Description of Artificial Sequence: Synthetic peptide"
ADFAFCFYY

SEQ ID NO: 26321 - protein, 9 aa, Artificial Sequence
  source: /note="Description of Artificial Sequence: Synthetic peptide"
ANADFAFCF

SEQ ID NO: 26322 - protein, 10 aa, Artificial Sequence
  source: /note="Description of Artificial Sequence: Synthetic peptide"
NADFAFCFYY

SEQ ID NO: 26323 - protein, 10 aa, Artificial Sequence
  source: /note="Description of Artificial Sequence: Synthetic peptide"
FAFCFYYLIA

SEQ ID NO: 26324 - protein, 10 aa, Artificial Sequence
  source: /note="Description of Artificial Sequence: Synthetic peptide"
DFAFCFYYLI

SEQ ID NO: 26325 - protein, 10 aa, Artificial Sequence
  source: /note="Description of Artificial Sequence: Synthetic peptide"
ANADFAFCFY

SEQ ID NO: 26326 - protein, 10 aa, Artificial Sequence
  source: /note="Description of Artificial Sequence: Synthetic peptide"
ADFAFCFYYL

SEQ ID NO: 26327 - protein, 9 aa, Artificial Sequence
  source: /note="Description of Artificial Sequence: Synthetic peptide"
FLMIITNKA

SEQ ID NO: 26328 - protein, 9 aa, Artificial Sequence
  source: /note="Description of Artificial Sequence: Synthetic peptide"
TFLMIITNK

SEQ ID NO: 26329 - protein, 9 aa, Artificial Sequence
  source: /note="Description of Artificial Sequence: Synthetic peptide"
SFNRTFLMI

SEQ ID NO: 26330 - protein, 9 aa, Artificial Sequence
  source: /note="Description of Artificial Sequence: Synthetic peptide"
FNRTFLMII

SEQ ID NO: 26331 - protein, 10 aa, Artificial Sequence
  source: /note="Description of Artificial Sequence: Synthetic peptide"
FLMIITNKAT

SEQ ID NO: 26332 - protein, 10 aa, Artificial Sequence
  source: /note="Description of Artificial Sequence: Synthetic peptide"
RTFLMIITNK

SEQ ID NO: 26333 - protein, 10 aa, Artificial Sequence
  source: /note="Description of Artificial Sequence: Synthetic peptide"
VSFNRTFLMI

SEQ ID NO: 26334 - protein, 10 aa, Artificial Sequence
  source: /note="Description of Artificial Sequence: Synthetic peptide"
SFNRTFLMII

SEQ ID NO: 26335 - protein, 9 aa, Artificial Sequence
  source: /note="Description of Artificial Sequence: Synthetic peptide"
NSSARTLLM

SEQ ID NO: 26336 - protein, 9 aa, Artificial Sequence
  source: /note="Description of Artificial Sequence: Synthetic peptide"
SVDFQKTLK

SEQ ID NO: 26337 - protein, 9 aa, Artificial Sequence
  source: /note="Description of Artificial Sequence: Synthetic peptide"
KTLKNPDKR

SEQ ID NO: 26338 - protein, 9 aa, Artificial Sequence
  source: /note="Description of Artificial Sequence: Synthetic peptide"
TSGLNVNPK

SEQ ID NO: 26339 - protein, 9 aa, Artificial Sequence
  source: /note="Description of Artificial Sequence: Synthetic peptide"
SARTLLMLR

SEQ ID NO: 26340 - protein, 9 aa, Artificial Sequence
  source: /note="Description of Artificial Sequence: Synthetic peptide"
LMLRLCWYW

SEQ ID NO: 26341 - protein, 9 aa, Artificial Sequence
  source: /note="Description of Artificial Sequence: Synthetic peptide"
KVKSRNSSA

SEQ ID NO: 26342 - protein, 9 aa, Artificial Sequence
  source: /note="Description of Artificial Sequence: Synthetic peptide"
KSRNSSART

SEQ ID NO: 26343 - protein, 9 aa, Artificial Sequence
  source: /note="Description of Artificial Sequence: Synthetic peptide"
RNSSARTLL

SEQ ID NO: 26344 - protein, 9 aa, Artificial Sequence
  source: /note="Description of Artificial Sequence: Synthetic peptide"
LLMLRLCWY

SEQ ID NO: 26345 - protein, 9 aa, Artificial Sequence
  source: /note="Description of Artificial Sequence: Synthetic peptide"
NVNPKVKSR

SEQ ID NO: 26346 - protein, 9 aa, Artificial Sequence
  source: /note="Description of Artificial Sequence: Synthetic peptide"
KRLTSGLNV

SEQ ID NO: 26347 - protein, 9 aa, Artificial Sequence
  source: /note="Description of Artificial Sequence: Synthetic peptide"
SRNSSARTL

SEQ ID NO: 26348 - protein, 9 aa, Artificial Sequence
  source: /note="Description of Artificial Sequence: Synthetic peptide"
SSARTLLML

SEQ ID NO: 26349 - protein, 9 aa, Artificial Sequence
  source: /note="Description of Artificial Sequence: Synthetic peptide"
IESVDFQKT

SEQ ID NO: 26350 - protein, 10 aa, Artificial Sequence
  source: /note="Description of Artificial Sequence: Synthetic peptide"
LTSGLNVNPK

SEQ ID NO: 26351 - protein, 10 aa, Artificial Sequence
  source: /note="Description of Artificial Sequence: Synthetic peptide"
SSARTLLMLR

SEQ ID NO: 26352 - protein, 10 aa, Artificial Sequence
  source: /note="Description of Artificial Sequence: Synthetic peptide"
RTLLMLRLCW

SEQ ID NO: 26353 - protein, 10 aa, Artificial Sequence
  source: /note="Description of Artificial Sequence: Synthetic peptide"
LLMLRLCWYW

SEQ ID NO: 26354 - protein, 10 aa, Artificial Sequence
  source: /note="Description of Artificial Sequence: Synthetic peptide"
FQKTLKNPDK

SEQ ID NO: 26355 - protein, 10 aa, Artificial Sequence
  source: /note="Description of Artificial Sequence: Synthetic peptide"
SGLNVNPKVK

SEQ ID NO: 26356 - protein, 10 aa, Artificial Sequence
  source: /note="Description of Artificial Sequence: Synthetic peptide"
KVKSRNSSAR

SEQ ID NO: 26357 - protein, 10 aa, Artificial Sequence
  source: /note="Description of Artificial Sequence: Synthetic peptide"
KSRNSSARTL

SEQ ID NO: 26358 - protein, 10 aa, Artificial Sequence
  source: /note="Description of Artificial Sequence: Synthetic peptide"
RNSSARTLLM

SEQ ID NO: 26359 - protein, 10 aa, Artificial Sequence
  source: /note="Description of Artificial Sequence: Synthetic peptide"
SARTLLMLRL

SEQ ID NO: 26360 - protein, 10 aa, Artificial Sequence
  source: /note="Description of Artificial Sequence: Synthetic peptide"
TLLMLRLCWY

SEQ ID NO: 26361 - protein, 10 aa, Artificial Sequence
  source: /note="Description of Artificial Sequence: Synthetic peptide"
NPDKRLTSGL

SEQ ID NO: 26362 - protein, 10 aa, Artificial Sequence
  source: /note="Description of Artificial Sequence: Synthetic peptide"
IESVDFQKTL

SEQ ID NO: 26363 - protein, 10 aa, Artificial Sequence
  source: /note="Description of Artificial Sequence: Synthetic peptide"
SRNSSARTLL

SEQ ID NO: 26364 - protein, 9 aa, Artificial Sequence
  source: /note="Description of Artificial Sequence: Synthetic peptide"
KCVQMMRQY

SEQ ID NO: 26365 - protein, 9 aa, Artificial Sequence
  source: /note="Description of Artificial Sequence: Synthetic peptide"
TYKCVQMMR

SEQ ID NO: 26366 - protein, 9 aa, Artificial Sequence
  source: /note="Description of Artificial Sequence: Synthetic peptide"
NTYKCVQMM

SEQ ID NO: 26367 - protein, 10 aa, Artificial Sequence
  source: /note="Description of Artificial Sequence: Synthetic peptide"
NTYKCVQMMR

SEQ ID NO: 26368 - protein, 10 aa, Artificial Sequence
  source: /note="Description of Artificial Sequence: Synthetic peptide"
WPNKNTYKCV

SEQ ID NO: 26369 - protein, 10 aa, Artificial Sequence
  source: /note="Description of Artificial Sequence: Synthetic peptide"
NKNTYKCVQM

SEQ ID NO: 26370 - protein, 10 aa, Artificial Sequence
  source: /note="Description of Artificial Sequence: Synthetic peptide"
YKCVQMMRQY

SEQ ID NO: 26371 - protein, 9 aa, Artificial Sequence
  source: /note="Description of Artificial Sequence: Synthetic peptide"
TAKPLDIPM

SEQ ID NO: 26372 - protein, 9 aa, Artificial Sequence
  source: /note="Description of Artificial Sequence: Synthetic peptide"
VDICTAKPL

SEQ ID NO: 26373 - protein, 10 aa, Artificial Sequence
  source: /note="Description of Artificial Sequence: Synthetic peptide"
CTAKPLDIPM

SEQ ID NO: 26374 - protein, 10 aa, Artificial Sequence
  source: /note="Description of Artificial Sequence: Synthetic peptide"
KPLDIPMNPM

SEQ ID NO: 26375 - protein, 9 aa, Artificial Sequence
  source: /note="Description of Artificial Sequence: Synthetic peptide"
SLKMVKNFL

SEQ ID NO: 26376 - protein, 9 aa, Artificial Sequence
  source: /note="Description of Artificial Sequence: Synthetic peptide"
SMGYDSLKM

SEQ ID NO: 26377 - protein, 10 aa, Artificial Sequence
  source: /note="Description of Artificial Sequence: Synthetic peptide"
SMGYDSLKMV

SEQ ID NO: 26378 - protein, 10 aa, Artificial Sequence
  source: /note="Description of Artificial Sequence: Synthetic peptide"
MGYDSLKMVK

SEQ ID NO: 26379 - protein, 10 aa, Artificial Sequence
  source: /note="Description of Artificial Sequence: Synthetic peptide"
SLKMVKNFLS

SEQ ID NO: 26380 - protein, 10 aa, Artificial Sequence
  source: /note="Description of Artificial Sequence: Synthetic peptide"
HSMGYDSLKM

SEQ ID NO: 26381 - protein, 9 aa, Artificial Sequence
  source: /note="Description of Artificial Sequence: Synthetic peptide"
SMRASQALQ

SEQ ID NO: 26382 - protein, 9 aa, Artificial Sequence
  source: /note="Description of Artificial Sequence: Synthetic peptide"
DSMRASQAL

SEQ ID NO: 26383 - protein, 9 aa, Artificial Sequence
  source: /note="Description of Artificial Sequence: Synthetic peptide"
AQWGIGDSM

SEQ ID NO: 26384 - protein, 10 aa, Artificial Sequence
  source: /note="Description of Artificial Sequence: Synthetic peptide"
SMRASQALQQ

SEQ ID NO: 26385 - protein, 10 aa, Artificial Sequence
  source: /note="Description of Artificial Sequence: Synthetic peptide"
RAQWGIGDSM

SEQ ID NO: 26386 - protein, 9 aa, Artificial Sequence
  source: /note="Description of Artificial Sequence: Synthetic peptide"
KYYKYVTNA

SEQ ID NO: 26387 - protein, 9 aa, Artificial Sequence
  source: /note="Description of Artificial Sequence: Synthetic peptide"
KCRKKYYKY

SEQ ID NO: 26388 - protein, 9 aa, Artificial Sequence
  source: /note="Description of Artificial Sequence: Synthetic peptide"
GVNKCRKKY

SEQ ID NO: 26389 - protein, 9 aa, Artificial Sequence
  source: /note="Description of Artificial Sequence: Synthetic peptide"
YKYVTNACL

SEQ ID NO: 26390 - protein, 10 aa, Artificial Sequence
  source: /note="Description of Artificial Sequence: Synthetic peptide"
KYYKYVTNAC

SEQ ID NO: 26391 - protein, 10 aa, Artificial Sequence
  source: /note="Description of Artificial Sequence: Synthetic peptide"
YYKYVTNACL

SEQ ID NO: 26392 - protein, 10 aa, Artificial Sequence
  source: /note="Description of Artificial Sequence: Synthetic peptide"
VNKCRKKYYK

SEQ ID NO: 26393 - protein, 10 aa, Artificial Sequence
  source: /note="Description of Artificial Sequence: Synthetic peptide"
KCRKKYYKYV

SEQ ID NO: 26394 - protein, 10 aa, Artificial Sequence
  source: /note="Description of Artificial Sequence: Synthetic peptide"
GVNKCRKKYY

SEQ ID NO: 26395 - protein, 10 aa, Artificial Sequence
  source: /note="Description of Artificial Sequence: Synthetic peptide"
KKYYKYVTNA

SEQ ID NO: 26396 - protein, 9 aa, Artificial Sequence
  source: /note="Description of Artificial Sequence: Synthetic peptide"
TLQPYVAHT

SEQ ID NO: 26397 - protein, 9 aa, Artificial Sequence
  source: /note="Description of Artificial Sequence: Synthetic peptide"
LQPYVAHTL

SEQ ID NO: 26398 - protein, 9 aa, Artificial Sequence
  source: /note="Description of Artificial Sequence: Synthetic peptide"
ISPFTLQPY

SEQ ID NO: 26399 - protein, 9 aa, Artificial Sequence
  source: /note="Description of Artificial Sequence: Synthetic peptide"
LQISPFTLQ

SEQ ID NO: 26400 - protein, 9 aa, Artificial Sequence
  source: /note="Description of Artificial Sequence: Synthetic peptide"
SPFTLQPYV

SEQ ID NO: 26401 - protein, 10 aa, Artificial Sequence
  source: /note="Description of Artificial Sequence: Synthetic peptide"
TLQPYVAHTL

SEQ ID NO: 26402 - protein, 10 aa, Artificial Sequence
  source: /note="Description of Artificial Sequence: Synthetic peptide"
QISPFTLQPY

SEQ ID NO: 26403 - protein, 10 aa, Artificial Sequence
  source: /note="Description of Artificial Sequence: Synthetic peptide"
ISPFTLQPYV

SEQ ID NO: 26404 - protein, 10 aa, Artificial Sequence
  source: /note="Description of Artificial Sequence: Synthetic peptide"
APLQISPFTL

SEQ ID NO: 26405 - protein, 10 aa, Artificial Sequence
  source: /note="Description of Artificial Sequence: Synthetic peptide"
LQISPFTLQP

SEQ ID NO: 26406 - protein, 10 aa, Artificial Sequence
  source: /note="Description of Artificial Sequence: Synthetic peptide"
SPFTLQPYVA

SEQ ID NO: 26407 - protein, 10 aa, Artificial Sequence
  source: /note="Description of Artificial Sequence: Synthetic peptide"
YLPGSDPDPT

SEQ ID NO: 26408 - protein, 10 aa, Artificial Sequence
  source: /note="Description of Artificial Sequence: Synthetic peptide"
LPGSDPDPTL

SEQ ID NO: 26409 - protein, 9 aa, Artificial Sequence
  source: /note="Description of Artificial Sequence: Synthetic peptide"
TLWEDDNRI

SEQ ID NO: 26410 - protein, 9 aa, Artificial Sequence
  source: /note="Description of Artificial Sequence: Synthetic peptide"
LARLNGTLW

SEQ ID NO: 26411 - protein, 10 aa, Artificial Sequence
  source: /note="Description of Artificial Sequence: Synthetic peptide"
TLWEDDNRIL

SEQ ID NO: 26412 - protein, 9 aa, Artificial Sequence
  source: /note="Description of Artificial Sequence: Synthetic peptide"
CVRNTTARA

SEQ ID NO: 26413 - protein, 10 aa, Artificial Sequence
  source: /note="Description of Artificial Sequence: Synthetic peptide"
CVRNTTARAF

SEQ ID NO: 26414 - protein, 9 aa, Artificial Sequence
  source: /note="Description of Artificial Sequence: Synthetic peptide"
NMDEYVRYT

SEQ ID NO: 26415 - protein, 9 aa, Artificial Sequence
  source: /note="Description of Artificial Sequence: Synthetic peptide"
YTTARAFAV

SEQ ID NO: 26416 - protein, 9 aa, Artificial Sequence
  source: /note="Description of Artificial Sequence: Synthetic peptide"
YVRYTTARA

SEQ ID NO: 26417 - protein, 9 aa, Artificial Sequence
  source: /note="Description of Artificial Sequence: Synthetic peptide"
RYTTARAFA

SEQ ID NO: 26418 - protein, 9 aa, Artificial Sequence
  source: /note="Description of Artificial Sequence: Synthetic peptide"
EYVRYTTAR

SEQ ID NO: 26419 - protein, 9 aa, Artificial Sequence
  source: /note="Description of Artificial Sequence: Synthetic peptide"
VRYTTARAF

SEQ ID NO: 26420 - protein, 9 aa, Artificial Sequence
  source: /note="Description of Artificial Sequence: Synthetic peptide"
DEYVRYTTA

SEQ ID NO: 26421 - protein, 10 aa, Artificial Sequence
  source: /note="Description of Artificial Sequence: Synthetic peptide"
NMDEYVRYTT

SEQ ID NO: 26422 - protein, 10 aa, Artificial Sequence
  source: /note="Description of Artificial Sequence: Synthetic peptide"
YTTARAFAVV

SEQ ID NO: 26423 - protein, 10 aa, Artificial Sequence
  source: /note="Description of Artificial Sequence: Synthetic peptide"
RYTTARAFAV

SEQ ID NO: 26424 - protein, 10 aa, Artificial Sequence
  source: /note="Description of Artificial Sequence: Synthetic peptide"
YVRYTTARAF

SEQ ID NO: 26425 - protein, 10 aa, Artificial Sequence
  source: /note="Description of Artificial Sequence: Synthetic peptide"
IDNMDEYVRY

SEQ ID NO: 26426 - protein, 10 aa, Artificial Sequence
  source: /note="Description of Artificial Sequence: Synthetic peptide"
DEYVRYTTAR

SEQ ID NO: 26427 - protein, 9 aa, Artificial Sequence
  source: /note="Description of Artificial Sequence: Synthetic peptide"
QARHTGIEI

SEQ ID NO: 26428 - protein, 9 aa, Artificial Sequence
  source: /note="Description of Artificial Sequence: Synthetic peptide"
EIVQQIAIL

SEQ ID NO: 26429 - protein, 9 aa, Artificial Sequence
  source: /note="Description of Artificial Sequence: Synthetic peptide"
IEIVQQIAI

SEQ ID NO: 26430 - protein, 10 aa, Artificial Sequence
  source: /note="Description of Artificial Sequence: Synthetic peptide"
WQARHTGIEI

SEQ ID NO: 26431 - protein, 10 aa, Artificial Sequence
  source: /note="Description of Artificial Sequence: Synthetic peptide"
EIVQQIAILM

SEQ ID NO: 26432 - protein, 10 aa, Artificial Sequence
  source: /note="Description of Artificial Sequence: Synthetic peptide"
IEIVQQIAIL

SEQ ID NO: 26433 - protein, 9 aa, Artificial Sequence
  source: /note="Description of Artificial Sequence: Synthetic peptide"
GLVDEQQEV

SEQ ID NO: 26434 - protein, 9 aa, Artificial Sequence
  source: /note="Description of Artificial Sequence: Synthetic peptide"
EVRTISALA

SEQ ID NO: 26435 - protein, 9 aa, Artificial Sequence
  source: /note="Description of Artificial Sequence: Synthetic peptide"
QEVRTISAL

SEQ ID NO: 26436 - protein, 9 aa, Artificial Sequence
  source: /note="Description of Artificial Sequence: Synthetic peptide"
DEQQEVRTI

SEQ ID NO: 26437 - protein, 10 aa, Artificial Sequence
  source: /note="Description of Artificial Sequence: Synthetic peptide"
EVRTISALAI

SEQ ID NO: 26438 - protein, 10 aa, Artificial Sequence
  source: /note="Description of Artificial Sequence: Synthetic peptide"
QQEVRTISAL

SEQ ID NO: 26439 - protein, 10 aa, Artificial Sequence
  source: /note="Description of Artificial Sequence: Synthetic peptide"
DEQQEVRTIS

SEQ ID NO: 26440 - protein, 10 aa, Artificial Sequence
  source: /note="Description of Artificial Sequence: Synthetic peptide"
QEVRTISALA

SEQ ID NO: 26441 - protein, 9 aa, Artificial Sequence
  source: /note="Description of Artificial Sequence: Synthetic peptide"
ILYAFQKQT

SEQ ID NO: 26442 - protein, 9 aa, Artificial Sequence
  source: /note="Description of Artificial Sequence: Synthetic peptide"
KQTTEDSVM

SEQ ID NO: 26443 - protein, 10 aa, Artificial Sequence
  source: /note="Description of Artificial Sequence: Synthetic peptide"
ILYAFQKQTT

SEQ ID NO: 26444 - protein, 10 aa, Artificial Sequence
  source: /note="Description of Artificial Sequence: Synthetic peptide"
FQKQTTEDSV

SEQ ID NO: 26445 - protein, 10 aa, Artificial Sequence
  source: /note="Description of Artificial Sequence: Synthetic peptide"
QKQTTEDSVM

SEQ ID NO: 26446 - protein, 10 aa, Artificial Sequence
  source: /note="Description of Artificial Sequence: Synthetic peptide"
KQTTEDSVML

SEQ ID NO: 26447 - protein, 9 aa, Artificial Sequence
  source: /note="Description of Artificial Sequence: Synthetic peptide"
DLISQTAVV

SEQ ID NO: 26448 - protein, 9 aa, Artificial Sequence
  source: /note="Description of Artificial Sequence: Synthetic peptide"
ISQTAVVMK

SEQ ID NO: 26449 - protein, 9 aa, Artificial Sequence
  source: /note="Description of Artificial Sequence: Synthetic peptide"
LISQTAVVM

SEQ ID NO: 26450 - protein, 9 aa, Artificial Sequence
  source: /note="Description of Artificial Sequence: Synthetic peptide"
ADLISQTAV

SEQ ID NO: 26451 - protein, 10 aa, Artificial Sequence
  source: /note="Description of Artificial Sequence: Synthetic peptide"
LISQTAVVMK

SEQ ID NO: 26452 - protein, 10 aa, Artificial Sequence
  source: /note="Description of Artificial Sequence: Synthetic peptide"
QAADLISQTA

SEQ ID NO: 26453 - protein, 10 aa, Artificial Sequence
  source: /note="Description of Artificial Sequence: Synthetic peptide"
DLISQTAVVM

SEQ ID NO: 26454 - protein, 10 aa, Artificial Sequence
  source: /note="Description of Artificial Sequence: Synthetic peptide"
RQQAADLISQ

SEQ ID NO: 26455 - protein, 9 aa, Artificial Sequence
  source: /note="Description of Artificial Sequence: Synthetic peptide"
LLAQRLSQT

SEQ ID NO: 26456 - protein, 9 aa, Artificial Sequence
  source: /note="Description of Artificial Sequence: Synthetic peptide"
SQTCFRQWR

SEQ ID NO: 26457 - protein, 9 aa, Artificial Sequence
  source: /note="Description of Artificial Sequence: Synthetic peptide"
AQRLSQTCF

SEQ ID NO: 26458 - protein, 9 aa, Artificial Sequence
  source: /note="Description of Artificial Sequence: Synthetic peptide"
LSQTCFRQW

SEQ ID NO: 26459 - protein, 10 aa, Artificial Sequence
  source: /note="Description of Artificial Sequence: Synthetic peptide"
LLAQRLSQTC

SEQ ID NO: 26460 - protein, 10 aa, Artificial Sequence
  source: /note="Description of Artificial Sequence: Synthetic peptide"
AQRLSQTCFR

SEQ ID NO: 26461 - protein, 10 aa, Artificial Sequence
  source: /note="Description of Artificial Sequence: Synthetic peptide"
LSQTCFRQWR

SEQ ID NO: 26462 - protein, 10 aa, Artificial Sequence
  source: /note="Description of Artificial Sequence: Synthetic peptide"
LAQRLSQTCF

SEQ ID NO: 26463 - protein, 10 aa, Artificial Sequence
  source: /note="Description of Artificial Sequence: Synthetic peptide"
RLSQTCFRQW

SEQ ID NO: 26464 - protein, 9 aa, Artificial Sequence
  source: /note="Description of Artificial Sequence: Synthetic peptide"
MQMGGGGAM

SEQ ID NO: 26465 - protein, 10 aa, Artificial Sequence
  source: /note="Description of Artificial Sequence: Synthetic peptide"
DMQMGGGGAM

SEQ ID NO: 26466 - protein, 10 aa, Artificial Sequence
  source: /note="Description of Artificial Sequence: Synthetic peptide"
QMGGGGAMNM

SEQ ID NO: 26467 - protein, 10 aa, Artificial Sequence
  source: /note="Description of Artificial Sequence: Synthetic peptide"
MQMGGGGAMN

SEQ ID NO: 26468 - protein, 9 aa, Artificial Sequence
  source: /note="Description of Artificial Sequence: Synthetic peptide"
IPQTQVPLI

SEQ ID NO: 26469 - protein, 10 aa, Artificial Sequence
  source: /note="Description of Artificial Sequence: Synthetic peptide"
SSSPIPQTQV

SEQ ID NO: 26470 - protein, 10 aa, Artificial Sequence
  source: /note="Description of Artificial Sequence: Synthetic peptide"
SPIPQTQVPL

SEQ ID NO: 26471 - protein, 9 aa, Artificial Sequence
  source: /note="Description of Artificial Sequence: Synthetic peptide"
ESKEGQESY

SEQ ID NO: 26472 - protein, 9 aa, Artificial Sequence
  source: /note="Description of Artificial Sequence: Synthetic peptide"
GQESYSSAA

SEQ ID NO: 26473 - protein, 10 aa, Artificial Sequence
  source: /note="Description of Artificial Sequence: Synthetic peptide"
YSSAANTNPA

SEQ ID NO: 26474 - protein, 10 aa, Artificial Sequence
  source: /note="Description of Artificial Sequence: Synthetic peptide"
KEGQESYSSA

SEQ ID NO: 26475 - protein, 10 aa, Artificial Sequence
  source: /note="Description of Artificial Sequence: Synthetic peptide"
EESKEGQESY

SEQ ID NO: 26476 - protein, 10 aa, Artificial Sequence
  source: /note="Description of Artificial Sequence: Synthetic peptide"
QESYSSAANT

SEQ ID NO: 26477 - protein, 9 aa, Artificial Sequence
  source: /note="Description of Artificial Sequence: Synthetic peptide"
EVLSQMDIL

SEQ ID NO: 26478 - protein, 9 aa, Artificial Sequence
  source: /note="Description of Artificial Sequence: Synthetic peptide"
VLSQMDILF

SEQ ID NO: 26479 - protein, 9 aa, Artificial Sequence
  source: /note="Description of Artificial Sequence: Synthetic peptide"
GKIEVLSQM

SEQ ID NO: 26480 - protein, 9 aa, Artificial Sequence
  source: /note="Description of Artificial Sequence: Synthetic peptide"
IEVLSQMDI

SEQ ID NO: 26481 - protein, 10 aa, Artificial Sequence
  source: /note="Description of Artificial Sequence: Synthetic peptide"
IQAHAGKIEV

SEQ ID NO: 26482 - protein, 10 aa, Artificial Sequence
  source: /note="Description of Artificial Sequence: Synthetic peptide"
QAHAGKIEVL

SEQ ID NO: 26483 - protein, 10 aa, Artificial Sequence
  source: /note="Description of Artificial Sequence: Synthetic peptide"
IEVLSQMDIL

SEQ ID NO: 26484 - protein, 10 aa, Artificial Sequence
  source: /note="Description of Artificial Sequence: Synthetic peptide"
EVLSQMDILF

SEQ ID NO: 26485 - protein, 9 aa, Artificial Sequence
  source: /note="Description of Artificial Sequence: Synthetic peptide"
LYPVGMYGW

SEQ ID NO: 26486 - protein, 9 aa, Artificial Sequence
  source: /note="Description of Artificial Sequence: Synthetic peptide"
MYGWRKRCL

SEQ ID NO: 26487 - protein, 9 aa, Artificial Sequence
  source: /note="Description of Artificial Sequence: Synthetic peptide"
AQLYPVGMY

SEQ ID NO: 26488 - protein, 10 aa, Artificial Sequence
  source: /note="Description of Artificial Sequence: Synthetic peptide"
GMYGWRKRCL

SEQ ID NO: 26489 - protein, 10 aa, Artificial Sequence
  source: /note="Description of Artificial Sequence: Synthetic peptide"
MYGWRKRCLY

SEQ ID NO: 26490 - protein, 10 aa, Artificial Sequence
  source: /note="Description of Artificial Sequence: Synthetic peptide"
NAQLYPVGMY

SEQ ID NO: 26491 - protein, 10 aa, Artificial Sequence
  source: /note="Description of Artificial Sequence: Synthetic peptide"
QLYPVGMYGW

SEQ ID NO: 26492 - protein, 9 aa, Artificial Sequence
  source: /note="Description of Artificial Sequence: Synthetic peptide"
ALAESTSSI

SEQ ID NO: 26493 - protein, 10 aa, Artificial Sequence
  source: /note="Description of Artificial Sequence: Synthetic peptide"
ALAESTSSIS

SEQ ID NO: 26494 - protein, 10 aa, Artificial Sequence
  source: /note="Description of Artificial Sequence: Synthetic peptide"
SPPPIAPLAL

SEQ ID NO: 26495 - protein, 10 aa, Artificial Sequence
  source: /note="Description of Artificial Sequence: Synthetic peptide"
LALAESTSSI

SEQ ID NO: 26496 - protein, 9 aa, Artificial Sequence
  source: /note="Description of Artificial Sequence: Synthetic peptide"
LINKITPPF

SEQ ID NO: 26497 - protein, 10 aa, Artificial Sequence
  source: /note="Description of Artificial Sequence: Synthetic peptide"
DLINKITPPF

SEQ ID NO: 26498 - protein, 9 aa, Artificial Sequence
  source: /note="Description of Artificial Sequence: Synthetic peptide"
TLKKQFPAW

SEQ ID NO: 26499 - protein, 9 aa, Artificial Sequence
  source: /note="Description of Artificial Sequence: Synthetic peptide"
LMSWMAKGV

SEQ ID NO: 26500 - protein, 9 aa, Artificial Sequence
  source: /note="Description of Artificial Sequence: Synthetic peptide"
WMAKGVQKI

SEQ ID NO: 26501 - protein, 9 aa, Artificial Sequence
  source: /note="Description of Artificial Sequence: Synthetic peptide"
SLKIVQMSI

SEQ ID NO: 26502 - protein, 9 aa, Artificial Sequence
  source: /note="Description of Artificial Sequence: Synthetic peptide"
IVQMSILGK

SEQ ID NO: 26503 - protein, 9 aa, Artificial Sequence
  source: /note="Description of Artificial Sequence: Synthetic peptide"
MSILGKRLK

SEQ ID NO: 26504 - protein, 9 aa, Artificial Sequence
  source: /note="Description of Artificial Sequence: Synthetic peptide"
SWMAKGVQK

SEQ ID NO: 26505 - protein, 9 aa, Artificial Sequence
  source: /note="Description of Artificial Sequence: Synthetic peptide"
FSIMNSWLR

SEQ ID NO: 26506 - protein, 9 aa, Artificial Sequence
  source: /note="Description of Artificial Sequence: Synthetic peptide"
GVQKIPVLF

SEQ ID NO: 26507 - protein, 9 aa, Artificial Sequence
  source: /note="Description of Artificial Sequence: Synthetic peptide"
KDLMSWMAK

SEQ ID NO: 26508 - protein, 9 aa, Artificial Sequence
  source: /note="Description of Artificial Sequence: Synthetic peptide"
GQKDLMSWM

SEQ ID NO: 26509 - protein, 9 aa, Artificial Sequence
  source: /note="Description of Artificial Sequence: Synthetic peptide"
REKDQRDSL

SEQ ID NO: 26510 - protein, 9 aa, Artificial Sequence
  source: /note="Description of Artificial Sequence: Synthetic peptide"
RDSLKIVQM

SEQ ID NO: 26511 - protein, 9 aa, Artificial Sequence
  source: /note="Description of Artificial Sequence: Synthetic peptide"
LKIVQMSIL

SEQ ID NO: 26512 - protein, 9 aa, Artificial Sequence
  source: /note="Description of Artificial Sequence: Synthetic peptide"
KGVQKIPVL

SEQ ID NO: 26513 - protein, 9 aa, Artificial Sequence
  source: /note="Description of Artificial Sequence: Synthetic peptide"
QKIPVLFSI

SEQ ID NO: 26514 - protein, 9 aa, Artificial Sequence
  source: /note="Description of Artificial Sequence: Synthetic peptide"
KIPVLFSIM

SEQ ID NO: 26515 - protein, 9 aa, Artificial Sequence
  source: /note="Description of Artificial Sequence: Synthetic peptide"
VLFSIMNSW

SEQ ID NO: 26516 - protein, 10 aa, Artificial Sequence
  source: /note="Description of Artificial Sequence: Synthetic peptide"
DLMSWMAKGV

SEQ ID NO: 26517 - protein, 10 aa, Artificial Sequence
  source: /note="Description of Artificial Sequence: Synthetic peptide"
VLFSIMNSWL

SEQ ID NO: 26518 - protein, 10 aa, Artificial Sequence
  source: /note="Description of Artificial Sequence: Synthetic peptide"
SLKIVQMSIL

SEQ ID NO: 26519 - protein, 10 aa, Artificial Sequence
  source: /note="Description of Artificial Sequence: Synthetic peptide"
KIVQMSILGK

SEQ ID NO: 26520 - protein, 10 aa, Artificial Sequence
  source: /note="Description of Artificial Sequence: Synthetic peptide"
QMSILGKRLK

SEQ ID NO: 26521 - protein, 10 aa, Artificial Sequence
  source: /note="Description of Artificial Sequence: Synthetic peptide"
MSWMAKGVQK

SEQ ID NO: 26522 - protein, 10 aa, Artificial Sequence
  source: /note="Description of Artificial Sequence: Synthetic peptide"
SWMAKGVQKI

SEQ ID NO: 26523 - protein, 10 aa, Artificial Sequence
  source: /note="Description of Artificial Sequence: Synthetic peptide"
KGVQKIPVLF

SEQ ID NO: 26524 - protein, 10 aa, Artificial Sequence
  source: /note="Description of Artificial Sequence: Synthetic peptide"
KVKDSSSEKR

SEQ ID NO: 26525 - protein, 10 aa, Artificial Sequence
  source: /note="Description of Artificial Sequence: Synthetic peptide"
REKDQRDSLK

SEQ ID NO: 26526 - protein, 10 aa, Artificial Sequence
  source: /note="Description of Artificial Sequence: Synthetic peptide"
LGKRLKTGQK

SEQ ID NO: 26527 - protein, 10 aa, Artificial Sequence
  source: /note="Description of Artificial Sequence: Synthetic peptide"
RLKTGQKDLM

SEQ ID NO: 26528 - protein, 10 aa, Artificial Sequence
  source: /note="Description of Artificial Sequence: Synthetic peptide"
MAKGVQKIPV

SEQ ID NO: 26529 - protein, 10 aa, Artificial Sequence
  source: /note="Description of Artificial Sequence: Synthetic peptide"
IVQMSILGKR

SEQ ID NO: 26530 - protein, 10 aa, Artificial Sequence
  source: /note="Description of Artificial Sequence: Synthetic peptide"
LFSIMNSWLR

SEQ ID NO: 26531 - protein, 10 aa, Artificial Sequence
  source: /note="Description of Artificial Sequence: Synthetic peptide"
VQMSILGKRL

SEQ ID NO: 26532 - protein, 10 aa, Artificial Sequence
  source: /note="Description of Artificial Sequence: Synthetic peptide"
KRLKTGQKDL

SEQ ID NO: 26533 - protein, 10 aa, Artificial Sequence
  source: /note="Description of Artificial Sequence: Synthetic peptide"
GQKDLMSWMA

SEQ ID NO: 26534 - protein, 10 aa, Artificial Sequence
  source: /note="Description of Artificial Sequence: Synthetic peptide"
AKGVQKIPVL

SEQ ID NO: 26535 - protein, 10 aa, Artificial Sequence
  source: /note="Description of Artificial Sequence: Synthetic peptide"
VQKIPVLFSI

SEQ ID NO: 26536 - protein, 10 aa, Artificial Sequence
  source: /note="Description of Artificial Sequence: Synthetic peptide"
QKIPVLFSIM

SEQ ID NO: 26537 - protein, 9 aa, Artificial Sequence
  source: /note="Description of Artificial Sequence: Synthetic peptide"
SVDDRQSSK

SEQ ID NO: 26538 - protein, 9 aa, Artificial Sequence
  source: /note="Description of Artificial Sequence: Synthetic peptide"
RQSSKATTS

SEQ ID NO: 26539 - protein, 10 aa, Artificial Sequence
  source: /note="Description of Artificial Sequence: Synthetic peptide"
GSVDDRQSSK

SEQ ID NO: 26540 - protein, 10 aa, Artificial Sequence
  source: /note="Description of Artificial Sequence: Synthetic peptide"
RQSSKATTSQ

SEQ ID NO: 26541 - protein, 9 aa, Artificial Sequence
  source: /note="Description of Artificial Sequence: Synthetic peptide"
FTDIIKLFN

SEQ ID NO: 26542 - protein, 9 aa, Artificial Sequence
  source: /note="Description of Artificial Sequence: Synthetic peptide"
KLFNEMAER

SEQ ID NO: 26543 - protein, 9 aa, Artificial Sequence
  source: /note="Description of Artificial Sequence: Synthetic peptide"
DFTDIIKLF

SEQ ID NO: 26544 - protein, 9 aa, Artificial Sequence
  source: /note="Description of Artificial Sequence: Synthetic peptide"
DIIKLFNEM

SEQ ID NO: 26545 - protein, 9 aa, Artificial Sequence
  source: /note="Description of Artificial Sequence: Synthetic peptide"
MDFTDIIKL

SEQ ID NO: 26546 - protein, 10 aa, Artificial Sequence
  source: /note="Description of Artificial Sequence: Synthetic peptide"
NMDFTDIIKL

SEQ ID NO: 26547 - protein, 10 aa, Artificial Sequence
  source: /note="Description of Artificial Sequence: Synthetic peptide"
DIIKLFNEMA

SEQ ID NO: 26548 - protein, 10 aa, Artificial Sequence
  source: /note="Description of Artificial Sequence: Synthetic peptide"
MDFTDIIKLF

SEQ ID NO: 26549 - protein, 9 aa, Artificial Sequence
  source: /note="Description of Artificial Sequence: Synthetic peptide"
VLSGALPPV

SEQ ID NO: 26550 - protein, 9 aa, Artificial Sequence
  source: /note="Description of Artificial Sequence: Synthetic peptide"
TQSQLPVSV

SEQ ID NO: 26551 - protein, 9 aa, Artificial Sequence
  source: /note="Description of Artificial Sequence: Synthetic peptide"
GALPPVILF

SEQ ID NO: 26552 - protein, 9 aa, Artificial Sequence
  source: /note="Description of Artificial Sequence: Synthetic peptide"
PVSVRHGRK

SEQ ID NO: 26553 - protein, 9 aa, Artificial Sequence
  source: /note="Description of Artificial Sequence: Synthetic peptide"
SVRHGRKTK

SEQ ID NO: 26554 - protein, 9 aa, Artificial Sequence
  source: /note="Description of Artificial Sequence: Synthetic peptide"
LPVSVRHGR

SEQ ID NO: 26555 - protein, 9 aa, Artificial Sequence
  source: /note="Description of Artificial Sequence: Synthetic peptide"
SPSVLSGAL

SEQ ID NO: 26556 - protein, 9 aa, Artificial Sequence
  source: /note="Description of Artificial Sequence: Synthetic peptide"
SWTQSQLPV

SEQ ID NO: 26557 - protein, 9 aa, Artificial Sequence
  source: /note="Description of Artificial Sequence: Synthetic peptide"
SQLPVSVRH

SEQ ID NO: 26558 - protein, 10 aa, Artificial Sequence
  source: /note="Description of Artificial Sequence: Synthetic peptide"
SVLSGALPPV

SEQ ID NO: 26559 - protein, 10 aa, Artificial Sequence
  source: /note="Description of Artificial Sequence: Synthetic peptide"
VLSGALPPVI

SEQ ID NO: 26560 - protein, 10 aa, Artificial Sequence
  source: /note="Description of Artificial Sequence: Synthetic peptide"
ILFGNSWTQS

SEQ ID NO: 26561 - protein, 10 aa, Artificial Sequence
  source: /note="Description of Artificial Sequence: Synthetic peptide"
WTQSQLPVSV

SEQ ID NO: 26562 - protein, 10 aa, Artificial Sequence
  source: /note="Description of Artificial Sequence: Synthetic peptide"
VSVRHGRKTK

SEQ ID NO: 26563 - protein, 10 aa, Artificial Sequence
  source: /note="Description of Artificial Sequence: Synthetic peptide"
QLPVSVRHGR

SEQ ID NO: 26564 - protein, 10 aa, Artificial Sequence
  source: /note="Description of Artificial Sequence: Synthetic peptide"
NSWTQSQLPV

SEQ ID NO: 26565 - protein, 10 aa, Artificial Sequence
  source: /note="Description of Artificial Sequence: Synthetic peptide"
SGALPPVILF

SEQ ID NO: 26566 - protein, 10 aa, Artificial Sequence
  source: /note="Description of Artificial Sequence: Synthetic peptide"
FGNSWTQSQL

SEQ ID NO: 26567 - protein, 10 aa, Artificial Sequence
  source: /note="Description of Artificial Sequence: Synthetic peptide"
SQLPVSVRHG

SEQ ID NO: 26568 - protein, 10 aa, Artificial Sequence
  source: /note="Description of Artificial Sequence: Synthetic peptide"
PPVILFGNSW

SEQ ID NO: 26569 - protein, 9 aa, Artificial Sequence
  source: /note="Description of Artificial Sequence: Synthetic peptide"
RWSLRPAAR

SEQ ID NO: 26570 - protein, 9 aa, Artificial Sequence
  source: /note="Description of Artificial Sequence: Synthetic peptide"
RPAARRPWR

SEQ ID NO: 26571 - protein, 9 aa, Artificial Sequence
  source: /note="Description of Artificial Sequence: Synthetic peptide"
CSARKENQR

SEQ ID NO: 26572 - protein, 9 aa, Artificial Sequence
  source: /note="Description of Artificial Sequence: Synthetic peptide"
WSLRPAARR

SEQ ID NO: 26573 - protein, 9 aa, Artificial Sequence
  source: /note="Description of Artificial Sequence: Synthetic peptide"
RKENQRWSL

SEQ ID NO: 26574 - protein, 9 aa, Artificial Sequence
  source: /note="Description of Artificial Sequence: Synthetic peptide"
NQRWSLRPA

SEQ ID NO: 26575 - protein, 9 aa, Artificial Sequence
  source: /note="Description of Artificial Sequence: Synthetic peptide"
QRWSLRPAA

SEQ ID NO: 26576 - protein, 9 aa, Artificial Sequence
  source: /note="Description of Artificial Sequence: Synthetic peptide"
WEQLDTEPT

SEQ ID NO: 26577 - protein, 9 aa, Artificial Sequence
  source: /note="Description of Artificial Sequence: Synthetic peptide"
APSPCHPLW

SEQ ID NO: 26578 - protein, 10 aa, Artificial Sequence
  source: /note="Description of Artificial Sequence: Synthetic peptide"
RWSLRPAARR

SEQ ID NO: 26579 - protein, 10 aa, Artificial Sequence
  source: /note="Description of Artificial Sequence: Synthetic peptide"
SLRPAARRPW

SEQ ID NO: 26580 - protein, 10 aa, Artificial Sequence
  source: /note="Description of Artificial Sequence: Synthetic peptide"
EQLDTEPTPR

SEQ ID NO: 26581 - protein, 10 aa, Artificial Sequence
  source: /note="Description of Artificial Sequence: Synthetic peptide"
SAAPSPCHPL

SEQ ID NO: 26582 - protein, 10 aa, Artificial Sequence
  source: /note="Description of Artificial Sequence: Synthetic peptide"
RPAARRPWRS

SEQ ID NO: 26583 - protein, 10 aa, Artificial Sequence
  source: /note="Description of Artificial Sequence: Synthetic peptide"
NQRWSLRPAA

SEQ ID NO: 26584 - protein, 9 aa, Artificial Sequence
  source: /note="Description of Artificial Sequence: Synthetic peptide"
TLYMTCSAY

SEQ ID NO: 26585 - protein, 9 aa, Artificial Sequence
  source: /note="Description of Artificial Sequence: Synthetic peptide"
ATLYMTCSA

SEQ ID NO: 26586 - protein, 9 aa, Artificial Sequence
  source: /note="Description of Artificial Sequence: Synthetic peptide"
KEWEGPATL

SEQ ID NO: 26587 - protein, 9 aa, Artificial Sequence
  source: /note="Description of Artificial Sequence: Synthetic peptide"
WEGPATLYM

SEQ ID NO: 26588 - protein, 10 aa, Artificial Sequence
  source: /note="Description of Artificial Sequence: Synthetic peptide"
ATLYMTCSAY

SEQ ID NO: 26589 - protein, 10 aa, Artificial Sequence
  source: /note="Description of Artificial Sequence: Synthetic peptide"
LYMTCSAYQK

SEQ ID NO: 26590 - protein, 10 aa, Artificial Sequence
  source: /note="Description of Artificial Sequence: Synthetic peptide"
KEWEGPATLY

SEQ ID NO: 26591 - protein, 10 aa, Artificial Sequence
  source: /note="Description of Artificial Sequence: Synthetic peptide"
KKEWEGPATL

SEQ ID NO: 26592 - protein, 10 aa, Artificial Sequence
  source: /note="Description of Artificial Sequence: Synthetic peptide"
WEGPATLYMT

SEQ ID NO: 26593 - protein, 9 aa, Artificial Sequence
  source: /note="Description of Artificial Sequence: Synthetic peptide"
HSPSGCHMV

SEQ ID NO: 26594 - protein, 9 aa, Artificial Sequence
  source: /note="Description of Artificial Sequence: Synthetic peptide"
VHSPSGCHM

SEQ ID NO: 26595 - protein, 10 aa, Artificial Sequence
  source: /note="Description of Artificial Sequence: Synthetic peptide"
MVHSPSGCHM

SEQ ID NO: 26596 - protein, 10 aa, Artificial Sequence
  source: /note="Description of Artificial Sequence: Synthetic peptide"
SPSGCHMVEI

SEQ ID NO: 26597 - protein, 10 aa, Artificial Sequence
  source: /note="Description of Artificial Sequence: Synthetic peptide"
RMVHSPSGCH

SEQ ID NO: 26598 - protein, 10 aa, Artificial Sequence
  source: /note="Description of Artificial Sequence: Synthetic peptide"
CHMVEISTPV

SEQ ID NO: 26599 - protein, 9 aa, Artificial Sequence
  source: /note="Description of Artificial Sequence: Synthetic peptide"
NEDQEVCML

SEQ ID NO: 26600 - protein, 10 aa, Artificial Sequence
  source: /note="Description of Artificial Sequence: Synthetic peptide"
CMLFKDLSAR

SEQ ID NO: 26601 - protein, 10 aa, Artificial Sequence
  source: /note="Description of Artificial Sequence: Synthetic peptide"
LENEDQEVCM

SEQ ID NO: 26602 - protein, 10 aa, Artificial Sequence
  source: /note="Description of Artificial Sequence: Synthetic peptide"
NEDQEVCMLF

SEQ ID NO: 26603 - protein, 10 aa, Artificial Sequence
  source: /note="Description of Artificial Sequence: Synthetic peptide"
QEVCMLFKDL

SEQ ID NO: 26604 - protein, 9 aa, Artificial Sequence
  source: /note="Description of Artificial Sequence: Synthetic peptide"
FMHMKLTKT

SEQ ID NO: 26605 - protein, 9 aa, Artificial Sequence
  source: /note="Description of Artificial Sequence: Synthetic peptide"
GFMHMKLTK

SEQ ID NO: 26606 - protein, 9 aa, Artificial Sequence
  source: /note="Description of Artificial Sequence: Synthetic peptide"
KLTKTKEKY

SEQ ID NO: 26607 - protein, 10 aa, Artificial Sequence
  source: /note="Description of Artificial Sequence: Synthetic peptide"
KLTKTKEKYV

SEQ ID NO: 26608 - protein, 10 aa, Artificial Sequence
  source: /note="Description of Artificial Sequence: Synthetic peptide"
FMHMKLTKTK

SEQ ID NO: 26609 - protein, 10 aa, Artificial Sequence
  source: /note="Description of Artificial Sequence: Synthetic peptide"
QGFMHMKLTK

SEQ ID NO: 26610 - protein, 10 aa, Artificial Sequence
  source: /note="Description of Artificial Sequence: Synthetic peptide"
HMKLTKTKEK

SEQ ID NO: 26611 - protein, 10 aa, Artificial Sequence
  source: /note="Description of Artificial Sequence: Synthetic peptide"
LTKTKEKYVL

SEQ ID NO: 26612 - protein, 10 aa, Artificial Sequence
  source: /note="Description of Artificial Sequence: Synthetic peptide"
MKLTKTKEKY

SEQ ID NO: 26613 - protein, 9 aa, Artificial Sequence
  source: /note="Description of Artificial Sequence: Synthetic peptide"
EEAEEEEEL

SEQ ID NO: 26614 - protein, 9 aa, Artificial Sequence
  source: /note="Description of Artificial Sequence: Synthetic peptide"
FMPAYWALG

SEQ ID NO: 26615 - protein, 9 aa, Artificial Sequence
  source: /note="Description of Artificial Sequence: Synthetic peptide"
PFMPAYWAL

SEQ ID NO: 26616 - protein, 9 aa, Artificial Sequence
  source: /note="Description of Artificial Sequence: Synthetic peptide"
IGHPFMPAY

SEQ ID NO: 26617 - protein, 9 aa, Artificial Sequence
  source: /note="Description of Artificial Sequence: Synthetic peptide"
HPFMPAYWA

SEQ ID NO: 26618 - protein, 9 aa, Artificial Sequence
  source: /note="Description of Artificial Sequence: Synthetic peptide"
YHEVIGHPF

SEQ ID NO: 26619 - protein, 9 aa, Artificial Sequence
  source: /note="Description of Artificial Sequence: Synthetic peptide"
HEVIGHPFM

SEQ ID NO: 26620 - protein, 10 aa, Artificial Sequence
  source: /note="Description of Artificial Sequence: Synthetic peptide"
FMPAYWALGF

SEQ ID NO: 26621 - protein, 10 aa, Artificial Sequence
  source: /note="Description of Artificial Sequence: Synthetic peptide"
QYHEVIGHPF

SEQ ID NO: 26622 - protein, 10 aa, Artificial Sequence
  source: /note="Description of Artificial Sequence: Synthetic peptide"
VIGHPFMPAY

SEQ ID NO: 26623 - protein, 10 aa, Artificial Sequence
  source: /note="Description of Artificial Sequence: Synthetic peptide"
EVIGHPFMPA

SEQ ID NO: 26624 - protein, 10 aa, Artificial Sequence
  source: /note="Description of Artificial Sequence: Synthetic peptide"
HPFMPAYWAL

SEQ ID NO: 26625 - protein, 10 aa, Artificial Sequence
  source: /note="Description of Artificial Sequence: Synthetic peptide"
YHEVIGHPFM

SEQ ID NO: 26626 - protein, 10 aa, Artificial Sequence
  source: /note="Description of Artificial Sequence: Synthetic peptide"
IGHPFMPAYW

SEQ ID NO: 26627 - protein, 9 aa, Artificial Sequence
  source: /note="Description of Artificial Sequence: Synthetic peptide"
TFNASYDTK

SEQ ID NO: 26628 - protein, 10 aa, Artificial Sequence
  source: /note="Description of Artificial Sequence: Synthetic peptide"
QTFNASYDTK

SEQ ID NO: 26629 - protein, 10 aa, Artificial Sequence
  source: /note="Description of Artificial Sequence: Synthetic peptide"
ASYDTKNLHV

SEQ ID NO: 26630 - protein, 9 aa, Artificial Sequence
  source: /note="Description of Artificial Sequence: Synthetic peptide"
SASTSSWLR

SEQ ID NO: 26631 - protein, 9 aa, Artificial Sequence
  source: /note="Description of Artificial Sequence: Synthetic peptide"
STSSWLRSR

SEQ ID NO: 26632 - protein, 9 aa, Artificial Sequence
  source: /note="Description of Artificial Sequence: Synthetic peptide"
PPSASTSSW

SEQ ID NO: 26633 - protein, 10 aa, Artificial Sequence
  source: /note="Description of Artificial Sequence: Synthetic peptide"
ASTSSWLRSR

SEQ ID NO: 26634 - protein, 10 aa, Artificial Sequence
  source: /note="Description of Artificial Sequence: Synthetic peptide"
SPPSASTSSW

SEQ ID NO: 26635 - protein, 9 aa, Artificial Sequence
  source: /note="Description of Artificial Sequence: Synthetic peptide"
ISRDNMPAL

SEQ ID NO: 26636 - protein, 9 aa, Artificial Sequence
  source: /note="Description of Artificial Sequence: Synthetic peptide"
MPALEPQPQ

SEQ ID NO: 26637 - protein, 10 aa, Artificial Sequence
  source: /note="Description of Artificial Sequence: Synthetic peptide"
SISRDNMPAL

SEQ ID NO: 26638 - protein, 10 aa, Artificial Sequence
  source: /note="Description of Artificial Sequence: Synthetic peptide"
LVISISRDNM

SEQ ID NO: 26639 - protein, 10 aa, Artificial Sequence
  source: /note="Description of Artificial Sequence: Synthetic peptide"
ISISRDNMPA

SEQ ID NO: 26640 - protein, 10 aa, Artificial Sequence
  source: /note="Description of Artificial Sequence: Synthetic peptide"
MPALEPQPQG

SEQ ID NO: 26641 - protein, 9 aa, Artificial Sequence
  source: /note="Description of Artificial Sequence: Synthetic peptide"
MVFQANRTV

SEQ ID NO: 26642 - protein, 9 aa, Artificial Sequence
  source: /note="Description of Artificial Sequence: Synthetic peptide"
RVMVFQANR

SEQ ID NO: 26643 - protein, 10 aa, Artificial Sequence
  source: /note="Description of Artificial Sequence: Synthetic peptide"
VMVFQANRTV

SEQ ID NO: 26644 - protein, 10 aa, Artificial Sequence
  source: /note="Description of Artificial Sequence: Synthetic peptide"
RVMVFQANRT

SEQ ID NO: 26645 - protein, 10 aa, Artificial Sequence
  source: /note="Description of Artificial Sequence: Synthetic peptide"
MVFQANRTVL

SEQ ID NO: 26646 - protein, 10 aa, Artificial Sequence
  source: /note="Description of Artificial Sequence: Synthetic peptide"
FQANRTVLEN

SEQ ID NO: 26647 - protein, 9 aa, Artificial Sequence
  source: /note="Description of Artificial Sequence: Synthetic peptide"
QAPSRPLPR

SEQ ID NO: 26648 - protein, 9 aa, Artificial Sequence
  source: /note="Description of Artificial Sequence: Synthetic peptide"
APSRPLPRL

SEQ ID NO: 26649 - protein, 9 aa, Artificial Sequence
  source: /note="Description of Artificial Sequence: Synthetic peptide"
CSQAPSRPL

SEQ ID NO: 26650 - protein, 9 aa, Artificial Sequence
  source: /note="Description of Artificial Sequence: Synthetic peptide"
SQAPSRPLP

SEQ ID NO: 26651 - protein, 10 aa, Artificial Sequence
  source: /note="Description of Artificial Sequence: Synthetic peptide"
SQAPSRPLPR

SEQ ID NO: 26652 - protein, 9 aa, Artificial Sequence
  source: /note="Description of Artificial Sequence: Synthetic peptide"
YQNVGLVAM

SEQ ID NO: 26653 - protein, 9 aa, Artificial Sequence
  source: /note="Description of Artificial Sequence: Synthetic peptide"
GLVAMGHSL

SEQ ID NO: 26654 - protein, 9 aa, Artificial Sequence
  source: /note="Description of Artificial Sequence: Synthetic peptide"
MGHSLPPSA

SEQ ID NO: 26655 - protein, 9 aa, Artificial Sequence
  source: /note="Description of Artificial Sequence: Synthetic peptide"
VAMGHSLPP

SEQ ID NO: 26656 - protein, 10 aa, Artificial Sequence
  source: /note="Description of Artificial Sequence: Synthetic peptide"
AMGHSLPPSA

SEQ ID NO: 26657 - protein, 10 aa, Artificial Sequence
  source: /note="Description of Artificial Sequence: Synthetic peptide"
CYQNVGLVAM

SEQ ID NO: 26658 - protein, 10 aa, Artificial Sequence
  source: /note="Description of Artificial Sequence: Synthetic peptide"
YQNVGLVAMG

SEQ ID NO: 26659 - protein, 10 aa, Artificial Sequence
  source: /note="Description of Artificial Sequence: Synthetic peptide"
MGHSLPPSAV

SEQ ID NO: 26660 - protein, 9 aa, Artificial Sequence
  source: /note="Description of Artificial Sequence: Synthetic peptide"
KFPFQNNNK

SEQ ID NO: 26661 - protein, 9 aa, Artificial Sequence
  source: /note="Description of Artificial Sequence: Synthetic peptide"
FQNNNKWQR

SEQ ID NO: 26662 - protein, 9 aa, Artificial Sequence
  source: /note="Description of Artificial Sequence: Synthetic peptide"
FPFQNNNKW

SEQ ID NO: 26663 - protein, 9 aa, Artificial Sequence
  source: /note="Description of Artificial Sequence: Synthetic peptide"
YEFKFPFQN

SEQ ID NO: 26664 - protein, 10 aa, Artificial Sequence
  source: /note="Description of Artificial Sequence: Synthetic peptide"
KFPFQNNNKW

SEQ ID NO: 26665 - protein, 10 aa, Artificial Sequence
  source: /note="Description of Artificial Sequence: Synthetic peptide"
YEFKFPFQNN

SEQ ID NO: 26666 - protein, 9 aa, Artificial Sequence
  source: /note="Description of Artificial Sequence: Synthetic peptide"
RGPQDFNYF

SEQ ID NO: 26667 - protein, 9 aa, Artificial Sequence
  source: /note="Description of Artificial Sequence: Synthetic peptide"
YFVLEQHEY

SEQ ID NO: 26668 - protein, 9 aa, Artificial Sequence
  source: /note="Description of Artificial Sequence: Synthetic peptide"
YRGPQDFNY

SEQ ID NO: 26669 - protein, 10 aa, Artificial Sequence
  source: /note="Description of Artificial Sequence: Synthetic peptide"
YRGPQDFNYF

SEQ ID NO: 26670 - protein, 10 aa, Artificial Sequence
  source: /note="Description of Artificial Sequence: Synthetic peptide"
SYRGPQDFNY

SEQ ID NO: 26671 - protein, 10 aa, Artificial Sequence
  source: /note="Description of Artificial Sequence: Synthetic peptide"
NYFVLEQHEY

SEQ ID NO: 26672 - protein, 10 aa, Artificial Sequence
  source: /note="Description of Artificial Sequence: Synthetic peptide"
GPQDFNYFVL

SEQ ID NO: 26673 - protein, 9 aa, Artificial Sequence
  source: /note="Description of Artificial Sequence: Synthetic peptide"
RSKDAPPFA

SEQ ID NO: 26674 - protein, 9 aa, Artificial Sequence
  source: /note="Description of Artificial Sequence: Synthetic peptide"
DAPPFAPPI

SEQ ID NO: 26675 - protein, 10 aa, Artificial Sequence
  source: /note="Description of Artificial Sequence: Synthetic peptide"
RSKDAPPFAP

SEQ ID NO: 26676 - protein, 10 aa, Artificial Sequence
  source: /note="Description of Artificial Sequence: Synthetic peptide"
APPIPSGTTF

SEQ ID NO: 26677 - protein, 10 aa, Artificial Sequence
  source: /note="Description of Artificial Sequence: Synthetic peptide"
KDAPPFAPPI

SEQ ID NO: 26678 - protein, 9 aa, Artificial Sequence
  source: /note="Description of Artificial Sequence: Synthetic peptide"
KGSPDVEFK

SEQ ID NO: 26679 - protein, 9 aa, Artificial Sequence
  source: /note="Description of Artificial Sequence: Synthetic peptide"
KFRKGSPDV

SEQ ID NO: 26680 - protein, 9 aa, Artificial Sequence
  source: /note="Description of Artificial Sequence: Synthetic peptide"
RKGSPDVEF

SEQ ID NO: 26681 - protein, 10 aa, Artificial Sequence
  source: /note="Description of Artificial Sequence: Synthetic peptide"
VKFRKGSPDV

SEQ ID NO: 26682 - protein, 10 aa, Artificial Sequence
  source: /note="Description of Artificial Sequence: Synthetic peptide"
FRKGSPDVEF

SEQ ID NO: 26683 - protein, 9 aa, Artificial Sequence
  source: /note="Description of Artificial Sequence: Synthetic peptide"
QVICEVAHI

SEQ ID NO: 26684 - protein, 10 aa, Artificial Sequence
  source: /note="Description of Artificial Sequence: Synthetic peptide"
VICEVAHITL

SEQ ID NO: 26685 - protein, 10 aa, Artificial Sequence
  source: /note="Description of Artificial Sequence: Synthetic peptide"
SQVICEVAHI

SEQ ID NO: 26686 - protein, 9 aa, Artificial Sequence
  source: /note="Description of Artificial Sequence: Synthetic peptide"
KNNNSSSNK

SEQ ID NO: 26687 - protein, 9 aa, Artificial Sequence
  source: /note="Description of Artificial Sequence: Synthetic peptide"
FADSHHRSL

SEQ ID NO: 26688 - protein, 10 aa, Artificial Sequence
  source: /note="Description of Artificial Sequence: Synthetic peptide"
FADSHHRSLL

SEQ ID NO: 26689 - protein, 9 aa, Artificial Sequence
  source: /note="Description of Artificial Sequence: Synthetic peptide"
GAAAVPGPV

SEQ ID NO: 26690 - protein, 10 aa, Artificial Sequence
  source: /note="Description of Artificial Sequence: Synthetic peptide"
KEAGAAAVPG

SEQ ID NO: 26691 - protein, 9 aa, Artificial Sequence
  source: /note="Description of Artificial Sequence: Synthetic peptide"
KARCAIQQK

SEQ ID NO: 26692 - protein, 9 aa, Artificial Sequence
  source: /note="Description of Artificial Sequence: Synthetic peptide"
RCAIQQKLK

SEQ ID NO: 26693 - protein, 9 aa, Artificial Sequence
  source: /note="Description of Artificial Sequence: Synthetic peptide"
QERKARCAI

SEQ ID NO: 26694 - protein, 10 aa, Artificial Sequence
  source: /note="Description of Artificial Sequence: Synthetic peptide"
KARCAIQQKL

SEQ ID NO: 26695 - protein, 9 aa, Artificial Sequence
  source: /note="Description of Artificial Sequence: Synthetic peptide"
TLAPPYMLL

SEQ ID NO: 26696 - protein, 9 aa, Artificial Sequence
  source: /note="Description of Artificial Sequence: Synthetic peptide"
SMPKSRNQV

SEQ ID NO: 26697 - protein, 9 aa, Artificial Sequence
  source: /note="Description of Artificial Sequence: Synthetic peptide"
KQIPSQSML

SEQ ID NO: 26698 - protein, 9 aa, Artificial Sequence
  source: /note="Description of Artificial Sequence: Synthetic peptide"
QIPSQSMLV

SEQ ID NO: 26699 - protein, 9 aa, Artificial Sequence
  source: /note="Description of Artificial Sequence: Synthetic peptide"
KSRNQVLFR

SEQ ID NO: 26700 - protein, 9 aa, Artificial Sequence
  source: /note="Description of Artificial Sequence: Synthetic peptide"
SLSQSLSRK

SEQ ID NO: 26701 - protein, 9 aa, Artificial Sequence
  source: /note="Description of Artificial Sequence: Synthetic peptide"
QSLSQSLSR

SEQ ID NO: 26702 - protein, 9 aa, Artificial Sequence
  source: /note="Description of Artificial Sequence: Synthetic peptide"
RTLAPPYML

SEQ ID NO: 26703 - protein, 9 aa, Artificial Sequence
  source: /note="Description of Artificial Sequence: Synthetic peptide"
PYMLLPQSL

SEQ ID NO: 26704 - protein, 9 aa, Artificial Sequence
  source: /note="Description of Artificial Sequence: Synthetic peptide"
KKALRSMPK

SEQ ID NO: 26705 - protein, 9 aa, Artificial Sequence
  source: /note="Description of Artificial Sequence: Synthetic peptide"
ALRSMPKSR

SEQ ID NO: 26706 - protein, 9 aa, Artificial Sequence
  source: /note="Description of Artificial Sequence: Synthetic peptide"
RSMPKSRNQ

SEQ ID NO: 26707 - protein, 9 aa, Artificial Sequence
  source: /note="Description of Artificial Sequence: Synthetic peptide"
RNLTPSQLR

SEQ ID NO: 26708 - protein, 9 aa, Artificial Sequence
  source: /note="Description of Artificial Sequence: Synthetic peptide"
QLRTLAPPY

SEQ ID NO: 26709 - protein, 9 aa, Artificial Sequence
  source: /note="Description of Artificial Sequence: Synthetic peptide"
TTVEKKALR

SEQ ID NO: 26710 - protein, 9 aa, Artificial Sequence
  source: /note="Description of Artificial Sequence: Synthetic peptide"
MPKSRNQVL

SEQ ID NO: 26711 - protein, 9 aa, Artificial Sequence
  source: /note="Description of Artificial Sequence: Synthetic peptide"
TPSQLRTLA

SEQ ID NO: 26712 - protein, 9 aa, Artificial Sequence
  source: /note="Description of Artificial Sequence: Synthetic peptide"
LPQSLSQSL

SEQ ID NO: 26713 - protein, 9 aa, Artificial Sequence
  source: /note="Description of Artificial Sequence: Synthetic peptide"
VEKKALRSM

SEQ ID NO: 26714 - protein, 9 aa, Artificial Sequence
  source: /note="Description of Artificial Sequence: Synthetic peptide"
NQVLFRRNL

SEQ ID NO: 26715 - protein, 9 aa, Artificial Sequence
  source: /note="Description of Artificial Sequence: Synthetic peptide"
RRNLTPSQL

SEQ ID NO: 26716 - protein, 9 aa, Artificial Sequence
  source: /note="Description of Artificial Sequence: Synthetic peptide"
SQLRTLAPP

SEQ ID NO: 26717 - protein, 9 aa, Artificial Sequence
  source: /note="Description of Artificial Sequence: Synthetic peptide"
LRTLAPPYM

SEQ ID NO: 26718 - protein, 9 aa, Artificial Sequence
  source: /note="Description of Artificial Sequence: Synthetic peptide"
SQSLSRKQI

SEQ ID NO: 26719 - protein, 9 aa, Artificial Sequence
  source: /note="Description of Artificial Sequence: Synthetic peptide"
RKQIPSQSM

SEQ ID NO: 26720 - protein, 10 aa, Artificial Sequence
  source: /note="Description of Artificial Sequence: Synthetic peptide"
LLPQSLSQSL

SEQ ID NO: 26721 - protein, 10 aa, Artificial Sequence
  source: /note="Description of Artificial Sequence: Synthetic peptide"
KQIPSQSMLV

SEQ ID NO: 26722 - protein, 10 aa, Artificial Sequence
  source: /note="Description of Artificial Sequence: Synthetic peptide"
SMPKSRNQVL

SEQ ID NO: 26723 - protein, 10 aa, Artificial Sequence
  source: /note="Description of Artificial Sequence: Synthetic peptide"
KSRNQVLFRR

SEQ ID NO: 26724 - protein, 10 aa, Artificial Sequence
  source: /note="Description of Artificial Sequence: Synthetic peptide"
QSLSQSLSRK

SEQ ID NO: 26725 - protein, 10 aa, Artificial Sequence
  source: /note="Description of Artificial Sequence: Synthetic peptide"
RTLAPPYMLL

SEQ ID NO: 26726 - protein, 10 aa, Artificial Sequence
  source: /note="Description of Artificial Sequence: Synthetic peptide"
KALRSMPKSR

SEQ ID NO: 26727 - protein, 10 aa, Artificial Sequence
  source: /note="Description of Artificial Sequence: Synthetic peptide"
RSMPKSRNQV

SEQ ID NO: 26728 - protein, 10 aa, Artificial Sequence
  source: /note="Description of Artificial Sequence: Synthetic peptide"
QLRTLAPPYM

SEQ ID NO: 26729 - protein, 10 aa, Artificial Sequence
  source: /note="Description of Artificial Sequence: Synthetic peptide"
SQLRTLAPPY

SEQ ID NO: 26730 - protein, 10 aa, Artificial Sequence
  source: /note="Description of Artificial Sequence: Synthetic peptide"
QTTVEKKALR

SEQ ID NO: 26731 - protein, 10 aa, Artificial Sequence
  source: /note="Description of Artificial Sequence: Synthetic peptide"
MPKSRNQVLF

SEQ ID NO: 26732 - protein, 10 aa, Artificial Sequence
  source: /note="Description of Artificial Sequence: Synthetic peptide"
PPYMLLPQSL

SEQ ID NO: 26733 - protein, 10 aa, Artificial Sequence
  source: /note="Description of Artificial Sequence: Synthetic peptide"
YQTTVEKKAL

SEQ ID NO: 26734 - protein, 10 aa, Artificial Sequence
  source: /note="Description of Artificial Sequence: Synthetic peptide"
FRRNLTPSQL

SEQ ID NO: 26735 - protein, 10 aa, Artificial Sequence
  source: /note="Description of Artificial Sequence: Synthetic peptide"
YMLLPQSLSQ

SEQ ID NO: 26736 - protein, 10 aa, Artificial Sequence
  source: /note="Description of Artificial Sequence: Synthetic peptide"
SRKQIPSQSM

SEQ ID NO: 26737 - protein, 10 aa, Artificial Sequence
  source: /note="Description of Artificial Sequence: Synthetic peptide"
RKQIPSQSML

SEQ ID NO: 26738 - protein, 9 aa, Artificial Sequence
  source: /note="Description of Artificial Sequence: Synthetic peptide"
LLVTLVVLL

SEQ ID NO: 26739 - protein, 9 aa, Artificial Sequence
  source: /note="Description of Artificial Sequence: Synthetic peptide"
LLIMTGTML

SEQ ID NO: 26740 - protein, 9 aa, Artificial Sequence
  source: /note="Description of Artificial Sequence: Synthetic peptide"
VLLIMTGTM

SEQ ID NO: 26741 - protein, 10 aa, Artificial Sequence
  source: /note="Description of Artificial Sequence: Synthetic peptide"
SLLVTLVVLL

SEQ ID NO: 26742 - protein, 10 aa, Artificial Sequence
  source: /note="Description of Artificial Sequence: Synthetic peptide"
LLVTLVVLLI

SEQ ID NO: 26743 - protein, 9 aa, Artificial Sequence
  source: /note="Description of Artificial Sequence: Synthetic peptide"
LIMGCCPGA

SEQ ID NO: 26744 - protein, 9 aa, Artificial Sequence
  source: /note="Description of Artificial Sequence: Synthetic peptide"
GLMEIWISA

SEQ ID NO: 26745 - protein, 9 aa, Artificial Sequence
  source: /note="Description of Artificial Sequence: Synthetic peptide"
SLTFSPSGL

SEQ ID NO: 26746 - protein, 9 aa, Artificial Sequence
  source: /note="Description of Artificial Sequence: Synthetic peptide"
FSPSGLMEI

SEQ ID NO: 26747 - protein, 9 aa, Artificial Sequence
  source: /note="Description of Artificial Sequence: Synthetic peptide"
LTFSPSGLM

SEQ ID NO: 26748 - protein, 9 aa, Artificial Sequence
  source: /note="Description of Artificial Sequence: Synthetic peptide"
MEIWISASV

SEQ ID NO: 26749 - protein, 9 aa, Artificial Sequence
  source: /note="Description of Artificial Sequence: Synthetic peptide"
CPGAPSLTF

SEQ ID NO: 26750 - protein, 9 aa, Artificial Sequence
  source: /note="Description of Artificial Sequence: Synthetic peptide"
APSLTFSPS

SEQ ID NO: 26751 - protein, 9 aa, Artificial Sequence
  source: /note="Description of Artificial Sequence: Synthetic peptide"
SPSGLMEIW

SEQ ID NO: 26752 - protein, 10 aa, Artificial Sequence
  source: /note="Description of Artificial Sequence: Synthetic peptide"
VLIMGCCPGA

SEQ ID NO: 26753 - protein, 10 aa, Artificial Sequence
  source: /note="Description of Artificial Sequence: Synthetic peptide"
GLMEIWISAS

SEQ ID NO: 26754 - protein, 10 aa, Artificial Sequence
  source: /note="Description of Artificial Sequence: Synthetic peptide"
LMEIWISASV

SEQ ID NO: 26755 - protein, 10 aa, Artificial Sequence
  source: /note="Description of Artificial Sequence: Synthetic peptide"
SLTFSPSGLM

SEQ ID NO: 26756 - protein, 10 aa, Artificial Sequence
  source: /note="Description of Artificial Sequence: Synthetic peptide"
TFSPSGLMEI

SEQ ID NO: 26757 - protein, 10 aa, Artificial Sequence
  source: /note="Description of Artificial Sequence: Synthetic peptide"
MGCCPGAPSL

SEQ ID NO: 26758 - protein, 10 aa, Artificial Sequence
  source: /note="Description of Artificial Sequence: Synthetic peptide"
SPSGLMEIWI

SEQ ID NO: 26759 - protein, 9 aa, Artificial Sequence
  source: /note="Description of Artificial Sequence: Synthetic peptide"
FIFSTRNNL

SEQ ID NO: 26760 - protein, 9 aa, Artificial Sequence
  source: /note="Description of Artificial Sequence: Synthetic peptide"
STRNNLGFT

SEQ ID NO: 26761 - protein, 9 aa, Artificial Sequence
  source: /note="Description of Artificial Sequence: Synthetic peptide"
RNNLGFTPA

SEQ ID NO: 26762 - protein, 9 aa, Artificial Sequence
  source: /note="Description of Artificial Sequence: Synthetic peptide"
FSTRNNLGF

SEQ ID NO: 26763 - protein, 10 aa, Artificial Sequence
  source: /note="Description of Artificial Sequence: Synthetic peptide"
NLGFTPADTV

SEQ ID NO: 26764 - protein, 10 aa, Artificial Sequence
  source: /note="Description of Artificial Sequence: Synthetic peptide"
TFIFSTRNNL

SEQ ID NO: 26765 - protein, 10 aa, Artificial Sequence
  source: /note="Description of Artificial Sequence: Synthetic peptide"
IFSTRNNLGF

SEQ ID NO: 26766 - protein, 9 aa, Artificial Sequence
  source: /note="Description of Artificial Sequence: Synthetic peptide"
LLKESDLMM

SEQ ID NO: 26767 - protein, 10 aa, Artificial Sequence
  source: /note="Description of Artificial Sequence: Synthetic peptide"
LLKESDLMMV

SEQ ID NO: 26768 - protein, 10 aa, Artificial Sequence
  source: /note="Description of Artificial Sequence: Synthetic peptide"
LMMVDPTNDI

SEQ ID NO: 26769 - protein, 9 aa, Artificial Sequence
  source: /note="Description of Artificial Sequence: Synthetic peptide"
MGPQRQAMK

SEQ ID NO: 26770 - protein, 9 aa, Artificial Sequence
  source: /note="Description of Artificial Sequence: Synthetic peptide"
HMGPQRQAM

SEQ ID NO: 26771 - protein, 9 aa, Artificial Sequence
  source: /note="Description of Artificial Sequence: Synthetic peptide"
PQRQAMKEM

SEQ ID NO: 26772 - protein, 10 aa, Artificial Sequence
  source: /note="Description of Artificial Sequence: Synthetic peptide"
HMGPQRQAMK

SEQ ID NO: 26773 - protein, 10 aa, Artificial Sequence
  source: /note="Description of Artificial Sequence: Synthetic peptide"
HVHMGPQRQA

SEQ ID NO: 26774 - protein, 10 aa, Artificial Sequence
  source: /note="Description of Artificial Sequence: Synthetic peptide"
GPQRQAMKEM

SEQ ID NO: 26775 - protein, 10 aa, Artificial Sequence
  source: /note="Description of Artificial Sequence: Synthetic peptide"
VHMGPQRQAM

SEQ ID NO: 26776 - protein, 9 aa, Artificial Sequence
  source: /note="Description of Artificial Sequence: Synthetic peptide"
LRVEHGPPT

SEQ ID NO: 26777 - protein, 10 aa, Artificial Sequence
  source: /note="Description of Artificial Sequence: Synthetic peptide"
RVEHGPPTPR

SEQ ID NO: 26778 - protein, 9 aa, Artificial Sequence
  source: /note="Description of Artificial Sequence: Synthetic peptide"
SGLSEWLGK

SEQ ID NO: 26779 - protein, 9 aa, Artificial Sequence
  source: /note="Description of Artificial Sequence: Synthetic peptide"
SSHCHHPLP

SEQ ID NO: 26780 - protein, 9 aa, Artificial Sequence
  source: /note="Description of Artificial Sequence: Synthetic peptide"
HPLPPGGHL

SEQ ID NO: 26781 - protein, 9 aa, Artificial Sequence
  source: /note="Description of Artificial Sequence: Synthetic peptide"
KQADPTAEC

SEQ ID NO: 26782 - protein, 9 aa, Artificial Sequence
  source: /note="Description of Artificial Sequence: Synthetic peptide"
SSSHCHHPL

SEQ ID NO: 26783 - protein, 9 aa, Artificial Sequence
  source: /note="Description of Artificial Sequence: Synthetic peptide"
SEWLGKQAD

SEQ ID NO: 26784 - protein, 10 aa, Artificial Sequence
  source: /note="Description of Artificial Sequence: Synthetic peptide"
GLSEWLGKQA

SEQ ID NO: 26785 - protein, 10 aa, Artificial Sequence
  source: /note="Description of Artificial Sequence: Synthetic peptide"
RSGLSEWLGK

SEQ ID NO: 26786 - protein, 10 aa, Artificial Sequence
  source: /note="Description of Artificial Sequence: Synthetic peptide"
KQADPTAECA

SEQ ID NO: 26787 - protein, 10 aa, Artificial Sequence
  source: /note="Description of Artificial Sequence: Synthetic peptide"
ASSSHCHHPL

SEQ ID NO: 26788 - protein, 10 aa, Artificial Sequence
  source: /note="Description of Artificial Sequence: Synthetic peptide"
SEWLGKQADP

SEQ ID NO: 26789 - protein, 10 aa, Artificial Sequence
  source: /note="Description of Artificial Sequence: Synthetic peptide"
LPPGGHLHRV

SEQ ID NO: 26790 - protein, 9 aa, Artificial Sequence
  source: /note="Description of Artificial Sequence: Synthetic peptide"
LLFAWLWLP

SEQ ID NO: 26791 - protein, 9 aa, Artificial Sequence
  source: /note="Description of Artificial Sequence: Synthetic peptide"
FAWLWLPFV

SEQ ID NO: 26792 - protein, 9 aa, Artificial Sequence
  source: /note="Description of Artificial Sequence: Synthetic peptide"
WLWLPFVYM

SEQ ID NO: 26793 - protein, 9 aa, Artificial Sequence
  source: /note="Description of Artificial Sequence: Synthetic peptide"
LFAWLWLPF

SEQ ID NO: 26794 - protein, 9 aa, Artificial Sequence
  source: /note="Description of Artificial Sequence: Synthetic peptide"
AWLWLPFVY

SEQ ID NO: 26795 - protein, 9 aa, Artificial Sequence
  source: /note="Description of Artificial Sequence: Synthetic peptide"
WLPFVYMRF

SEQ ID NO: 26796 - protein, 9 aa, Artificial Sequence
  source: /note="Description of Artificial Sequence: Synthetic peptide"
PFVYMRFNF

SEQ ID NO: 26797 - protein, 9 aa, Artificial Sequence
  source: /note="Description of Artificial Sequence: Synthetic peptide"
LWLPFVYMR

SEQ ID NO: 26798 - protein, 10 aa, Artificial Sequence
  source: /note="Description of Artificial Sequence: Synthetic peptide"
FAWLWLPFVY

SEQ ID NO: 26799 - protein, 10 aa, Artificial Sequence
  source: /note="Description of Artificial Sequence: Synthetic peptide"
LLFAWLWLPF

SEQ ID NO: 26800 - protein, 10 aa, Artificial Sequence
  source: /note="Description of Artificial Sequence: Synthetic peptide"
LFAWLWLPFV

SEQ ID NO: 26801 - protein, 10 aa, Artificial Sequence
  source: /note="Description of Artificial Sequence: Synthetic peptide"
AWLWLPFVYM

SEQ ID NO: 26802 - protein, 10 aa, Artificial Sequence
  source: /note="Description of Artificial Sequence: Synthetic peptide"
LWLPFVYMRF

SEQ ID NO: 26803 - protein, 10 aa, Artificial Sequence
  source: /note="Description of Artificial Sequence: Synthetic peptide"
PFVYMRFNFK

SEQ ID NO: 26804 - protein, 10 aa, Artificial Sequence
  source: /note="Description of Artificial Sequence: Synthetic peptide"
WLWLPFVYMR

SEQ ID NO: 26805 - protein, 10 aa, Artificial Sequence
  source: /note="Description of Artificial Sequence: Synthetic peptide"
LPFVYMRFNF

SEQ ID NO: 26806 - protein, 9 aa, Artificial Sequence
  source: /note="Description of Artificial Sequence: Synthetic peptide"
LLIQPCIQI

SEQ ID NO: 26807 - protein, 9 aa, Artificial Sequence
  source: /note="Description of Artificial Sequence: Synthetic peptide"
CIQIIEQSR

SEQ ID NO: 26808 - protein, 10 aa, Artificial Sequence
  source: /note="Description of Artificial Sequence: Synthetic peptide"
FLLIQPCIQI

SEQ ID NO: 26809 - protein, 10 aa, Artificial Sequence
  source: /note="Description of Artificial Sequence: Synthetic peptide"
LLIQPCIQII

SEQ ID NO: 26810 - protein, 10 aa, Artificial Sequence
  source: /note="Description of Artificial Sequence: Synthetic peptide"
QIIEQSRRKY

SEQ ID NO: 26811 - protein, 10 aa, Artificial Sequence
  source: /note="Description of Artificial Sequence: Synthetic peptide"
CIQIIEQSRR

SEQ ID NO: 26812 - protein, 9 aa, Artificial Sequence
  source: /note="Description of Artificial Sequence: Synthetic peptide"
LLTRGFSYV

SEQ ID NO: 26813 - protein, 9 aa, Artificial Sequence
  source: /note="Description of Artificial Sequence: Synthetic peptide"
RLVVMLGGA

SEQ ID NO: 26814 - protein, 9 aa, Artificial Sequence
  source: /note="Description of Artificial Sequence: Synthetic peptide"
LTRGFSYVR

SEQ ID NO: 26815 - protein, 9 aa, Artificial Sequence
  source: /note="Description of Artificial Sequence: Synthetic peptide"
YVRRHRHHL

SEQ ID NO: 26816 - protein, 9 aa, Artificial Sequence
  source: /note="Description of Artificial Sequence: Synthetic peptide"
RHRHHLWSG

SEQ ID NO: 26817 - protein, 9 aa, Artificial Sequence
  source: /note="Description of Artificial Sequence: Synthetic peptide"
LLLTRGFSY

SEQ ID NO: 26818 - protein, 9 aa, Artificial Sequence
  source: /note="Description of Artificial Sequence: Synthetic peptide"
GFSYVRRHR

SEQ ID NO: 26819 - protein, 9 aa, Artificial Sequence
  source: /note="Description of Artificial Sequence: Synthetic peptide"
CQHRDGGRL

SEQ ID NO: 26820 - protein, 9 aa, Artificial Sequence
  source: /note="Description of Artificial Sequence: Synthetic peptide"
GRLLLTRGF

SEQ ID NO: 26821 - protein, 9 aa, Artificial Sequence
  source: /note="Description of Artificial Sequence: Synthetic peptide"
RGFSYVRRH

SEQ ID NO: 26822 - protein, 9 aa, Artificial Sequence
  source: /note="Description of Artificial Sequence: Synthetic peptide"
RHHLWSGIL

SEQ ID NO: 26823 - protein, 9 aa, Artificial Sequence
  source: /note="Description of Artificial Sequence: Synthetic peptide"
HHLWSGILL

SEQ ID NO: 26824 - protein, 10 aa, Artificial Sequence
  source: /note="Description of Artificial Sequence: Synthetic peptide"
LLLTRGFSYV

SEQ ID NO: 26825 - protein, 10 aa, Artificial Sequence
  source: /note="Description of Artificial Sequence: Synthetic peptide"
RLLLTRGFSY

SEQ ID NO: 26826 - protein, 10 aa, Artificial Sequence
  source: /note="Description of Artificial Sequence: Synthetic peptide"
SYVRRHRHHL

SEQ ID NO: 26827 - protein, 10 aa, Artificial Sequence
  source: /note="Description of Artificial Sequence: Synthetic peptide"
LTRGFSYVRR

SEQ ID NO: 26828 - protein, 10 aa, Artificial Sequence
  source: /note="Description of Artificial Sequence: Synthetic peptide"
RGFSYVRRHR

SEQ ID NO: 26829 - protein, 10 aa, Artificial Sequence
  source: /note="Description of Artificial Sequence: Synthetic peptide"
RHRHHLWSGI

SEQ ID NO: 26830 - protein, 10 aa, Artificial Sequence
  source: /note="Description of Artificial Sequence: Synthetic peptide"
MLGGATCQHR

SEQ ID NO: 26831 - protein, 10 aa, Artificial Sequence
  source: /note="Description of Artificial Sequence: Synthetic peptide"
ATCQHRDGGR

SEQ ID NO: 26832 - protein, 10 aa, Artificial Sequence
  source: /note="Description of Artificial Sequence: Synthetic peptide"
LLTRGFSYVR

SEQ ID NO: 26833 - protein, 10 aa, Artificial Sequence
  source: /note="Description of Artificial Sequence: Synthetic peptide"
VMLGGATCQH

SEQ ID NO: 26834 - protein, 10 aa, Artificial Sequence
  source: /note="Description of Artificial Sequence: Synthetic peptide"
CQHRDGGRLL

SEQ ID NO: 26835 - protein, 10 aa, Artificial Sequence
  source: /note="Description of Artificial Sequence: Synthetic peptide"
FSYVRRHRHH

SEQ ID NO: 26836 - protein, 10 aa, Artificial Sequence
  source: /note="Description of Artificial Sequence: Synthetic peptide"
YVRRHRHHLW

SEQ ID NO: 26837 - protein, 10 aa, Artificial Sequence
  source: /note="Description of Artificial Sequence: Synthetic peptide"
HRHHLWSGIL

SEQ ID NO: 26838 - protein, 10 aa, Artificial Sequence
  source: /note="Description of Artificial Sequence: Synthetic peptide"
RHHLWSGILL

SEQ ID NO: 26839 - protein, 9 aa, Artificial Sequence
  source: /note="Description of Artificial Sequence: Synthetic peptide"
AFYFSGFFI

SEQ ID NO: 26840 - protein, 9 aa, Artificial Sequence
  source: /note="Description of Artificial Sequence: Synthetic peptide"
FYFSGFFIL

SEQ ID NO: 26841 - protein, 9 aa, Artificial Sequence
  source: /note="Description of Artificial Sequence: Synthetic peptide"
YFSGFFILL

SEQ ID NO: 26842 - protein, 9 aa, Artificial Sequence
  source: /note="Description of Artificial Sequence: Synthetic peptide"
IAFYFSGFF

SEQ ID NO: 26843 - protein, 10 aa, Artificial Sequence
  source: /note="Description of Artificial Sequence: Synthetic peptide"
IAFYFSGFFI

SEQ ID NO: 26844 - protein, 10 aa, Artificial Sequence
  source: /note="Description of Artificial Sequence: Synthetic peptide"
AFYFSGFFIL

SEQ ID NO: 26845 - protein, 10 aa, Artificial Sequence
  source: /note="Description of Artificial Sequence: Synthetic peptide"
FYFSGFFILL

SEQ ID NO: 26846 - protein, 10 aa, Artificial Sequence
  source: /note="Description of Artificial Sequence: Synthetic peptide"
YFSGFFILLL

SEQ ID NO: 26847 - protein, 10 aa, Artificial Sequence
  source: /note="Description of Artificial Sequence: Synthetic peptide"
DIAFYFSGFF

SEQ ID NO: 26848 - protein, 9 aa, Artificial Sequence
  source: /note="Description of Artificial Sequence: Synthetic peptide"
GMGLGLSSI

SEQ ID NO: 26849 - protein, 9 aa, Artificial Sequence
  source: /note="Description of Artificial Sequence: Synthetic peptide"
GLSSIFALC

SEQ ID NO: 26850 - protein, 9 aa, Artificial Sequence
  source: /note="Description of Artificial Sequence: Synthetic peptide"
SIFALCLGH

SEQ ID NO: 26851 - protein, 9 aa, Artificial Sequence
  source: /note="Description of Artificial Sequence: Synthetic peptide"
MGLGLSSIF

SEQ ID NO: 26852 - protein, 9 aa, Artificial Sequence
  source: /note="Description of Artificial Sequence: Synthetic peptide"
LGLSSIFAL

SEQ ID NO: 26853 - protein, 9 aa, Artificial Sequence
  source: /note="Description of Artificial Sequence: Synthetic peptide"
LSSIFALCL

SEQ ID NO: 26854 - protein, 10 aa, Artificial Sequence
  source: /note="Description of Artificial Sequence: Synthetic peptide"
GLGLSSIFAL

SEQ ID NO: 26855 - protein, 10 aa, Artificial Sequence
  source: /note="Description of Artificial Sequence: Synthetic peptide"
GLSSIFALCL

SEQ ID NO: 26856 - protein, 10 aa, Artificial Sequence
  source: /note="Description of Artificial Sequence: Synthetic peptide"
GMGLGLSSIF

SEQ ID NO: 26857 - protein, 10 aa, Artificial Sequence
  source: /note="Description of Artificial Sequence: Synthetic peptide"
QGMGLGLSSI

SEQ ID NO: 26858 - protein, 9 aa, Artificial Sequence
  source: /note="Description of Artificial Sequence: Synthetic peptide"
KNPFSFFCW

SEQ ID NO: 26859 - protein, 9 aa, Artificial Sequence
  source: /note="Description of Artificial Sequence: Synthetic peptide"
PFSFFCWHF

SEQ ID NO: 26860 - protein, 9 aa, Artificial Sequence
  source: /note="Description of Artificial Sequence: Synthetic peptide"
SFFCWHFPS

SEQ ID NO: 26861 - protein, 9 aa, Artificial Sequence
  source: /note="Description of Artificial Sequence: Synthetic peptide"
FFCWHFPSL

SEQ ID NO: 26862 - protein, 9 aa, Artificial Sequence
  source: /note="Description of Artificial Sequence: Synthetic peptide"
LDHCPGHRF

SEQ ID NO: 26863 - protein, 9 aa, Artificial Sequence
  source: /note="Description of Artificial Sequence: Synthetic peptide"
GHRFQCWNF

SEQ ID NO: 26864 - protein, 9 aa, Artificial Sequence
  source: /note="Description of Artificial Sequence: Synthetic peptide"
FQCWNFACH

SEQ ID NO: 26865 - protein, 9 aa, Artificial Sequence
  source: /note="Description of Artificial Sequence: Synthetic peptide"
WNFACHLSL

SEQ ID NO: 26866 - protein, 9 aa, Artificial Sequence
  source: /note="Description of Artificial Sequence: Synthetic peptide"
NPFSFFCWH

SEQ ID NO: 26867 - protein, 9 aa, Artificial Sequence
  source: /note="Description of Artificial Sequence: Synthetic peptide"
FPSLDHCPG

SEQ ID NO: 26868 - protein, 9 aa, Artificial Sequence
  source: /note="Description of Artificial Sequence: Synthetic peptide"
CPGHRFQCW

SEQ ID NO: 26869 - protein, 10 aa, Artificial Sequence
  source: /note="Description of Artificial Sequence: Synthetic peptide"
SFFCWHFPSL

SEQ ID NO: 26870 - protein, 10 aa, Artificial Sequence
  source: /note="Description of Artificial Sequence: Synthetic peptide"
FQCWNFACHL

SEQ ID NO: 26871 - protein, 10 aa, Artificial Sequence
  source: /note="Description of Artificial Sequence: Synthetic peptide"
CWNFACHLSL

SEQ ID NO: 26872 - protein, 10 aa, Artificial Sequence
  source: /note="Description of Artificial Sequence: Synthetic peptide"
FACHLSLPGR

SEQ ID NO: 26873 - protein, 10 aa, Artificial Sequence
  source: /note="Description of Artificial Sequence: Synthetic peptide"
FSFFCWHFPS

SEQ ID NO: 26874 - protein, 10 aa, Artificial Sequence
  source: /note="Description of Artificial Sequence: Synthetic peptide"
RKNPFSFFCW

SEQ ID NO: 26875 - protein, 10 aa, Artificial Sequence
  source: /note="Description of Artificial Sequence: Synthetic peptide"
NPFSFFCWHF

SEQ ID NO: 26876 - protein, 10 aa, Artificial Sequence
  source: /note="Description of Artificial Sequence: Synthetic peptide"
SLDHCPGHRF

SEQ ID NO: 26877 - protein, 10 aa, Artificial Sequence
  source: /note="Description of Artificial Sequence: Synthetic peptide"
FPSLDHCPGH

SEQ ID NO: 26878 - protein, 9 aa, Artificial Sequence
  source: /note="Description of Artificial Sequence: Synthetic peptide"
LEEAPEREA

SEQ ID NO: 26879 - protein, 10 aa, Artificial Sequence
  source: /note="Description of Artificial Sequence: Synthetic peptide"
RGLERGNQHR

SEQ ID NO: 26880 - protein, 9 aa, Artificial Sequence
  source: /note="Description of Artificial Sequence: Synthetic peptide"
ALAGLIGGL

SEQ ID NO: 26881 - protein, 9 aa, Artificial Sequence
  source: /note="Description of Artificial Sequence: Synthetic peptide"
GLIGGLFFA

SEQ ID NO: 26882 - protein, 9 aa, Artificial Sequence
  source: /note="Description of Artificial Sequence: Synthetic peptide"
LIGGLFFAV

SEQ ID NO: 26883 - protein, 9 aa, Artificial Sequence
  source: /note="Description of Artificial Sequence: Synthetic peptide"
TAYWALAGL

SEQ ID NO: 26884 - protein, 9 aa, Artificial Sequence
  source: /note="Description of Artificial Sequence: Synthetic peptide"
AYWALAGLI

SEQ ID NO: 26885 - protein, 9 aa, Artificial Sequence
  source: /note="Description of Artificial Sequence: Synthetic peptide"
LAGLIGGLF

SEQ ID NO: 26886 - protein, 9 aa, Artificial Sequence
  source: /note="Description of Artificial Sequence: Synthetic peptide"
AGLIGGLFF

SEQ ID NO: 26887 - protein, 10 aa, Artificial Sequence
  source: /note="Description of Artificial Sequence: Synthetic peptide"
GLIGGLFFAV

SEQ ID NO: 26888 - protein, 10 aa, Artificial Sequence
  source: /note="Description of Artificial Sequence: Synthetic peptide"
GTAYWALAGL

SEQ ID NO: 26889 - protein, 10 aa, Artificial Sequence
  source: /note="Description of Artificial Sequence: Synthetic peptide"
ALAGLIGGLF

SEQ ID NO: 26890 - protein, 10 aa, Artificial Sequence
  source: /note="Description of Artificial Sequence: Synthetic peptide"
TAYWALAGLI

SEQ ID NO: 26891 - protein, 10 aa, Artificial Sequence
  source: /note="Description of Artificial Sequence: Synthetic peptide"
LAGLIGGLFF

SEQ ID NO: 26892 - protein, 9 aa, Artificial Sequence
  source: /note="Description of Artificial Sequence: Synthetic peptide"
YMNRQASQM

SEQ ID NO: 26893 - protein, 9 aa, Artificial Sequence
  source: /note="Description of Artificial Sequence: Synthetic peptide"
ALKYMNRQA

SEQ ID NO: 26894 - protein, 9 aa, Artificial Sequence
  source: /note="Description of Artificial Sequence: Synthetic peptide"
KYMNRQASQ

SEQ ID NO: 26895 - protein, 9 aa, Artificial Sequence
  source: /note="Description of Artificial Sequence: Synthetic peptide"
RQASQMLLM

SEQ ID NO: 26896 - protein, 9 aa, Artificial Sequence
  source: /note="Description of Artificial Sequence: Synthetic peptide"
MNRQASQML

SEQ ID NO: 26897 - protein, 9 aa, Artificial Sequence
  source: /note="Description of Artificial Sequence: Synthetic peptide"
QASQMLLMF

SEQ ID NO: 26898 - protein, 9 aa, Artificial Sequence
  source: /note="Description of Artificial Sequence: Synthetic peptide"
LKYMNRQAS

SEQ ID NO: 26899 - protein, 10 aa, Artificial Sequence
  source: /note="Description of Artificial Sequence: Synthetic peptide"
YMNRQASQML

SEQ ID NO: 26900 - protein, 10 aa, Artificial Sequence
  source: /note="Description of Artificial Sequence: Synthetic peptide"
KYMNRQASQM

SEQ ID NO: 26901 - protein, 10 aa, Artificial Sequence
  source: /note="Description of Artificial Sequence: Synthetic peptide"
RQASQMLLMF

SEQ ID NO: 26902 - protein, 10 aa, Artificial Sequence
  source: /note="Description of Artificial Sequence: Synthetic peptide"
MNRQASQMLL

SEQ ID NO: 26903 - protein, 10 aa, Artificial Sequence
  source: /note="Description of Artificial Sequence: Synthetic peptide"
LKYMNRQASQ

SEQ ID NO: 26904 - protein, 10 aa, Artificial Sequence
  source: /note="Description of Artificial Sequence: Synthetic peptide"
NRQASQMLLM

SEQ ID NO: 26905 - protein, 9 aa, Artificial Sequence
  source: /note="Description of Artificial Sequence: Synthetic peptide"
RKGVIILHV

SEQ ID NO: 26906 - protein, 10 aa, Artificial Sequence
  source: /note="Description of Artificial Sequence: Synthetic peptide"
VIILHVIGMI

SEQ ID NO: 26907 - protein, 10 aa, Artificial Sequence
  source: /note="Description of Artificial Sequence: Synthetic peptide"
SLEERRKGVI

SEQ ID NO: 26908 - protein, 10 aa, Artificial Sequence
  source: /note="Description of Artificial Sequence: Synthetic peptide"
RKGVIILHVI

SEQ ID NO: 26909 - protein, 10 aa, Artificial Sequence
  source: /note="Description of Artificial Sequence: Synthetic peptide"
EERRKGVIIL

SEQ ID NO: 26910 - protein, 9 aa, Artificial Sequence
  source: /note="Description of Artificial Sequence: Synthetic peptide"
SLPQSLPRA

SEQ ID NO: 26911 - protein, 9 aa, Artificial Sequence
  source: /note="Description of Artificial Sequence: Synthetic peptide"
TSLPQSLPR

SEQ ID NO: 26912 - protein, 9 aa, Artificial Sequence
  source: /note="Description of Artificial Sequence: Synthetic peptide"
LPQSLPRAT

SEQ ID NO: 26913 - protein, 10 aa, Artificial Sequence
  source: /note="Description of Artificial Sequence: Synthetic peptide"
GTSLPQSLPR

SEQ ID NO: 26914 - protein, 9 aa, Artificial Sequence
  source: /note="Description of Artificial Sequence: Synthetic peptide"
AMTVFFPWI

SEQ ID NO: 26915 - protein, 9 aa, Artificial Sequence
  source: /note="Description of Artificial Sequence: Synthetic peptide"
IQLDFDFRL

SEQ ID NO: 26916 - protein, 9 aa, Artificial Sequence
  source: /note="Description of Artificial Sequence: Synthetic peptide"
RLMRKENPK

SEQ ID NO: 26917 - protein, 9 aa, Artificial Sequence
  source: /note="Description of Artificial Sequence: Synthetic peptide"
KLHTWCSWR

SEQ ID NO: 26918 - protein, 9 aa, Artificial Sequence
  source: /note="Description of Artificial Sequence: Synthetic peptide"
CSWRSLKKK

SEQ ID NO: 26919 - protein, 9 aa, Artificial Sequence
  source: /note="Description of Artificial Sequence: Synthetic peptide"
TWCSWRSLK

SEQ ID NO: 26920 - protein, 9 aa, Artificial Sequence
  source: /note="Description of Artificial Sequence: Synthetic peptide"
TAMTVFFPW

SEQ ID NO: 26921 - protein, 9 aa, Artificial Sequence
  source: /note="Description of Artificial Sequence: Synthetic peptide"
FFPWIQLDF

SEQ ID NO: 26922 - protein, 9 aa, Artificial Sequence
  source: /note="Description of Artificial Sequence: Synthetic peptide"
PWIQLDFDF

SEQ ID NO: 26923 - protein, 9 aa, Artificial Sequence
  source: /note="Description of Artificial Sequence: Synthetic peptide"
SWHHIEGGF

SEQ ID NO: 26924 - protein, 9 aa, Artificial Sequence
  source: /note="Description of Artificial Sequence: Synthetic peptide"
LMRKENPKL

SEQ ID NO: 26925 - protein, 9 aa, Artificial Sequence
  source: /note="Description of Artificial Sequence: Synthetic peptide"
HTWCSWRSL

SEQ ID NO: 26926 - protein, 9 aa, Artificial Sequence
  source: /note="Description of Artificial Sequence: Synthetic peptide"
WIQLDFDFR

SEQ ID NO: 26927 - protein, 9 aa, Artificial Sequence
  source: /note="Description of Artificial Sequence: Synthetic peptide"
DFDFRLMRK

SEQ ID NO: 26928 - protein, 9 aa, Artificial Sequence
  source: /note="Description of Artificial Sequence: Synthetic peptide"
TVFFPWIQL

SEQ ID NO: 26929 - protein, 9 aa, Artificial Sequence
  source: /note="Description of Artificial Sequence: Synthetic peptide"
KENPKLHTW

SEQ ID NO: 26930 - protein, 9 aa, Artificial Sequence
  source: /note="Description of Artificial Sequence: Synthetic peptide"
RSLKKKDSW

SEQ ID NO: 26931 - protein, 9 aa, Artificial Sequence
  source: /note="Description of Artificial Sequence: Synthetic peptide"
KKKDSWHHI

SEQ ID NO: 26932 - protein, 10 aa, Artificial Sequence
  source: /note="Description of Artificial Sequence: Synthetic peptide"
RLMRKENPKL

SEQ ID NO: 26933 - protein, 10 aa, Artificial Sequence
  source: /note="Description of Artificial Sequence: Synthetic peptide"
HTWCSWRSLK

SEQ ID NO: 26934 - protein, 10 aa, Artificial Sequence
  source: /note="Description of Artificial Sequence: Synthetic peptide"
TWCSWRSLKK

SEQ ID NO: 26935 - protein, 10 aa, Artificial Sequence
  source: /note="Description of Artificial Sequence: Synthetic peptide"
VTAMTVFFPW

SEQ ID NO: 26936 - protein, 10 aa, Artificial Sequence
  source: /note="Description of Artificial Sequence: Synthetic peptide"
TAMTVFFPWI

SEQ ID NO: 26937 - protein, 10 aa, Artificial Sequence
  source: /note="Description of Artificial Sequence: Synthetic peptide"
VFFPWIQLDF

SEQ ID NO: 26938 - protein, 10 aa, Artificial Sequence
  source: /note="Description of Artificial Sequence: Synthetic peptide"
LMRKENPKLH

SEQ ID NO: 26939 - protein, 10 aa, Artificial Sequence
  source: /note="Description of Artificial Sequence: Synthetic peptide"
MTVFFPWIQL

SEQ ID NO: 26940 - protein, 10 aa, Artificial Sequence
  source: /note="Description of Artificial Sequence: Synthetic peptide"
IQLDFDFRLM

SEQ ID NO: 26941 - protein, 10 aa, Artificial Sequence
  source: /note="Description of Artificial Sequence: Synthetic peptide"
RKENPKLHTW

SEQ ID NO: 26942 - protein, 10 aa, Artificial Sequence
  source: /note="Description of Artificial Sequence: Synthetic peptide"
LHTWCSWRSL

SEQ ID NO: 26943 - protein, 10 aa, Artificial Sequence
  source: /note="Description of Artificial Sequence: Synthetic peptide"
LKKKDSWHHI

SEQ ID NO: 26944 - protein, 10 aa, Artificial Sequence
  source: /note="Description of Artificial Sequence: Synthetic peptide"
FPWIQLDFDF

SEQ ID NO: 26945 - protein, 10 aa, Artificial Sequence
  source: /note="Description of Artificial Sequence: Synthetic peptide"
NPKLHTWCSW

SEQ ID NO: 26946 - protein, 9 aa, Artificial Sequence
  source: /note="Description of Artificial Sequence: Synthetic peptide"
GLYEGVTPN

SEQ ID NO: 26947 - protein, 9 aa, Artificial Sequence
  source: /note="Description of Artificial Sequence: Synthetic peptide"
GLRGLYEGV

SEQ ID NO: 26948 - protein, 9 aa, Artificial Sequence
  source: /note="Description of Artificial Sequence: Synthetic peptide"
LYEGVTPNI

SEQ ID NO: 26949 - protein, 9 aa, Artificial Sequence
  source: /note="Description of Artificial Sequence: Synthetic peptide"
YEGVTPNIW

SEQ ID NO: 26950 - protein, 10 aa, Artificial Sequence
  source: /note="Description of Artificial Sequence: Synthetic peptide"
GLYEGVTPNI

SEQ ID NO: 26951 - protein, 10 aa, Artificial Sequence
  source: /note="Description of Artificial Sequence: Synthetic peptide"
LYEGVTPNIW

SEQ ID NO: 26952 - protein, 9 aa, Artificial Sequence
  source: /note="Description of Artificial Sequence: Synthetic peptide"
IQNEGIKSL

SEQ ID NO: 26953 - protein, 9 aa, Artificial Sequence
  source: /note="Description of Artificial Sequence: Synthetic peptide"
KIIQNEGIK

SEQ ID NO: 26954 - protein, 9 aa, Artificial Sequence
  source: /note="Description of Artificial Sequence: Synthetic peptide"
FKIIQNEGI

SEQ ID NO: 26955 - protein, 10 aa, Artificial Sequence
  source: /note="Description of Artificial Sequence: Synthetic peptide"
IQNEGIKSLW

SEQ ID NO: 26956 - protein, 9 aa, Artificial Sequence
  source: /note="Description of Artificial Sequence: Synthetic peptide"
FLACCTGGF

SEQ ID NO: 26957 - protein, 9 aa, Artificial Sequence
  source: /note="Description of Artificial Sequence: Synthetic peptide"
YMHIFLACC

SEQ ID NO: 26958 - protein, 9 aa, Artificial Sequence
  source: /note="Description of Artificial Sequence: Synthetic peptide"
SYMHIFLAC

SEQ ID NO: 26959 - protein, 10 aa, Artificial Sequence
  source: /note="Description of Artificial Sequence: Synthetic peptide"
YMHIFLACCT

SEQ ID NO: 26960 - protein, 10 aa, Artificial Sequence
  source: /note="Description of Artificial Sequence: Synthetic peptide"
FLACCTGGFL

SEQ ID NO: 26961 - protein, 10 aa, Artificial Sequence
  source: /note="Description of Artificial Sequence: Synthetic peptide"
SYMHIFLACC

SEQ ID NO: 26962 - protein, 10 aa, Artificial Sequence
  source: /note="Description of Artificial Sequence: Synthetic peptide"
IFLACCTGGF

SEQ ID NO: 26963 - protein, 10 aa, Artificial Sequence
  source: /note="Description of Artificial Sequence: Synthetic peptide"
CCTGGFLQAY

SEQ ID NO: 26964 - protein, 9 aa, Artificial Sequence
  source: /note="Description of Artificial Sequence: Synthetic peptide"
GMSFPLTSI

SEQ ID NO: 26965 - protein, 9 aa, Artificial Sequence
  source: /note="Description of Artificial Sequence: Synthetic peptide"
TSIAVYNSV

SEQ ID NO: 26966 - protein, 9 aa, Artificial Sequence
  source: /note="Description of Artificial Sequence: Synthetic peptide"
MSFPLTSIA

SEQ ID NO: 26967 - protein, 9 aa, Artificial Sequence
  source: /note="Description of Artificial Sequence: Synthetic peptide"
FPLTSIAVY

SEQ ID NO: 26968 - protein, 10 aa, Artificial Sequence
  source: /note="Description of Artificial Sequence: Synthetic peptide"
MSFPLTSIAV

SEQ ID NO: 26969 - protein, 10 aa, Artificial Sequence
  source: /note="Description of Artificial Sequence: Synthetic peptide"
GMSFPLTSIA

SEQ ID NO: 26970 - protein, 10 aa, Artificial Sequence
  source: /note="Description of Artificial Sequence: Synthetic peptide"
LTSIAVYNSV

SEQ ID NO: 26971 - protein, 10 aa, Artificial Sequence
  source: /note="Description of Artificial Sequence: Synthetic peptide"
KGMSFPLTSI

SEQ ID NO: 26972 - protein, 10 aa, Artificial Sequence
  source: /note="Description of Artificial Sequence: Synthetic peptide"
SFPLTSIAVY

SEQ ID NO: 26973 - protein, 10 aa, Artificial Sequence
  source: /note="Description of Artificial Sequence: Synthetic peptide"
TSIAVYNSVV

SEQ ID NO: 26974 - protein, 9 aa, Artificial Sequence
  source: /note="Description of Artificial Sequence: Synthetic peptide"
SPPSTLSDL

SEQ ID NO: 26975 - protein, 10 aa, Artificial Sequence
  source: /note="Description of Artificial Sequence: Synthetic peptide"
EPEASPPSTL

SEQ ID NO: 26976 - protein, 9 aa, Artificial Sequence
  source: /note="Description of Artificial Sequence: Synthetic peptide"
NLANVFRYF

SEQ ID NO: 26977 - protein, 9 aa, Artificial Sequence
  source: /note="Description of Artificial Sequence: Synthetic peptide"
RGNLANVFR

SEQ ID NO: 26978 - protein, 9 aa, Artificial Sequence
  source: /note="Description of Artificial Sequence: Synthetic peptide"
VFRYFPTQA

SEQ ID NO: 26979 - protein, 9 aa, Artificial Sequence
  source: /note="Description of Artificial Sequence: Synthetic peptide"
GNLANVFRY

SEQ ID NO: 26980 - protein, 9 aa, Artificial Sequence
  source: /note="Description of Artificial Sequence: Synthetic peptide"
WRGNLANVF

SEQ ID NO: 26981 - protein, 9 aa, Artificial Sequence
  source: /note="Description of Artificial Sequence: Synthetic peptide"
FRYFPTQAL

SEQ ID NO: 26982 - protein, 10 aa, Artificial Sequence
  source: /note="Description of Artificial Sequence: Synthetic peptide"
NVFRYFPTQA

SEQ ID NO: 26983 - protein, 10 aa, Artificial Sequence
  source: /note="Description of Artificial Sequence: Synthetic peptide"
FWRGNLANVF

SEQ ID NO: 26984 - protein, 10 aa, Artificial Sequence
  source: /note="Description of Artificial Sequence: Synthetic peptide"
VFRYFPTQAL

SEQ ID NO: 26985 - protein, 10 aa, Artificial Sequence
  source: /note="Description of Artificial Sequence: Synthetic peptide"
RGNLANVFRY

SEQ ID NO: 26986 - protein, 10 aa, Artificial Sequence
  source: /note="Description of Artificial Sequence: Synthetic peptide"
GNLANVFRYF

SEQ ID NO: 26987 - protein, 9 aa, Artificial Sequence
  source: /note="Description of Artificial Sequence: Synthetic peptide"
WLYFAGNLT

SEQ ID NO: 26988 - protein, 9 aa, Artificial Sequence
  source: /note="Description of Artificial Sequence: Synthetic peptide"
LTSGGAAGA

SEQ ID NO: 26989 - protein, 10 aa, Artificial Sequence
  source: /note="Description of Artificial Sequence: Synthetic peptide"
NLTSGGAAGA

SEQ ID NO: 26990 - protein, 10 aa, Artificial Sequence
  source: /note="Description of Artificial Sequence: Synthetic peptide"
WLYFAGNLTS

SEQ ID NO: 26991 - protein, 9 aa, Artificial Sequence
  source: /note="Description of Artificial Sequence: Synthetic peptide"
GISTGIVAI

SEQ ID NO: 26992 - protein, 9 aa, Artificial Sequence
  source: /note="Description of Artificial Sequence: Synthetic peptide"
GIVAILQGL

SEQ ID NO: 26993 - protein, 9 aa, Artificial Sequence
  source: /note="Description of Artificial Sequence: Synthetic peptide"
AILQGLAFA

SEQ ID NO: 26994 - protein, 9 aa, Artificial Sequence
  source: /note="Description of Artificial Sequence: Synthetic peptide"
ILQGLAFAL

SEQ ID NO: 26995 - protein, 9 aa, Artificial Sequence
  source: /note="Description of Artificial Sequence: Synthetic peptide"
VAILQGLAF

SEQ ID NO: 26996 - protein, 9 aa, Artificial Sequence
  source: /note="Description of Artificial Sequence: Synthetic peptide"
ISTGIVAIL

SEQ ID NO: 26997 - protein, 10 aa, Artificial Sequence
  source: /note="Description of Artificial Sequence: Synthetic peptide"
AILQGLAFAL

SEQ ID NO: 26998 - protein, 10 aa, Artificial Sequence
  source: /note="Description of Artificial Sequence: Synthetic peptide"
ILQGLAFALL

SEQ ID NO: 26999 - protein, 10 aa, Artificial Sequence
  source: /note="Description of Artificial Sequence: Synthetic peptide"
GISTGIVAIL

SEQ ID NO: 27000 - protein, 10 aa, Artificial Sequence
  source: /note="Description of Artificial Sequence: Synthetic peptide"
GIVAILQGLA

SEQ ID NO: 27001 - protein, 10 aa, Artificial Sequence
  source: /note="Description of Artificial Sequence: Synthetic peptide"
IVAILQGLAF

SEQ ID NO: 27002 - protein, 10 aa, Artificial Sequence
  source: /note="Description of Artificial Sequence: Synthetic peptide"
SGISTGIVAI

SEQ ID NO: 27003 - protein, 9 aa, Artificial Sequence
  source: /note="Description of Artificial Sequence: Synthetic peptide"
KPIFLNRYL

SEQ ID NO: 27004 - protein, 10 aa, Artificial Sequence
  source: /note="Description of Artificial Sequence: Synthetic peptide"
NLDSEKPIFL

SEQ ID NO: 27005 - protein, 10 aa, Artificial Sequence
  source: /note="Description of Artificial Sequence: Synthetic peptide"
SEKPIFLNRY

SEQ ID NO: 27006 - protein, 10 aa, Artificial Sequence
  source: /note="Description of Artificial Sequence: Synthetic peptide"
DSEKPIFLNR

SEQ ID NO: 27007 - protein, 10 aa, Artificial Sequence
  source: /note="Description of Artificial Sequence: Synthetic peptide"
KPIFLNRYLL

SEQ ID NO: 27008 - protein, 9 aa, Artificial Sequence
  source: /note="Description of Artificial Sequence: Synthetic peptide"
WQMRASTPA

SEQ ID NO: 27009 - protein, 9 aa, Artificial Sequence
  source: /note="Description of Artificial Sequence: Synthetic peptide"
ALVLRPPTL

SEQ ID NO: 27010 - protein, 9 aa, Artificial Sequence
  source: /note="Description of Artificial Sequence: Synthetic peptide"
CSSTPTCLR

SEQ ID NO: 27011 - protein, 9 aa, Artificial Sequence
  source: /note="Description of Artificial Sequence: Synthetic peptide"
LTHCTFWTR

SEQ ID NO: 27012 - protein, 9 aa, Artificial Sequence
  source: /note="Description of Artificial Sequence: Synthetic peptide"
GSRSLWPPQ

SEQ ID NO: 27013 - protein, 9 aa, Artificial Sequence
  source: /note="Description of Artificial Sequence: Synthetic peptide"
PQRPSNSRK

SEQ ID NO: 27014 - protein, 9 aa, Artificial Sequence
  source: /note="Description of Artificial Sequence: Synthetic peptide"
QMRASTPAP

SEQ ID NO: 27015 - protein, 9 aa, Artificial Sequence
  source: /note="Description of Artificial Sequence: Synthetic peptide"
RASTPAPCL

SEQ ID NO: 27016 - protein, 9 aa, Artificial Sequence
  source: /note="Description of Artificial Sequence: Synthetic peptide"
NSRKFGWQM

SEQ ID NO: 27017 - protein, 9 aa, Artificial Sequence
  source: /note="Description of Artificial Sequence: Synthetic peptide"
LVLRPPTLW

SEQ ID NO: 27018 - protein, 9 aa, Artificial Sequence
  source: /note="Description of Artificial Sequence: Synthetic peptide"
RKFGWQMRA

SEQ ID NO: 27019 - protein, 9 aa, Artificial Sequence
  source: /note="Description of Artificial Sequence: Synthetic peptide"
APCLTHCTF

SEQ ID NO: 27020 - protein, 10 aa, Artificial Sequence
  source: /note="Description of Artificial Sequence: Synthetic peptide"
VLRPPTLWTL

SEQ ID NO: 27021 - protein, 10 aa, Artificial Sequence
  source: /note="Description of Artificial Sequence: Synthetic peptide"
TLCSSTPTCL

SEQ ID NO: 27022 - protein, 10 aa, Artificial Sequence
  source: /note="Description of Artificial Sequence: Synthetic peptide"
GSRSLWPPQR

SEQ ID NO: 27023 - protein, 10 aa, Artificial Sequence
  source: /note="Description of Artificial Sequence: Synthetic peptide"
RSLWPPQRPS

SEQ ID NO: 27024 - protein, 10 aa, Artificial Sequence
  source: /note="Description of Artificial Sequence: Synthetic peptide"
NSRKFGWQMR

SEQ ID NO: 27025 - protein, 10 aa, Artificial Sequence
  source: /note="Description of Artificial Sequence: Synthetic peptide"
QMRASTPAPC

SEQ ID NO: 27026 - protein, 10 aa, Artificial Sequence
  source: /note="Description of Artificial Sequence: Synthetic peptide"
LTHCTFWTRL

SEQ ID NO: 27027 - protein, 10 aa, Artificial Sequence
  source: /note="Description of Artificial Sequence: Synthetic peptide"
CLTHCTFWTR

SEQ ID NO: 27028 - protein, 10 aa, Artificial Sequence
  source: /note="Description of Artificial Sequence: Synthetic peptide"
TPTCLRTCHL

SEQ ID NO: 27029 - protein, 10 aa, Artificial Sequence
  source: /note="Description of Artificial Sequence: Synthetic peptide"
GPDSSGSRSL

SEQ ID NO: 27030 - protein, 10 aa, Artificial Sequence
  source: /note="Description of Artificial Sequence: Synthetic peptide"
AALVLRPPTL

SEQ ID NO: 27031 - protein, 10 aa, Artificial Sequence
  source: /note="Description of Artificial Sequence: Synthetic peptide"
ALVLRPPTLW

SEQ ID NO: 27032 - protein, 10 aa, Artificial Sequence
  source: /note="Description of Artificial Sequence: Synthetic peptide"
PQRPSNSRKF

SEQ ID NO: 27033 - protein, 10 aa, Artificial Sequence
  source: /note="Description of Artificial Sequence: Synthetic peptide"
SNSRKFGWQM

SEQ ID NO: 27034 - protein, 10 aa, Artificial Sequence
  source: /note="Description of Artificial Sequence: Synthetic peptide"
RKFGWQMRAS

SEQ ID NO: 27035 - protein, 10 aa, Artificial Sequence
  source: /note="Description of Artificial Sequence: Synthetic peptide"
WQMRASTPAP

SEQ ID NO: 27036 - protein, 10 aa, Artificial Sequence
  source: /note="Description of Artificial Sequence: Synthetic peptide"
MRASTPAPCL

SEQ ID NO: 27037 - protein, 10 aa, Artificial Sequence
  source: /note="Description of Artificial Sequence: Synthetic peptide"
RPSNSRKFGW

SEQ ID NO: 27038 - protein, 10 aa, Artificial Sequence
  source: /note="Description of Artificial Sequence: Synthetic peptide"
APCLTHCTFW

SEQ ID NO: 27039 - protein, 9 aa, Artificial Sequence
  source: /note="Description of Artificial Sequence: Synthetic peptide"
DLRALAWLR

SEQ ID NO: 27040 - protein, 9 aa, Artificial Sequence
  source: /note="Description of Artificial Sequence: Synthetic peptide"
EEDLRALAW

SEQ ID NO: 27041 - protein, 10 aa, Artificial Sequence
  source: /note="Description of Artificial Sequence: Synthetic peptide"
DEEDLRALAW

SEQ ID NO: 27042 - protein, 10 aa, Artificial Sequence
  source: /note="Description of Artificial Sequence: Synthetic peptide"
EEDLRALAWL

SEQ ID NO: 27043 - protein, 9 aa, Artificial Sequence
  source: /note="Description of Artificial Sequence: Synthetic peptide"
TYFERHTTF

SEQ ID NO: 27044 - protein, 9 aa, Artificial Sequence
  source: /note="Description of Artificial Sequence: Synthetic peptide"
ETYFERHTT

SEQ ID NO: 27045 - protein, 9 aa, Artificial Sequence
  source: /note="Description of Artificial Sequence: Synthetic peptide"
HTTFMDGKL

SEQ ID NO: 27046 - protein, 9 aa, Artificial Sequence
  source: /note="Description of Artificial Sequence: Synthetic peptide"
YFERHTTFM

SEQ ID NO: 27047 - protein, 9 aa, Artificial Sequence
  source: /note="Description of Artificial Sequence: Synthetic peptide"
TTFMDGKLM

SEQ ID NO: 27048 - protein, 10 aa, Artificial Sequence
  source: /note="Description of Artificial Sequence: Synthetic peptide"
TYFERHTTFM

SEQ ID NO: 27049 - protein, 10 aa, Artificial Sequence
  source: /note="Description of Artificial Sequence: Synthetic peptide"
ETYFERHTTF

SEQ ID NO: 27050 - protein, 9 aa, Artificial Sequence
  source: /note="Description of Artificial Sequence: Synthetic peptide"
RAEGQLSVL

SEQ ID NO: 27051 - protein, 9 aa, Artificial Sequence
  source: /note="Description of Artificial Sequence: Synthetic peptide"
AERAEGQLS

SEQ ID NO: 27052 - protein, 9 aa, Artificial Sequence
  source: /note="Description of Artificial Sequence: Synthetic peptide"
AEGQLSVLH

SEQ ID NO: 27053 - protein, 10 aa, Artificial Sequence
  source: /note="Description of Artificial Sequence: Synthetic peptide"
QLSVLHLCAL

SEQ ID NO: 27054 - protein, 10 aa, Artificial Sequence
  source: /note="Description of Artificial Sequence: Synthetic peptide"
AERAEGQLSV

SEQ ID NO: 27055 - protein, 10 aa, Artificial Sequence
  source: /note="Description of Artificial Sequence: Synthetic peptide"
AEGQLSVLHL

SEQ ID NO: 27056 - protein, 10 aa, Artificial Sequence
  source: /note="Description of Artificial Sequence: Synthetic peptide"
GQLSVLHLCA

SEQ ID NO: 27057 - protein, 9 aa, Artificial Sequence
  source: /note="Description of Artificial Sequence: Synthetic peptide"
LAREKKLHK

SEQ ID NO: 27058 - protein, 9 aa, Artificial Sequence
  source: /note="Description of Artificial Sequence: Synthetic peptide"
LHKEAEIEY

SEQ ID NO: 27059 - protein, 9 aa, Artificial Sequence
  source: /note="Description of Artificial Sequence: Synthetic peptide"
REKKLHKEA

SEQ ID NO: 27060 - protein, 10 aa, Artificial Sequence
  source: /note="Description of Artificial Sequence: Synthetic peptide"
ALAREKKLHK

SEQ ID NO: 27061 - protein, 10 aa, Artificial Sequence
  source: /note="Description of Artificial Sequence: Synthetic peptide"
KLHKEAEIEY

SEQ ID NO: 27062 - protein, 9 aa, Artificial Sequence
  source: /note="Description of Artificial Sequence: Synthetic peptide"
VFFDIAIFV

SEQ ID NO: 27063 - protein, 9 aa, Artificial Sequence
  source: /note="Description of Artificial Sequence: Synthetic peptide"
LWHQVFFDI

SEQ ID NO: 27064 - protein, 9 aa, Artificial Sequence
  source: /note="Description of Artificial Sequence: Synthetic peptide"
FFDIAIFVI

SEQ ID NO: 27065 - protein, 9 aa, Artificial Sequence
  source: /note="Description of Artificial Sequence: Synthetic peptide"
IAIFVIGGI

SEQ ID NO: 27066 - protein, 9 aa, Artificial Sequence
  source: /note="Description of Artificial Sequence: Synthetic peptide"
QVFFDIAIF

SEQ ID NO: 27067 - protein, 9 aa, Artificial Sequence
  source: /note="Description of Artificial Sequence: Synthetic peptide"
HQVFFDIAI

SEQ ID NO: 27068 - protein, 10 aa, Artificial Sequence
  source: /note="Description of Artificial Sequence: Synthetic peptide"
LLWHQVFFDI

SEQ ID NO: 27069 - protein, 10 aa, Artificial Sequence
  source: /note="Description of Artificial Sequence: Synthetic peptide"
QVFFDIAIFV

SEQ ID NO: 27070 - protein, 10 aa, Artificial Sequence
  source: /note="Description of Artificial Sequence: Synthetic peptide"
VFFDIAIFVI

SEQ ID NO: 27071 - protein, 10 aa, Artificial Sequence
  source: /note="Description of Artificial Sequence: Synthetic peptide"
DIAIFVIGGI

SEQ ID NO: 27072 - protein, 10 aa, Artificial Sequence
  source: /note="Description of Artificial Sequence: Synthetic peptide"
HQVFFDIAIF

SEQ ID NO: 27073 - protein, 10 aa, Artificial Sequence
  source: /note="Description of Artificial Sequence: Synthetic peptide"
WHQVFFDIAI

SEQ ID NO: 27074 - protein, 9 aa, Artificial Sequence
  source: /note="Description of Artificial Sequence: Synthetic peptide"
KLQDEGSSL

SEQ ID NO: 27075 - protein, 9 aa, Artificial Sequence
  source: /note="Description of Artificial Sequence: Synthetic peptide"
LQDEGSSLW

SEQ ID NO: 27076 - protein, 10 aa, Artificial Sequence
  source: /note="Description of Artificial Sequence: Synthetic peptide"
KKLQDEGSSL

SEQ ID NO: 27077 - protein, 10 aa, Artificial Sequence
  source: /note="Description of Artificial Sequence: Synthetic peptide"
KLQDEGSSLW

SEQ ID NO: 27078 - protein, 9 aa, Artificial Sequence
  source: /note="Description of Artificial Sequence: Synthetic peptide"
PSEGGACTY

SEQ ID NO: 27079 - protein, 9 aa, Artificial Sequence
  source: /note="Description of Artificial Sequence: Synthetic peptide"
CTYLCAYTY

SEQ ID NO: 27080 - protein, 9 aa, Artificial Sequence
  source: /note="Description of Artificial Sequence: Synthetic peptide"
YLCAYTYFI

SEQ ID NO: 27081 - protein, 9 aa, Artificial Sequence
  source: /note="Description of Artificial Sequence: Synthetic peptide"
TYLCAYTYF

SEQ ID NO: 27082 - protein, 9 aa, Artificial Sequence
  source: /note="Description of Artificial Sequence: Synthetic peptide"
GACTYLCAY

SEQ ID NO: 27083 - protein, 9 aa, Artificial Sequence
  source: /note="Description of Artificial Sequence: Synthetic peptide"
SEGGACTYL

SEQ ID NO: 27084 - protein, 10 aa, Artificial Sequence
  source: /note="Description of Artificial Sequence: Synthetic peptide"
YLCAYTYFIC

SEQ ID NO: 27085 - protein, 10 aa, Artificial Sequence
  source: /note="Description of Artificial Sequence: Synthetic peptide"
CTYLCAYTYF

SEQ ID NO: 27086 - protein, 10 aa, Artificial Sequence
  source: /note="Description of Artificial Sequence: Synthetic peptide"
TYLCAYTYFI

SEQ ID NO: 27087 - protein, 10 aa, Artificial Sequence
  source: /note="Description of Artificial Sequence: Synthetic peptide"
GGACTYLCAY

SEQ ID NO: 27088 - protein, 10 aa, Artificial Sequence
  source: /note="Description of Artificial Sequence: Synthetic peptide"
ACTYLCAYTY

SEQ ID NO: 27089 - protein, 10 aa, Artificial Sequence
  source: /note="Description of Artificial Sequence: Synthetic peptide"
SPSEGGACTY

SEQ ID NO: 27090 - protein, 9 aa, Artificial Sequence
  source: /note="Description of Artificial Sequence: Synthetic peptide"
FMGVRIVAT

SEQ ID NO: 27091 - protein, 9 aa, Artificial Sequence
  source: /note="Description of Artificial Sequence: Synthetic peptide"
RIVATILAI

SEQ ID NO: 27092 - protein, 9 aa, Artificial Sequence
  source: /note="Description of Artificial Sequence: Synthetic peptide"
IVATILAIA

SEQ ID NO: 27093 - protein, 9 aa, Artificial Sequence
  source: /note="Description of Artificial Sequence: Synthetic peptide"
ATILAIAGI

SEQ ID NO: 27094 - protein, 9 aa, Artificial Sequence
  source: /note="Description of Artificial Sequence: Synthetic peptide"
GVRIVATIL

SEQ ID NO: 27095 - protein, 9 aa, Artificial Sequence
  source: /note="Description of Artificial Sequence: Synthetic peptide"
TILAIAGIV

SEQ ID NO: 27096 - protein, 9 aa, Artificial Sequence
  source: /note="Description of Artificial Sequence: Synthetic peptide"
MGVRIVATI

SEQ ID NO: 27097 - protein, 10 aa, Artificial Sequence
  source: /note="Description of Artificial Sequence: Synthetic peptide"
FMGVRIVATI

SEQ ID NO: 27098 - protein, 10 aa, Artificial Sequence
  source: /note="Description of Artificial Sequence: Synthetic peptide"
RIVATILAIA

SEQ ID NO: 27099 - protein, 10 aa, Artificial Sequence
  source: /note="Description of Artificial Sequence: Synthetic peptide"
ATILAIAGIV

SEQ ID NO: 27100 - protein, 10 aa, Artificial Sequence
  source: /note="Description of Artificial Sequence: Synthetic peptide"
RFMGVRIVAT

SEQ ID NO: 27101 - protein, 10 aa, Artificial Sequence
  source: /note="Description of Artificial Sequence: Synthetic peptide"
GVRIVATILA

SEQ ID NO: 27102 - protein, 10 aa, Artificial Sequence
  source: /note="Description of Artificial Sequence: Synthetic peptide"
MGVRIVATIL

SEQ ID NO: 27103 - protein, 10 aa, Artificial Sequence
  source: /note="Description of Artificial Sequence: Synthetic peptide"
VRIVATILAI

SEQ ID NO: 27104 - protein, 10 aa, Artificial Sequence
  source: /note="Description of Artificial Sequence: Synthetic peptide"
TILAIAGIVM

SEQ ID NO: 27105 - protein, 9 aa, Artificial Sequence
  source: /note="Description of Artificial Sequence: Synthetic peptide"
LSLEPWIPY

SEQ ID NO: 27106 - protein, 9 aa, Artificial Sequence
  source: /note="Description of Artificial Sequence: Synthetic peptide"
SLEPWIPYL

SEQ ID NO: 27107 - protein, 9 aa, Artificial Sequence
  source: /note="Description of Artificial Sequence: Synthetic peptide"
SEMKKKGEL

SEQ ID NO: 27108 - protein, 9 aa, Artificial Sequence
  source: /note="Description of Artificial Sequence: Synthetic peptide"
MKKKGELSL

SEQ ID NO: 27109 - protein, 9 aa, Artificial Sequence
  source: /note="Description of Artificial Sequence: Synthetic peptide"
GELSLEPWI

SEQ ID NO: 27110 - protein, 9 aa, Artificial Sequence
  source: /note="Description of Artificial Sequence: Synthetic peptide"
IPYLHQQKT

SEQ ID NO: 27111 - protein, 10 aa, Artificial Sequence
  source: /note="Description of Artificial Sequence: Synthetic peptide"
LSLEPWIPYL

SEQ ID NO: 27112 - protein, 10 aa, Artificial Sequence
  source: /note="Description of Artificial Sequence: Synthetic peptide"
EMKKKGELSL

SEQ ID NO: 27113 - protein, 10 aa, Artificial Sequence
  source: /note="Description of Artificial Sequence: Synthetic peptide"
ELSLEPWIPY

SEQ ID NO: 27114 - protein, 10 aa, Artificial Sequence
  source: /note="Description of Artificial Sequence: Synthetic peptide"
KKGELSLEPW

SEQ ID NO: 27115 - protein, 9 aa, Artificial Sequence
  source: /note="Description of Artificial Sequence: Synthetic peptide"
ATGDQIPFK

SEQ ID NO: 27116 - protein, 9 aa, Artificial Sequence
  source: /note="Description of Artificial Sequence: Synthetic peptide"
SATGDQIPF

SEQ ID NO: 27117 - protein, 10 aa, Artificial Sequence
  source: /note="Description of Artificial Sequence: Synthetic peptide"
SATGDQIPFK

SEQ ID NO: 27118 - protein, 10 aa, Artificial Sequence
  source: /note="Description of Artificial Sequence: Synthetic peptide"
GSATGDQIPF

SEQ ID NO: 27119 - protein, 10 aa, Artificial Sequence
  source: /note="Description of Artificial Sequence: Synthetic peptide"
CPGSATGDQI

SEQ ID NO: 27120 - protein, 9 aa, Artificial Sequence
  source: /note="Description of Artificial Sequence: Synthetic peptide"
ALANTRILL

SEQ ID NO: 27121 - protein, 9 aa, Artificial Sequence
  source: /note="Description of Artificial Sequence: Synthetic peptide"
RILLFLVLL

SEQ ID NO: 27122 - protein, 9 aa, Artificial Sequence
  source: /note="Description of Artificial Sequence: Synthetic peptide"
LAFALANTR

SEQ ID NO: 27123 - protein, 9 aa, Artificial Sequence
  source: /note="Description of Artificial Sequence: Synthetic peptide"
NTRILLFLV

SEQ ID NO: 27124 - protein, 9 aa, Artificial Sequence
  source: /note="Description of Artificial Sequence: Synthetic peptide"
LANTRILLF

SEQ ID NO: 27125 - protein, 9 aa, Artificial Sequence
  source: /note="Description of Artificial Sequence: Synthetic peptide"
FALANTRIL

SEQ ID NO: 27126 - protein, 9 aa, Artificial Sequence
  source: /note="Description of Artificial Sequence: Synthetic peptide"
TRILLFLVL

SEQ ID NO: 27127 - protein, 10 aa, Artificial Sequence
  source: /note="Description of Artificial Sequence: Synthetic peptide"
ALANTRILLF

SEQ ID NO: 27128 - protein, 10 aa, Artificial Sequence
  source: /note="Description of Artificial Sequence: Synthetic peptide"
NTRILLFLVL

SEQ ID NO: 27129 - protein, 10 aa, Artificial Sequence
  source: /note="Description of Artificial Sequence: Synthetic peptide"
GLAFALANTR

SEQ ID NO: 27130 - protein, 10 aa, Artificial Sequence
  source: /note="Description of Artificial Sequence: Synthetic peptide"
LAFALANTRI

SEQ ID NO: 27131 - protein, 10 aa, Artificial Sequence
  source: /note="Description of Artificial Sequence: Synthetic peptide"
FALANTRILL

SEQ ID NO: 27132 - protein, 9 aa, Artificial Sequence
  source: /note="Description of Artificial Sequence: Synthetic peptide"
APRDGVIGL

SEQ ID NO: 27133 - protein, 10 aa, Artificial Sequence
  source: /note="Description of Artificial Sequence: Synthetic peptide"
RDGVIGLNPL

SEQ ID NO: 27134 - protein, 9 aa, Artificial Sequence
  source: /note="Description of Artificial Sequence: Synthetic peptide"
SVQDWIFTV

SEQ ID NO: 27135 - protein, 9 aa, Artificial Sequence
  source: /note="Description of Artificial Sequence: Synthetic peptide"
DPSVQDWIF

SEQ ID NO: 27136 - protein, 10 aa, Artificial Sequence
  source: /note="Description of Artificial Sequence: Synthetic peptide"
GLSVSADPSV

SEQ ID NO: 27137 - protein, 9 aa, Artificial Sequence
  source: /note="Description of Artificial Sequence: Synthetic peptide"
TLQYHLQQL

SEQ ID NO: 27138 - protein, 9 aa, Artificial Sequence
  source: /note="Description of Artificial Sequence: Synthetic peptide"
AISTLQYHL

SEQ ID NO: 27139 - protein, 9 aa, Artificial Sequence
  source: /note="Description of Artificial Sequence: Synthetic peptide"
LQYHLQQLF

SEQ ID NO: 27140 - protein, 9 aa, Artificial Sequence
  source: /note="Description of Artificial Sequence: Synthetic peptide"
DLAISTLQY

SEQ ID NO: 27141 - protein, 10 aa, Artificial Sequence
  source: /note="Description of Artificial Sequence: Synthetic peptide"
LQYHLQQLFY

SEQ ID NO: 27142 - protein, 10 aa, Artificial Sequence
  source: /note="Description of Artificial Sequence: Synthetic peptide"
TLQYHLQQLF

SEQ ID NO: 27143 - protein, 10 aa, Artificial Sequence
  source: /note="Description of Artificial Sequence: Synthetic peptide"
INVDLAISTL

SEQ ID NO: 27144 - protein, 10 aa, Artificial Sequence
  source: /note="Description of Artificial Sequence: Synthetic peptide"
VDLAISTLQY

SEQ ID NO: 27145 - protein, 10 aa, Artificial Sequence
  source: /note="Description of Artificial Sequence: Synthetic peptide"
LAISTLQYHL

SEQ ID NO: 27146 - protein, 10 aa, Artificial Sequence
  source: /note="Description of Artificial Sequence: Synthetic peptide"
STLQYHLQQL

SEQ ID NO: 27147 - protein, 9 aa, Artificial Sequence
  source: /note="Description of Artificial Sequence: Synthetic peptide"
KQAMCLQLL

SEQ ID NO: 27148 - protein, 9 aa, Artificial Sequence
  source: /note="Description of Artificial Sequence: Synthetic peptide"
AMCLQLLTA

SEQ ID NO: 27149 - protein, 9 aa, Artificial Sequence
  source: /note="Description of Artificial Sequence: Synthetic peptide"
KKQAMCLQL

SEQ ID NO: 27150 - protein, 10 aa, Artificial Sequence
  source: /note="Description of Artificial Sequence: Synthetic peptide"
AMCLQLLTAV

SEQ ID NO: 27151 - protein, 10 aa, Artificial Sequence
  source: /note="Description of Artificial Sequence: Synthetic peptide"
SKKQAMCLQL

SEQ ID NO: 27152 - protein, 10 aa, Artificial Sequence
  source: /note="Description of Artificial Sequence: Synthetic peptide"
KKQAMCLQLL

SEQ ID NO: 27153 - protein, 10 aa, Artificial Sequence
  source: /note="Description of Artificial Sequence: Synthetic peptide"
KQAMCLQLLT

SEQ ID NO: 27154 - protein, 9 aa, Artificial Sequence
  source: /note="Description of Artificial Sequence: Synthetic peptide"
VLGLLGGSY

SEQ ID NO: 27155 - protein, 10 aa, Artificial Sequence
  source: /note="Description of Artificial Sequence: Synthetic peptide"
LLGGSYHDGA

SEQ ID NO: 27156 - protein, 10 aa, Artificial Sequence
  source: /note="Description of Artificial Sequence: Synthetic peptide"
EVLGLLGGSY

SEQ ID NO: 27157 - protein, 10 aa, Artificial Sequence
  source: /note="Description of Artificial Sequence: Synthetic peptide"
LEVLGLLGGS

SEQ ID NO: 27158 - protein, 9 aa, Artificial Sequence
  source: /note="Description of Artificial Sequence: Synthetic peptide"
ALSLLIFLA

SEQ ID NO: 27159 - protein, 9 aa, Artificial Sequence
  source: /note="Description of Artificial Sequence: Synthetic peptide"
LLIFLALSL

SEQ ID NO: 27160 - protein, 9 aa, Artificial Sequence
  source: /note="Description of Artificial Sequence: Synthetic peptide"
EALSLLIFL

SEQ ID NO: 27161 - protein, 9 aa, Artificial Sequence
  source: /note="Description of Artificial Sequence: Synthetic peptide"
RDVEALSLL

SEQ ID NO: 27162 - protein, 9 aa, Artificial Sequence
  source: /note="Description of Artificial Sequence: Synthetic peptide"
VEALSLLIF

SEQ ID NO: 27163 - protein, 9 aa, Artificial Sequence
  source: /note="Description of Artificial Sequence: Synthetic peptide"
LSLLIFLAL

SEQ ID NO: 27164 - protein, 10 aa, Artificial Sequence
  source: /note="Description of Artificial Sequence: Synthetic peptide"
ALSLLIFLAL

SEQ ID NO: 27165 - protein, 10 aa, Artificial Sequence
  source: /note="Description of Artificial Sequence: Synthetic peptide"
SLLIFLALSL

SEQ ID NO: 27166 - protein, 10 aa, Artificial Sequence
  source: /note="Description of Artificial Sequence: Synthetic peptide"
ASRDVEALSL

SEQ ID NO: 27167 - protein, 10 aa, Artificial Sequence
  source: /note="Description of Artificial Sequence: Synthetic peptide"
EALSLLIFLA

SEQ ID NO: 27168 - protein, 10 aa, Artificial Sequence
  source: /note="Description of Artificial Sequence: Synthetic peptide"
RDVEALSLLI

SEQ ID NO: 27169 - protein, 10 aa, Artificial Sequence
  source: /note="Description of Artificial Sequence: Synthetic peptide"
VEALSLLIFL

SEQ ID NO: 27170 - protein, 9 aa, Artificial Sequence
  source: /note="Description of Artificial Sequence: Synthetic peptide"
STWHVAHTF

SEQ ID NO: 27171 - protein, 9 aa, Artificial Sequence
  source: /note="Description of Artificial Sequence: Synthetic peptide"
TWHVAHTFL

SEQ ID NO: 27172 - protein, 9 aa, Artificial Sequence
  source: /note="Description of Artificial Sequence: Synthetic peptide"
HVAHTFLLM

SEQ ID NO: 27173 - protein, 9 aa, Artificial Sequence
  source: /note="Description of Artificial Sequence: Synthetic peptide"
WHVAHTFLL

SEQ ID NO: 27174 - protein, 10 aa, Artificial Sequence
  source: /note="Description of Artificial Sequence: Synthetic peptide"
STWHVAHTFL

SEQ ID NO: 27175 - protein, 10 aa, Artificial Sequence
  source: /note="Description of Artificial Sequence: Synthetic peptide"
VAHTFLLMPR

SEQ ID NO: 27176 - protein, 10 aa, Artificial Sequence
  source: /note="Description of Artificial Sequence: Synthetic peptide"
CSTWHVAHTF

SEQ ID NO: 27177 - protein, 10 aa, Artificial Sequence
  source: /note="Description of Artificial Sequence: Synthetic peptide"
TWHVAHTFLL

SEQ ID NO: 27178 - protein, 10 aa, Artificial Sequence
  source: /note="Description of Artificial Sequence: Synthetic peptide"
WHVAHTFLLM

SEQ ID NO: 27179 - protein, 9 aa, Artificial Sequence
  source: /note="Description of Artificial Sequence: Synthetic peptide"
FANRSCTDV

SEQ ID NO: 27180 - protein, 9 aa, Artificial Sequence
  source: /note="Description of Artificial Sequence: Synthetic peptide"
DFKGPFANR

SEQ ID NO: 27181 - protein, 10 aa, Artificial Sequence
  source: /note="Description of Artificial Sequence: Synthetic peptide"
TYDPDFKGPF

SEQ ID NO: 27182 - protein, 10 aa, Artificial Sequence
  source: /note="Description of Artificial Sequence: Synthetic peptide"
FANRSCTDVL

SEQ ID NO: 27183 - protein, 9 aa, Artificial Sequence
  source: /note="Description of Artificial Sequence: Synthetic peptide"
HQFCKTTAK

SEQ ID NO: 27184 - protein, 9 aa, Artificial Sequence
  source: /note="Description of Artificial Sequence: Synthetic peptide"
SYWEDYHQF

SEQ ID NO: 27185 - protein, 9 aa, Artificial Sequence
  source: /note="Description of Artificial Sequence: Synthetic peptide"
YHQFCKTTA

SEQ ID NO: 27186 - protein, 10 aa, Artificial Sequence
  source: /note="Description of Artificial Sequence: Synthetic peptide"
KSYWEDYHQF

SEQ ID NO: 27187 - protein, 10 aa, Artificial Sequence
  source: /note="Description of Artificial Sequence: Synthetic peptide"
SYWEDYHQFC

SEQ ID NO: 27188 - protein, 10 aa, Artificial Sequence
  source: /note="Description of Artificial Sequence: Synthetic peptide"
HQFCKTTAKP

SEQ ID NO: 27189 - protein, 10 aa, Artificial Sequence
  source: /note="Description of Artificial Sequence: Synthetic peptide"
WEDYHQFCKT

SEQ ID NO: 27190 - protein, 9 aa, Artificial Sequence
  source: /note="Description of Artificial Sequence: Synthetic peptide"
LLIGSLGGS

SEQ ID NO: 27191 - protein, 9 aa, Artificial Sequence
  source: /note="Description of Artificial Sequence: Synthetic peptide"
LIGSLGGSV

SEQ ID NO: 27192 - protein, 9 aa, Artificial Sequence
  source: /note="Description of Artificial Sequence: Synthetic peptide"
SLGGSVGCL

SEQ ID NO: 27193 - protein, 9 aa, Artificial Sequence
  source: /note="Description of Artificial Sequence: Synthetic peptide"
RSAPSPMSM

SEQ ID NO: 27194 - protein, 9 aa, Artificial Sequence
  source: /note="Description of Artificial Sequence: Synthetic peptide"
SAPSPMSMR

SEQ ID NO: 27195 - protein, 9 aa, Artificial Sequence
  source: /note="Description of Artificial Sequence: Synthetic peptide"
LPRSAPSPM

SEQ ID NO: 27196 - protein, 10 aa, Artificial Sequence
  source: /note="Description of Artificial Sequence: Synthetic peptide"
LLIGSLGGSV

SEQ ID NO: 27197 - protein, 10 aa, Artificial Sequence
  source: /note="Description of Artificial Sequence: Synthetic peptide"
RLPRSAPSPM

SEQ ID NO: 27198 - protein, 10 aa, Artificial Sequence
  source: /note="Description of Artificial Sequence: Synthetic peptide"
RSAPSPMSMR

SEQ ID NO: 27199 - protein, 10 aa, Artificial Sequence
  source: /note="Description of Artificial Sequence: Synthetic peptide"
GSRLPRSAPS

SEQ ID NO: 27200 - protein, 9 aa, Artificial Sequence
  source: /note="Description of Artificial Sequence: Synthetic peptide"
ILFIYLGCV

SEQ ID NO: 27201 - protein, 9 aa, Artificial Sequence
  source: /note="Description of Artificial Sequence: Synthetic peptide"
YLGCVTNAI

SEQ ID NO: 27202 - protein, 9 aa, Artificial Sequence
  source: /note="Description of Artificial Sequence: Synthetic peptide"
GCVTNAITF

SEQ ID NO: 27203 - protein, 10 aa, Artificial Sequence
  source: /note="Description of Artificial Sequence: Synthetic peptide"
AILFIYLGCV

SEQ ID NO: 27204 - protein, 10 aa, Artificial Sequence
  source: /note="Description of Artificial Sequence: Synthetic peptide"
FIYLGCVTNA

SEQ ID NO: 27205 - protein, 10 aa, Artificial Sequence
  source: /note="Description of Artificial Sequence: Synthetic peptide"
YLGCVTNAIT

SEQ ID NO: 27206 - protein, 10 aa, Artificial Sequence
  source: /note="Description of Artificial Sequence: Synthetic peptide"
ILFIYLGCVT

SEQ ID NO: 27207 - protein, 10 aa, Artificial Sequence
  source: /note="Description of Artificial Sequence: Synthetic peptide"
IYLGCVTNAI

SEQ ID NO: 27208 - protein, 10 aa, Artificial Sequence
  source: /note="Description of Artificial Sequence: Synthetic peptide"
LGCVTNAITF

SEQ ID NO: 27209 - protein, 9 aa, Artificial Sequence
  source: /note="Description of Artificial Sequence: Synthetic peptide"
KKRKNLIPI

SEQ ID NO: 27210 - protein, 9 aa, Artificial Sequence
  source: /note="Description of Artificial Sequence: Synthetic peptide"
KRKNLIPIV

SEQ ID NO: 27211 - protein, 10 aa, Artificial Sequence
  source: /note="Description of Artificial Sequence: Synthetic peptide"
KKRKNLIPIV

SEQ ID NO: 27212 - protein, 10 aa, Artificial Sequence
  source: /note="Description of Artificial Sequence: Synthetic peptide"
EKKRKNLIPI

SEQ ID NO: 27213 - protein, 10 aa, Artificial Sequence
  source: /note="Description of Artificial Sequence: Synthetic peptide"
HQNEKKRKNL

SEQ ID NO: 27214 - protein, 10 aa, Artificial Sequence
  source: /note="Description of Artificial Sequence: Synthetic peptide"
KNLIPIVRSF

SEQ ID NO: 27215 - protein, 9 aa, Artificial Sequence
  source: /note="Description of Artificial Sequence: Synthetic peptide"
VTTAGVVLV

SEQ ID NO: 27216 - protein, 9 aa, Artificial Sequence
  source: /note="Description of Artificial Sequence: Synthetic peptide"
LVTTAGVVL

SEQ ID NO: 27217 - protein, 10 aa, Artificial Sequence
  source: /note="Description of Artificial Sequence: Synthetic peptide"
LVTTAGVVLV

SEQ ID NO: 27218 - protein, 10 aa, Artificial Sequence
  source: /note="Description of Artificial Sequence: Synthetic peptide"
VTTAGVVLVV

SEQ ID NO: 27219 - protein, 10 aa, Artificial Sequence
  source: /note="Description of Artificial Sequence: Synthetic peptide"
CPPLVTTAGV

SEQ ID NO: 27220 - protein, 9 aa, Artificial Sequence
  source: /note="Description of Artificial Sequence: Synthetic peptide"
SLLHGGGPA

SEQ ID NO: 27221 - protein, 9 aa, Artificial Sequence
  source: /note="Description of Artificial Sequence: Synthetic peptide"
LSARRCCYV

SEQ ID NO: 27222 - protein, 9 aa, Artificial Sequence
  source: /note="Description of Artificial Sequence: Synthetic peptide"
HLSRVPQQK

SEQ ID NO: 27223 - protein, 9 aa, Artificial Sequence
  source: /note="Description of Artificial Sequence: Synthetic peptide"
CYVPPDQHL

SEQ ID NO: 27224 - protein, 9 aa, Artificial Sequence
  source: /note="Description of Artificial Sequence: Synthetic peptide"
GSRRGHPGG

SEQ ID NO: 27225 - protein, 9 aa, Artificial Sequence
  source: /note="Description of Artificial Sequence: Synthetic peptide"
RGHPGGLSA

SEQ ID NO: 27226 - protein, 9 aa, Artificial Sequence
  source: /note="Description of Artificial Sequence: Synthetic peptide"
GLSARRCCY

SEQ ID NO: 27227 - protein, 9 aa, Artificial Sequence
  source: /note="Description of Artificial Sequence: Synthetic peptide"
QQKGLCRPL

SEQ ID NO: 27228 - protein, 10 aa, Artificial Sequence
  source: /note="Description of Artificial Sequence: Synthetic peptide"
LLHGGGPAGI

SEQ ID NO: 27229 - protein, 10 aa, Artificial Sequence
  source: /note="Description of Artificial Sequence: Synthetic peptide"
GLSARRCCYV

SEQ ID NO: 27230 - protein, 10 aa, Artificial Sequence
  source: /note="Description of Artificial Sequence: Synthetic peptide"
GSRRGHPGGL

SEQ ID NO: 27231 - protein, 10 aa, Artificial Sequence
  source: /note="Description of Artificial Sequence: Synthetic peptide"
RGHPGGLSAR

SEQ ID NO: 27232 - protein, 10 aa, Artificial Sequence
  source: /note="Description of Artificial Sequence: Synthetic peptide"
SARRCCYVPP

SEQ ID NO: 27233 - protein, 10 aa, Artificial Sequence
  source: /note="Description of Artificial Sequence: Synthetic peptide"
VPPDQHLSRV

SEQ ID NO: 27234 - protein, 9 aa, Artificial Sequence
  source: /note="Description of Artificial Sequence: Synthetic peptide"
WTVGGFFLA

SEQ ID NO: 27235 - protein, 9 aa, Artificial Sequence
  source: /note="Description of Artificial Sequence: Synthetic peptide"
WAMFSTNRW

SEQ ID NO: 27236 - protein, 9 aa, Artificial Sequence
  source: /note="Description of Artificial Sequence: Synthetic peptide"
MFSTNRWTV

SEQ ID NO: 27237 - protein, 9 aa, Artificial Sequence
  source: /note="Description of Artificial Sequence: Synthetic peptide"
RWTVGGFFL

SEQ ID NO: 27238 - protein, 9 aa, Artificial Sequence
  source: /note="Description of Artificial Sequence: Synthetic peptide"
AMFSTNRWT

SEQ ID NO: 27239 - protein, 9 aa, Artificial Sequence
  source: /note="Description of Artificial Sequence: Synthetic peptide"
TNRWTVGGF

SEQ ID NO: 27240 - protein, 9 aa, Artificial Sequence
  source: /note="Description of Artificial Sequence: Synthetic peptide"
NRWTVGGFF

SEQ ID NO: 27241 - protein, 10 aa, Artificial Sequence
  source: /note="Description of Artificial Sequence: Synthetic peptide"
AMFSTNRWTV

SEQ ID NO: 27242 - protein, 10 aa, Artificial Sequence
  source: /note="Description of Artificial Sequence: Synthetic peptide"
LWAMFSTNRW

SEQ ID NO: 27243 - protein, 10 aa, Artificial Sequence
  source: /note="Description of Artificial Sequence: Synthetic peptide"
RWTVGGFFLA

SEQ ID NO: 27244 - protein, 10 aa, Artificial Sequence
  source: /note="Description of Artificial Sequence: Synthetic peptide"
STNRWTVGGF

SEQ ID NO: 27245 - protein, 10 aa, Artificial Sequence
  source: /note="Description of Artificial Sequence: Synthetic peptide"
TNRWTVGGFF

SEQ ID NO: 27246 - protein, 9 aa, Artificial Sequence
  source: /note="Description of Artificial Sequence: Synthetic peptide"
YISFFCLGA

SEQ ID NO: 27247 - protein, 9 aa, Artificial Sequence
  source: /note="Description of Artificial Sequence: Synthetic peptide"
CLGAVSAAV

SEQ ID NO: 27248 - protein, 9 aa, Artificial Sequence
  source: /note="Description of Artificial Sequence: Synthetic peptide"
ISFFCLGAV

SEQ ID NO: 27249 - protein, 9 aa, Artificial Sequence
  source: /note="Description of Artificial Sequence: Synthetic peptide"
VYISFFCLG

SEQ ID NO: 27250 - protein, 10 aa, Artificial Sequence
  source: /note="Description of Artificial Sequence: Synthetic peptide"
YISFFCLGAV

SEQ ID NO: 27251 - protein, 10 aa, Artificial Sequence
  source: /note="Description of Artificial Sequence: Synthetic peptide"
FCLGAVSAAV

SEQ ID NO: 27252 - protein, 10 aa, Artificial Sequence
  source: /note="Description of Artificial Sequence: Synthetic peptide"
VYISFFCLGA

SEQ ID NO: 27253 - protein, 10 aa, Artificial Sequence
  source: /note="Description of Artificial Sequence: Synthetic peptide"
CLGAVSAAVM

SEQ ID NO: 27254 - protein, 10 aa, Artificial Sequence
  source: /note="Description of Artificial Sequence: Synthetic peptide"
CPVYISFFCL

SEQ ID NO: 27255 - protein, 9 aa, Artificial Sequence
  source: /note="Description of Artificial Sequence: Synthetic peptide"
AVAGYVSVL

SEQ ID NO: 27256 - protein, 9 aa, Artificial Sequence
  source: /note="Description of Artificial Sequence: Synthetic peptide"
YVSVLFLRI

SEQ ID NO: 27257 - protein, 9 aa, Artificial Sequence
  source: /note="Description of Artificial Sequence: Synthetic peptide"
VAGYVSVLF

SEQ ID NO: 27258 - protein, 9 aa, Artificial Sequence
  source: /note="Description of Artificial Sequence: Synthetic peptide"
GYVSVLFLR

SEQ ID NO: 27259 - protein, 9 aa, Artificial Sequence
  source: /note="Description of Artificial Sequence: Synthetic peptide"
AGYVSVLFL

SEQ ID NO: 27260 - protein, 10 aa, Artificial Sequence
  source: /note="Description of Artificial Sequence: Synthetic peptide"
AGYVSVLFLR

SEQ ID NO: 27261 - protein, 10 aa, Artificial Sequence
  source: /note="Description of Artificial Sequence: Synthetic peptide"
AVAGYVSVLF

SEQ ID NO: 27262 - protein, 10 aa, Artificial Sequence
  source: /note="Description of Artificial Sequence: Synthetic peptide"
GYVSVLFLRI

SEQ ID NO: 27263 - protein, 10 aa, Artificial Sequence
  source: /note="Description of Artificial Sequence: Synthetic peptide"
YGAVAGYVSV

SEQ ID NO: 27264 - protein, 10 aa, Artificial Sequence
  source: /note="Description of Artificial Sequence: Synthetic peptide"
GAVAGYVSVL

SEQ ID NO: 27265 - protein, 9 aa, Artificial Sequence
  source: /note="Description of Artificial Sequence: Synthetic peptide"
YYKPLVYNN

SEQ ID NO: 27266 - protein, 10 aa, Artificial Sequence
  source: /note="Description of Artificial Sequence: Synthetic peptide"
YYKPLVYNNT

SEQ ID NO: 27267 - protein, 10 aa, Artificial Sequence
  source: /note="Description of Artificial Sequence: Synthetic peptide"
KPLVYNNTNV

SEQ ID NO: 27268 - protein, 9 aa, Artificial Sequence
  source: /note="Description of Artificial Sequence: Synthetic peptide"
RLSDPQVLV

SEQ ID NO: 27269 - protein, 9 aa, Artificial Sequence
  source: /note="Description of Artificial Sequence: Synthetic peptide"
VLVDAGTQI

SEQ ID NO: 27270 - protein, 9 aa, Artificial Sequence
  source: /note="Description of Artificial Sequence: Synthetic peptide"
SRLSDPQVL

SEQ ID NO: 27271 - protein, 9 aa, Artificial Sequence
  source: /note="Description of Artificial Sequence: Synthetic peptide"
LVDAGTQIF

SEQ ID NO: 27272 - protein, 10 aa, Artificial Sequence
  source: /note="Description of Artificial Sequence: Synthetic peptide"
LVDAGTQIFF

SEQ ID NO: 27273 - protein, 10 aa, Artificial Sequence
  source: /note="Description of Artificial Sequence: Synthetic peptide"
VLVDAGTQIF

SEQ ID NO: 27274 - protein, 10 aa, Artificial Sequence
  source: /note="Description of Artificial Sequence: Synthetic peptide"
LSRLSDPQVL

SEQ ID NO: 27275 - protein, 9 aa, Artificial Sequence
  source: /note="Description of Artificial Sequence: Synthetic peptide"
LALAGFTFV

SEQ ID NO: 27276 - protein, 9 aa, Artificial Sequence
  source: /note="Description of Artificial Sequence: Synthetic peptide"
ALAGFTFVL

SEQ ID NO: 27277 - protein, 9 aa, Artificial Sequence
  source: /note="Description of Artificial Sequence: Synthetic peptide"
VLSGVFTGT

SEQ ID NO: 27278 - protein, 9 aa, Artificial Sequence
  source: /note="Description of Artificial Sequence: Synthetic peptide"
MLALAGFTF

SEQ ID NO: 27279 - protein, 9 aa, Artificial Sequence
  source: /note="Description of Artificial Sequence: Synthetic peptide"
FTFVLSGVF

SEQ ID NO: 27280 - protein, 9 aa, Artificial Sequence
  source: /note="Description of Artificial Sequence: Synthetic peptide"
AIMLALAGF

SEQ ID NO: 27281 - protein, 10 aa, Artificial Sequence
  source: /note="Description of Artificial Sequence: Synthetic peptide"
MLALAGFTFV

SEQ ID NO: 27282 - protein, 10 aa, Artificial Sequence
  source: /note="Description of Artificial Sequence: Synthetic peptide"
FVLSGVFTGT

SEQ ID NO: 27283 - protein, 10 aa, Artificial Sequence
  source: /note="Description of Artificial Sequence: Synthetic peptide"
VLSGVFTGTI

SEQ ID NO: 27284 - protein, 10 aa, Artificial Sequence
  source: /note="Description of Artificial Sequence: Synthetic peptide"
AIMLALAGFT

SEQ ID NO: 27285 - protein, 10 aa, Artificial Sequence
  source: /note="Description of Artificial Sequence: Synthetic peptide"
ALAGFTFVLS

SEQ ID NO: 27286 - protein, 10 aa, Artificial Sequence
  source: /note="Description of Artificial Sequence: Synthetic peptide"
AGFTFVLSGV

SEQ ID NO: 27287 - protein, 10 aa, Artificial Sequence
  source: /note="Description of Artificial Sequence: Synthetic peptide"
YAIMLALAGF

SEQ ID NO: 27288 - protein, 10 aa, Artificial Sequence
  source: /note="Description of Artificial Sequence: Synthetic peptide"
IMLALAGFTF

SEQ ID NO: 27289 - protein, 10 aa, Artificial Sequence
  source: /note="Description of Artificial Sequence: Synthetic peptide"
GFTFVLSGVF

SEQ ID NO: 27290 - protein, 10 aa, Artificial Sequence
  source: /note="Description of Artificial Sequence: Synthetic peptide"
FTFVLSGVFT

SEQ ID NO: 27291 - protein, 10 aa, Artificial Sequence
  source: /note="Description of Artificial Sequence: Synthetic peptide"
LALAGFTFVL

SEQ ID NO: 27292 - protein, 9 aa, Artificial Sequence
  source: /note="Description of Artificial Sequence: Synthetic peptide"
AVPSEATKK

SEQ ID NO: 27293 - protein, 9 aa, Artificial Sequence
  source: /note="Description of Artificial Sequence: Synthetic peptide"
ATKKDQNLK

SEQ ID NO: 27294 - protein, 10 aa, Artificial Sequence
  source: /note="Description of Artificial Sequence: Synthetic peptide"
ATKKDQNLKR

SEQ ID NO: 27295 - protein, 9 aa, Artificial Sequence
  source: /note="Description of Artificial Sequence: Synthetic peptide"
NLTNGSWPA

SEQ ID NO: 27296 - protein, 9 aa, Artificial Sequence
  source: /note="Description of Artificial Sequence: Synthetic peptide"
WPAALPSNL

SEQ ID NO: 27297 - protein, 9 aa, Artificial Sequence
  source: /note="Description of Artificial Sequence: Synthetic peptide"
ASNLTNGSW

SEQ ID NO: 27298 - protein, 10 aa, Artificial Sequence
  source: /note="Description of Artificial Sequence: Synthetic peptide"
NLTNGSWPAA

SEQ ID NO: 27299 - protein, 10 aa, Artificial Sequence
  source: /note="Description of Artificial Sequence: Synthetic peptide"
SWPAALPSNL

SEQ ID NO: 27300 - protein, 10 aa, Artificial Sequence
  source: /note="Description of Artificial Sequence: Synthetic peptide"
LTNGSWPAAL

SEQ ID NO: 27301 - protein, 10 aa, Artificial Sequence
  source: /note="Description of Artificial Sequence: Synthetic peptide"
DASNLTNGSW

SEQ ID NO: 27302 - protein, 9 aa, Artificial Sequence
  source: /note="Description of Artificial Sequence: Synthetic peptide"
FPNCIPPPQ

SEQ ID NO: 27303 - protein, 9 aa, Artificial Sequence
  source: /note="Description of Artificial Sequence: Synthetic peptide"
EVWNPQKAI

SEQ ID NO: 27304 - protein, 9 aa, Artificial Sequence
  source: /note="Description of Artificial Sequence: Synthetic peptide"
EEVWNPQKA

SEQ ID NO: 27305 - protein, 9 aa, Artificial Sequence
  source: /note="Description of Artificial Sequence: Synthetic peptide"
IATTGEEVW

SEQ ID NO: 27306 - protein, 10 aa, Artificial Sequence
  source: /note="Description of Artificial Sequence: Synthetic peptide"
EEVWNPQKAI

SEQ ID NO: 27307 - protein, 10 aa, Artificial Sequence
  source: /note="Description of Artificial Sequence: Synthetic peptide"
GEEVWNPQKA

SEQ ID NO: 27308 - protein, 9 aa, Artificial Sequence
  source: /note="Description of Artificial Sequence: Synthetic peptide"
GTVALTIIH

SEQ ID NO: 27309 - protein, 9 aa, Artificial Sequence
  source: /note="Description of Artificial Sequence: Synthetic peptide"
TVALTIIHR

SEQ ID NO: 27310 - protein, 10 aa, Artificial Sequence
  source: /note="Description of Artificial Sequence: Synthetic peptide"
GTVALTIIHR

SEQ ID NO: 27311 - protein, 9 aa, Artificial Sequence
  source: /note="Description of Artificial Sequence: Synthetic peptide"
CGDLTNTVF

SEQ ID NO: 27312 - protein, 10 aa, Artificial Sequence
  source: /note="Description of Artificial Sequence: Synthetic peptide"
RCGDLTNTVF

SEQ ID NO: 27313 - protein, 9 aa, Artificial Sequence
  source: /note="Description of Artificial Sequence: Synthetic peptide"
SLAQRGKTV

SEQ ID NO: 27314 - protein, 9 aa, Artificial Sequence
  source: /note="Description of Artificial Sequence: Synthetic peptide"
KTSLAQRGK

SEQ ID NO: 27315 - protein, 9 aa, Artificial Sequence
  source: /note="Description of Artificial Sequence: Synthetic peptide"
RQAYYSSPF

SEQ ID NO: 27316 - protein, 9 aa, Artificial Sequence
  source: /note="Description of Artificial Sequence: Synthetic peptide"
AYYSSPFSL

SEQ ID NO: 27317 - protein, 9 aa, Artificial Sequence
  source: /note="Description of Artificial Sequence: Synthetic peptide"
RAPRRQAYY

SEQ ID NO: 27318 - protein, 9 aa, Artificial Sequence
  source: /note="Description of Artificial Sequence: Synthetic peptide"
YYSSPFSLK

SEQ ID NO: 27319 - protein, 9 aa, Artificial Sequence
  source: /note="Description of Artificial Sequence: Synthetic peptide"
SLKTSLAQR

SEQ ID NO: 27320 - protein, 9 aa, Artificial Sequence
  source: /note="Description of Artificial Sequence: Synthetic peptide"
KRAPRRQAY

SEQ ID NO: 27321 - protein, 9 aa, Artificial Sequence
  source: /note="Description of Artificial Sequence: Synthetic peptide"
PTAEKRAPR

SEQ ID NO: 27322 - protein, 9 aa, Artificial Sequence
  source: /note="Description of Artificial Sequence: Synthetic peptide"
MPSTPQHPT

SEQ ID NO: 27323 - protein, 9 aa, Artificial Sequence
  source: /note="Description of Artificial Sequence: Synthetic peptide"
SPFSLKTSL

SEQ ID NO: 27324 - protein, 10 aa, Artificial Sequence
  source: /note="Description of Artificial Sequence: Synthetic peptide"
AYYSSPFSLK

SEQ ID NO: 27325 - protein, 10 aa, Artificial Sequence
  source: /note="Description of Artificial Sequence: Synthetic peptide"
STPQHPTAEK

SEQ ID NO: 27326 - protein, 10 aa, Artificial Sequence
  source: /note="Description of Artificial Sequence: Synthetic peptide"
FSLKTSLAQR

SEQ ID NO: 27327 - protein, 10 aa, Artificial Sequence
  source: /note="Description of Artificial Sequence: Synthetic peptide"
RQAYYSSPFS

SEQ ID NO: 27328 - protein, 10 aa, Artificial Sequence
  source: /note="Description of Artificial Sequence: Synthetic peptide"
QAYYSSPFSL

SEQ ID NO: 27329 - protein, 10 aa, Artificial Sequence
  source: /note="Description of Artificial Sequence: Synthetic peptide"
KRAPRRQAYY

SEQ ID NO: 27330 - protein, 10 aa, Artificial Sequence
  source: /note="Description of Artificial Sequence: Synthetic peptide"
PTAEKRAPRR

SEQ ID NO: 27331 - protein, 10 aa, Artificial Sequence
  source: /note="Description of Artificial Sequence: Synthetic peptide"
MPSTPQHPTA

SEQ ID NO: 27332 - protein, 10 aa, Artificial Sequence
  source: /note="Description of Artificial Sequence: Synthetic peptide"
SPFSLKTSLA

SEQ ID NO: 27333 - protein, 10 aa, Artificial Sequence
  source: /note="Description of Artificial Sequence: Synthetic peptide"
RRQAYYSSPF

SEQ ID NO: 27334 - protein, 10 aa, Artificial Sequence
  source: /note="Description of Artificial Sequence: Synthetic peptide"
AEKRAPRRQA

SEQ ID NO: 27335 - protein, 9 aa, Artificial Sequence
  source: /note="Description of Artificial Sequence: Synthetic peptide"
ILIRHQNTL

SEQ ID NO: 27336 - protein, 9 aa, Artificial Sequence
  source: /note="Description of Artificial Sequence: Synthetic peptide"
LIRHQNTLR

SEQ ID NO: 27337 - protein, 9 aa, Artificial Sequence
  source: /note="Description of Artificial Sequence: Synthetic peptide"
HQNTLRESM

SEQ ID NO: 27338 - protein, 9 aa, Artificial Sequence
  source: /note="Description of Artificial Sequence: Synthetic peptide"
KEILIRHQN

SEQ ID NO: 27339 - protein, 10 aa, Artificial Sequence
  source: /note="Description of Artificial Sequence: Synthetic peptide"
ILIRHQNTLR

SEQ ID NO: 27340 - protein, 10 aa, Artificial Sequence
  source: /note="Description of Artificial Sequence: Synthetic peptide"
HQNTLRESMR

SEQ ID NO: 27341 - protein, 10 aa, Artificial Sequence
  source: /note="Description of Artificial Sequence: Synthetic peptide"
EILIRHQNTL

SEQ ID NO: 27342 - protein, 10 aa, Artificial Sequence
  source: /note="Description of Artificial Sequence: Synthetic peptide"
KQAKEILIRH

SEQ ID NO: 27343 - protein, 10 aa, Artificial Sequence
  source: /note="Description of Artificial Sequence: Synthetic peptide"
RHQNTLRESM

SEQ ID NO: 27344 - protein, 10 aa, Artificial Sequence
  source: /note="Description of Artificial Sequence: Synthetic peptide"
KEILIRHQNT

SEQ ID NO: 27345 - protein, 9 aa, Artificial Sequence
  source: /note="Description of Artificial Sequence: Synthetic peptide"
VIVQGFTIK

SEQ ID NO: 27346 - protein, 9 aa, Artificial Sequence
  source: /note="Description of Artificial Sequence: Synthetic peptide"
FFTVIVQGF

SEQ ID NO: 27347 - protein, 9 aa, Artificial Sequence
  source: /note="Description of Artificial Sequence: Synthetic peptide"
FTIKPLVKW

SEQ ID NO: 27348 - protein, 9 aa, Artificial Sequence
  source: /note="Description of Artificial Sequence: Synthetic peptide"
GFTIKPLVK

SEQ ID NO: 27349 - protein, 9 aa, Artificial Sequence
  source: /note="Description of Artificial Sequence: Synthetic peptide"
FTVIVQGFT

SEQ ID NO: 27350 - protein, 9 aa, Artificial Sequence
  source: /note="Description of Artificial Sequence: Synthetic peptide"
TVIVQGFTI

SEQ ID NO: 27351 - protein, 9 aa, Artificial Sequence
  source: /note="Description of Artificial Sequence: Synthetic peptide"
VQGFTIKPL

SEQ ID NO: 27352 - protein, 10 aa, Artificial Sequence
  source: /note="Description of Artificial Sequence: Synthetic peptide"
FTIKPLVKWL

SEQ ID NO: 27353 - protein, 10 aa, Artificial Sequence
  source: /note="Description of Artificial Sequence: Synthetic peptide"
TVIVQGFTIK

SEQ ID NO: 27354 - protein, 10 aa, Artificial Sequence
  source: /note="Description of Artificial Sequence: Synthetic peptide"
QGFTIKPLVK

SEQ ID NO: 27355 - protein, 10 aa, Artificial Sequence
  source: /note="Description of Artificial Sequence: Synthetic peptide"
VFFTVIVQGF

SEQ ID NO: 27356 - protein, 10 aa, Artificial Sequence
  source: /note="Description of Artificial Sequence: Synthetic peptide"
GFTIKPLVKW

SEQ ID NO: 27357 - protein, 10 aa, Artificial Sequence
  source: /note="Description of Artificial Sequence: Synthetic peptide"
FTVIVQGFTI

SEQ ID NO: 27358 - protein, 9 aa, Artificial Sequence
  source: /note="Description of Artificial Sequence: Synthetic peptide"
HSSKWSSTY

SEQ ID NO: 27359 - protein, 9 aa, Artificial Sequence
  source: /note="Description of Artificial Sequence: Synthetic peptide"
SLRTPLGTI

SEQ ID NO: 27360 - protein, 9 aa, Artificial Sequence
  source: /note="Description of Artificial Sequence: Synthetic peptide"
RSSGSRNSK

SEQ ID NO: 27361 - protein, 9 aa, Artificial Sequence
  source: /note="Description of Artificial Sequence: Synthetic peptide"
FSHLDHSSK

SEQ ID NO: 27362 - protein, 9 aa, Artificial Sequence
  source: /note="Description of Artificial Sequence: Synthetic peptide"
GSRNSKSLR

SEQ ID NO: 27363 - protein, 9 aa, Artificial Sequence
  source: /note="Description of Artificial Sequence: Synthetic peptide"
SSKWSSTYG

SEQ ID NO: 27364 - protein, 9 aa, Artificial Sequence
  source: /note="Description of Artificial Sequence: Synthetic peptide"
NSKSLRTPL

SEQ ID NO: 27365 - protein, 9 aa, Artificial Sequence
  source: /note="Description of Artificial Sequence: Synthetic peptide"
SHLDHSSKW

SEQ ID NO: 27366 - protein, 9 aa, Artificial Sequence
  source: /note="Description of Artificial Sequence: Synthetic peptide"
SKWSSTYGH

SEQ ID NO: 27367 - protein, 10 aa, Artificial Sequence
  source: /note="Description of Artificial Sequence: Synthetic peptide"
AVRSSGSRNS

SEQ ID NO: 27368 - protein, 10 aa, Artificial Sequence
  source: /note="Description of Artificial Sequence: Synthetic peptide"
KSLRTPLGTI

SEQ ID NO: 27369 - protein, 10 aa, Artificial Sequence
  source: /note="Description of Artificial Sequence: Synthetic peptide"
IFSHLDHSSK

SEQ ID NO: 27370 - protein, 10 aa, Artificial Sequence
  source: /note="Description of Artificial Sequence: Synthetic peptide"
SSKWSSTYGH

SEQ ID NO: 27371 - protein, 10 aa, Artificial Sequence
  source: /note="Description of Artificial Sequence: Synthetic peptide"
MPKATVQAVR

SEQ ID NO: 27372 - protein, 10 aa, Artificial Sequence
  source: /note="Description of Artificial Sequence: Synthetic peptide"
RNSKSLRTPL

SEQ ID NO: 27373 - protein, 10 aa, Artificial Sequence
  source: /note="Description of Artificial Sequence: Synthetic peptide"
CEGCDDSSIF

SEQ ID NO: 27374 - protein, 10 aa, Artificial Sequence
  source: /note="Description of Artificial Sequence: Synthetic peptide"
FSHLDHSSKW

SEQ ID NO: 27375 - protein, 9 aa, Artificial Sequence
  source: /note="Description of Artificial Sequence: Synthetic peptide"
ISSATSKQL

SEQ ID NO: 27376 - protein, 10 aa, Artificial Sequence
  source: /note="Description of Artificial Sequence: Synthetic peptide"
NINISSATSK

SEQ ID NO: 27377 - protein, 10 aa, Artificial Sequence
  source: /note="Description of Artificial Sequence: Synthetic peptide"
ISSATSKQLI

SEQ ID NO: 27378 - protein, 9 aa, Artificial Sequence
  source: /note="Description of Artificial Sequence: Synthetic peptide"
ESECLGDPV

SEQ ID NO: 27379 - protein, 9 aa, Artificial Sequence
  source: /note="Description of Artificial Sequence: Synthetic peptide"
CLGDPVRDF

SEQ ID NO: 27380 - protein, 10 aa, Artificial Sequence
  source: /note="Description of Artificial Sequence: Synthetic peptide"
QESECLGDPV

SEQ ID NO: 27381 - protein, 9 aa, Artificial Sequence
  source: /note="Description of Artificial Sequence: Synthetic peptide"
FTIYFCMAI

SEQ ID NO: 27382 - protein, 9 aa, Artificial Sequence
  source: /note="Description of Artificial Sequence: Synthetic peptide"
SLMSSLTFI

SEQ ID NO: 27383 - protein, 9 aa, Artificial Sequence
  source: /note="Description of Artificial Sequence: Synthetic peptide"
LMSSLTFIM

SEQ ID NO: 27384 - protein, 9 aa, Artificial Sequence
  source: /note="Description of Artificial Sequence: Synthetic peptide"
SLTFIMRLV

SEQ ID NO: 27385 - protein, 9 aa, Artificial Sequence
  source: /note="Description of Artificial Sequence: Synthetic peptide"
IMRLVCTWK

SEQ ID NO: 27386 - protein, 9 aa, Artificial Sequence
  source: /note="Description of Artificial Sequence: Synthetic peptide"
TMACMKSFR

SEQ ID NO: 27387 - protein, 9 aa, Artificial Sequence
  source: /note="Description of Artificial Sequence: Synthetic peptide"
QVCSVSLPR

SEQ ID NO: 27388 - protein, 9 aa, Artificial Sequence
  source: /note="Description of Artificial Sequence: Synthetic peptide"
MSSLTFIMR

SEQ ID NO: 27389 - protein, 9 aa, Artificial Sequence
  source: /note="Description of Artificial Sequence: Synthetic peptide"
VSLPRLPSF

SEQ ID NO: 27390 - protein, 9 aa, Artificial Sequence
  source: /note="Description of Artificial Sequence: Synthetic peptide"
RLPSFTIYF

SEQ ID NO: 27391 - protein, 9 aa, Artificial Sequence
  source: /note="Description of Artificial Sequence: Synthetic peptide"
YFCMAIPSL

SEQ ID NO: 27392 - protein, 9 aa, Artificial Sequence
  source: /note="Description of Artificial Sequence: Synthetic peptide"
CMAIPSLDF

SEQ ID NO: 27393 - protein, 9 aa, Artificial Sequence
  source: /note="Description of Artificial Sequence: Synthetic peptide"
FSLMSSLTF

SEQ ID NO: 27394 - protein, 9 aa, Artificial Sequence
  source: /note="Description of Artificial Sequence: Synthetic peptide"
FIMRLVCTW

SEQ ID NO: 27395 - protein, 9 aa, Artificial Sequence
  source: /note="Description of Artificial Sequence: Synthetic peptide"
KTMACMKSF

SEQ ID NO: 27396 - protein, 9 aa, Artificial Sequence
  source: /note="Description of Artificial Sequence: Synthetic peptide"
CMKSFRGLF

SEQ ID NO: 27397 - protein, 9 aa, Artificial Sequence
  source: /note="Description of Artificial Sequence: Synthetic peptide"
RGLFWGCSW

SEQ ID NO: 27398 - protein, 9 aa, Artificial Sequence
  source: /note="Description of Artificial Sequence: Synthetic peptide"
TWKTMACMK

SEQ ID NO: 27399 - protein, 9 aa, Artificial Sequence
  source: /note="Description of Artificial Sequence: Synthetic peptide"
KSFRGLFWG

SEQ ID NO: 27400 - protein, 9 aa, Artificial Sequence
  source: /note="Description of Artificial Sequence: Synthetic peptide"
LPRLPSFTI

SEQ ID NO: 27401 - protein, 9 aa, Artificial Sequence
  source: /note="Description of Artificial Sequence: Synthetic peptide"
IPSLDFSLM

SEQ ID NO: 27402 - protein, 9 aa, Artificial Sequence
  source: /note="Description of Artificial Sequence: Synthetic peptide"
RLVCTWKTM

SEQ ID NO: 27403 - protein, 9 aa, Artificial Sequence
  source: /note="Description of Artificial Sequence: Synthetic peptide"
KRASQVCSV

SEQ ID NO: 27404 - protein, 9 aa, Artificial Sequence
  source: /note="Description of Artificial Sequence: Synthetic peptide"
ASQVCSVSL

SEQ ID NO: 27405 - protein, 9 aa, Artificial Sequence
  source: /note="Description of Artificial Sequence: Synthetic peptide"
SQVCSVSLP

SEQ ID NO: 27406 - protein, 9 aa, Artificial Sequence
  source: /note="Description of Artificial Sequence: Synthetic peptide"
LDFSLMSSL

SEQ ID NO: 27407 - protein, 9 aa, Artificial Sequence
  source: /note="Description of Artificial Sequence: Synthetic peptide"
CTWKTMACM

SEQ ID NO: 27408 - protein, 9 aa, Artificial Sequence
  source: /note="Description of Artificial Sequence: Synthetic peptide"
MKSFRGLFW

SEQ ID NO: 27409 - protein, 9 aa, Artificial Sequence
  source: /note="Description of Artificial Sequence: Synthetic peptide"
CEKRASQVC

SEQ ID NO: 27410 - protein, 9 aa, Artificial Sequence
  source: /note="Description of Artificial Sequence: Synthetic peptide"
LPSFTIYFC

SEQ ID NO: 27411 - protein, 10 aa, Artificial Sequence
  source: /note="Description of Artificial Sequence: Synthetic peptide"
SLPRLPSFTI

SEQ ID NO: 27412 - protein, 10 aa, Artificial Sequence
  source: /note="Description of Artificial Sequence: Synthetic peptide"
RLPSFTIYFC

SEQ ID NO: 27413 - protein, 10 aa, Artificial Sequence
  source: /note="Description of Artificial Sequence: Synthetic peptide"
SLDFSLMSSL

SEQ ID NO: 27414 - protein, 10 aa, Artificial Sequence
  source: /note="Description of Artificial Sequence: Synthetic peptide"
FSLMSSLTFI

SEQ ID NO: 27415 - protein, 10 aa, Artificial Sequence
  source: /note="Description of Artificial Sequence: Synthetic peptide"
SLMSSLTFIM

SEQ ID NO: 27416 - protein, 10 aa, Artificial Sequence
  source: /note="Description of Artificial Sequence: Synthetic peptide"
RLVCTWKTMA

SEQ ID NO: 27417 - protein, 10 aa, Artificial Sequence
  source: /note="Description of Artificial Sequence: Synthetic peptide"
LMSSLTFIMR

SEQ ID NO: 27418 - protein, 10 aa, Artificial Sequence
  source: /note="Description of Artificial Sequence: Synthetic peptide"
FIMRLVCTWK

SEQ ID NO: 27419 - protein, 10 aa, Artificial Sequence
  source: /note="Description of Artificial Sequence: Synthetic peptide"
CTWKTMACMK

SEQ ID NO: 27420 - protein, 10 aa, Artificial Sequence
  source: /note="Description of Artificial Sequence: Synthetic peptide"
KTMACMKSFR

SEQ ID NO: 27421 - protein, 10 aa, Artificial Sequence
  source: /note="Description of Artificial Sequence: Synthetic peptide"
SQVCSVSLPR

SEQ ID NO: 27422 - protein, 10 aa, Artificial Sequence
  source: /note="Description of Artificial Sequence: Synthetic peptide"
SFTIYFCMAI

SEQ ID NO: 27423 - protein, 10 aa, Artificial Sequence
  source: /note="Description of Artificial Sequence: Synthetic peptide"
IYFCMAIPSL

SEQ ID NO: 27424 - protein, 10 aa, Artificial Sequence
  source: /note="Description of Artificial Sequence: Synthetic peptide"
FCMAIPSLDF

SEQ ID NO: 27425 - protein, 10 aa, Artificial Sequence
  source: /note="Description of Artificial Sequence: Synthetic peptide"
DFSLMSSLTF

SEQ ID NO: 27426 - protein, 10 aa, Artificial Sequence
  source: /note="Description of Artificial Sequence: Synthetic peptide"
TFIMRLVCTW

SEQ ID NO: 27427 - protein, 10 aa, Artificial Sequence
  source: /note="Description of Artificial Sequence: Synthetic peptide"
CMKSFRGLFW

SEQ ID NO: 27428 - protein, 10 aa, Artificial Sequence
  source: /note="Description of Artificial Sequence: Synthetic peptide"
SSLTFIMRLV

SEQ ID NO: 27429 - protein, 10 aa, Artificial Sequence
  source: /note="Description of Artificial Sequence: Synthetic peptide"
MAIPSLDFSL

SEQ ID NO: 27430 - protein, 10 aa, Artificial Sequence
  source: /note="Description of Artificial Sequence: Synthetic peptide"
MSSLTFIMRL

SEQ ID NO: 27431 - protein, 10 aa, Artificial Sequence
  source: /note="Description of Artificial Sequence: Synthetic peptide"
RASQVCSVSL

SEQ ID NO: 27432 - protein, 10 aa, Artificial Sequence
  source: /note="Description of Artificial Sequence: Synthetic peptide"
LPRLPSFTIY

SEQ ID NO: 27433 - protein, 10 aa, Artificial Sequence
  source: /note="Description of Artificial Sequence: Synthetic peptide"
LPSFTIYFCM

SEQ ID NO: 27434 - protein, 10 aa, Artificial Sequence
  source: /note="Description of Artificial Sequence: Synthetic peptide"
MACMKSFRGL

SEQ ID NO: 27435 - protein, 10 aa, Artificial Sequence
  source: /note="Description of Artificial Sequence: Synthetic peptide"
SVSLPRLPSF

SEQ ID NO: 27436 - protein, 10 aa, Artificial Sequence
  source: /note="Description of Artificial Sequence: Synthetic peptide"
MRLVCTWKTM

SEQ ID NO: 27437 - protein, 10 aa, Artificial Sequence
  source: /note="Description of Artificial Sequence: Synthetic peptide"
WKTMACMKSF

SEQ ID NO: 27438 - protein, 10 aa, Artificial Sequence
  source: /note="Description of Artificial Sequence: Synthetic peptide"
ACMKSFRGLF

SEQ ID NO: 27439 - protein, 10 aa, Artificial Sequence
  source: /note="Description of Artificial Sequence: Synthetic peptide"
FRGLFWGCSW

SEQ ID NO: 27440 - protein, 10 aa, Artificial Sequence
  source: /note="Description of Artificial Sequence: Synthetic peptide"
CEKRASQVCS

SEQ ID NO: 27441 - protein, 9 aa, Artificial Sequence
  source: /note="Description of Artificial Sequence: Synthetic peptide"
SLQHFTAPT

SEQ ID NO: 27442 - protein, 9 aa, Artificial Sequence
  source: /note="Description of Artificial Sequence: Synthetic peptide"
KGFTSLQHF

SEQ ID NO: 27443 - protein, 9 aa, Artificial Sequence
  source: /note="Description of Artificial Sequence: Synthetic peptide"
HFTAPTSQF

SEQ ID NO: 27444 - protein, 9 aa, Artificial Sequence
  source: /note="Description of Artificial Sequence: Synthetic peptide"
FTSLQHFTA

SEQ ID NO: 27445 - protein, 9 aa, Artificial Sequence
  source: /note="Description of Artificial Sequence: Synthetic peptide"
LQHFTAPTS

SEQ ID NO: 27446 - protein, 10 aa, Artificial Sequence
  source: /note="Description of Artificial Sequence: Synthetic peptide"
HFTAPTSQFY

SEQ ID NO: 27447 - protein, 10 aa, Artificial Sequence
  source: /note="Description of Artificial Sequence: Synthetic peptide"
KKGFTSLQHF

SEQ ID NO: 27448 - protein, 10 aa, Artificial Sequence
  source: /note="Description of Artificial Sequence: Synthetic peptide"
LQHFTAPTSQ

SEQ ID NO: 27449 - protein, 10 aa, Artificial Sequence
  source: /note="Description of Artificial Sequence: Synthetic peptide"
QHFTAPTSQF

SEQ ID NO: 27450 - protein, 9 aa, Artificial Sequence
  source: /note="Description of Artificial Sequence: Synthetic peptide"
FYLGMLDHI

SEQ ID NO: 27451 - protein, 9 aa, Artificial Sequence
  source: /note="Description of Artificial Sequence: Synthetic peptide"
RLKVLFYLG

SEQ ID NO: 27452 - protein, 9 aa, Artificial Sequence
  source: /note="Description of Artificial Sequence: Synthetic peptide"
KVLFYLGML

SEQ ID NO: 27453 - protein, 9 aa, Artificial Sequence
  source: /note="Description of Artificial Sequence: Synthetic peptide"
LKVLFYLGM

SEQ ID NO: 27454 - protein, 10 aa, Artificial Sequence
  source: /note="Description of Artificial Sequence: Synthetic peptide"
LFYLGMLDHI

SEQ ID NO: 27455 - protein, 10 aa, Artificial Sequence
  source: /note="Description of Artificial Sequence: Synthetic peptide"
RLKVLFYLGM

SEQ ID NO: 27456 - protein, 10 aa, Artificial Sequence
  source: /note="Description of Artificial Sequence: Synthetic peptide"
YLGMLDHIGR

SEQ ID NO: 27457 - protein, 10 aa, Artificial Sequence
  source: /note="Description of Artificial Sequence: Synthetic peptide"
LKVLFYLGML

SEQ ID NO: 27458 - protein, 9 aa, Artificial Sequence
  source: /note="Description of Artificial Sequence: Synthetic peptide"
GIPHLSSSK

SEQ ID NO: 27459 - protein, 9 aa, Artificial Sequence
  source: /note="Description of Artificial Sequence: Synthetic peptide"
LSSSKENAW

SEQ ID NO: 27460 - protein, 10 aa, Artificial Sequence
  source: /note="Description of Artificial Sequence: Synthetic peptide"
LGIPHLSSSK

SEQ ID NO: 27461 - protein, 10 aa, Artificial Sequence
  source: /note="Description of Artificial Sequence: Synthetic peptide"
VEASLGIPHL

SEQ ID NO: 27462 - protein, 10 aa, Artificial Sequence
  source: /note="Description of Artificial Sequence: Synthetic peptide"
HLSSSKENAW

SEQ ID NO: 27463 - protein, 9 aa, Artificial Sequence
  source: /note="Description of Artificial Sequence: Synthetic peptide"
RLYLNGNMI

SEQ ID NO: 27464 - protein, 9 aa, Artificial Sequence
  source: /note="Description of Artificial Sequence: Synthetic peptide"
YLNGNMIER

SEQ ID NO: 27465 - protein, 9 aa, Artificial Sequence
  source: /note="Description of Artificial Sequence: Synthetic peptide"
RRLYLNGNM

SEQ ID NO: 27466 - protein, 10 aa, Artificial Sequence
  source: /note="Description of Artificial Sequence: Synthetic peptide"
YLNGNMIERL

SEQ ID NO: 27467 - protein, 10 aa, Artificial Sequence
  source: /note="Description of Artificial Sequence: Synthetic peptide"
NMIERLSPEL

SEQ ID NO: 27468 - protein, 10 aa, Artificial Sequence
  source: /note="Description of Artificial Sequence: Synthetic peptide"
LYLNGNMIER

SEQ ID NO: 27469 - protein, 10 aa, Artificial Sequence
  source: /note="Description of Artificial Sequence: Synthetic peptide"
LRRLYLNGNM

SEQ ID NO: 27470 - protein, 10 aa, Artificial Sequence
  source: /note="Description of Artificial Sequence: Synthetic peptide"
RRLYLNGNMI

SEQ ID NO: 27471 - protein, 10 aa, Artificial Sequence
  source: /note="Description of Artificial Sequence: Synthetic peptide"
MIERLSPELF

SEQ ID NO: 27472 - protein, 9 aa, Artificial Sequence
  source: /note="Description of Artificial Sequence: Synthetic peptide"
ILTVSCENL

SEQ ID NO: 27473 - protein, 9 aa, Artificial Sequence
  source: /note="Description of Artificial Sequence: Synthetic peptide"
TVSCENLGI

SEQ ID NO: 27474 - protein, 9 aa, Artificial Sequence
  source: /note="Description of Artificial Sequence: Synthetic peptide"
CENLGIISL

SEQ ID NO: 27475 - protein, 10 aa, Artificial Sequence
  source: /note="Description of Artificial Sequence: Synthetic peptide"
NLGIISLSEI

SEQ ID NO: 27476 - protein, 10 aa, Artificial Sequence
  source: /note="Description of Artificial Sequence: Synthetic peptide"
LTVSCENLGI

SEQ ID NO: 27477 - protein, 10 aa, Artificial Sequence
  source: /note="Description of Artificial Sequence: Synthetic peptide"
CENLGIISLS

SEQ ID NO: 27478 - protein, 9 aa, Artificial Sequence
  source: /note="Description of Artificial Sequence: Synthetic peptide"
KQSTEFLSF

SEQ ID NO: 27479 - protein, 9 aa, Artificial Sequence
  source: /note="Description of Artificial Sequence: Synthetic peptide"
SNMKYKTTK

SEQ ID NO: 27480 - protein, 9 aa, Artificial Sequence
  source: /note="Description of Artificial Sequence: Synthetic peptide"
KYKTTKQST

SEQ ID NO: 27481 - protein, 9 aa, Artificial Sequence
  source: /note="Description of Artificial Sequence: Synthetic peptide"
TTKQSTEFL

SEQ ID NO: 27482 - protein, 9 aa, Artificial Sequence
  source: /note="Description of Artificial Sequence: Synthetic peptide"
KTTKQSTEF

SEQ ID NO: 27483 - protein, 10 aa, Artificial Sequence
  source: /note="Description of Artificial Sequence: Synthetic peptide"
GSNMKYKTTK

SEQ ID NO: 27484 - protein, 10 aa, Artificial Sequence
  source: /note="Description of Artificial Sequence: Synthetic peptide"
KTTKQSTEFL

SEQ ID NO: 27485 - protein, 10 aa, Artificial Sequence
  source: /note="Description of Artificial Sequence: Synthetic peptide"
MKYKTTKQST

SEQ ID NO: 27486 - protein, 10 aa, Artificial Sequence
  source: /note="Description of Artificial Sequence: Synthetic peptide"
YKTTKQSTEF

SEQ ID NO: 27487 - protein, 10 aa, Artificial Sequence
  source: /note="Description of Artificial Sequence: Synthetic peptide"
TKQSTEFLSF

SEQ ID NO: 27488 - protein, 9 aa, Artificial Sequence
  source: /note="Description of Artificial Sequence: Synthetic peptide"
LLSNVNQNA

SEQ ID NO: 27489 - protein, 9 aa, Artificial Sequence
  source: /note="Description of Artificial Sequence: Synthetic peptide"
VNQNATVEM

SEQ ID NO: 27490 - protein, 10 aa, Artificial Sequence
  source: /note="Description of Artificial Sequence: Synthetic peptide"
GLLSNVNQNA

SEQ ID NO: 27491 - protein, 10 aa, Artificial Sequence
  source: /note="Description of Artificial Sequence: Synthetic peptide"
NVNQNATVEM

SEQ ID NO: 27492 - protein, 10 aa, Artificial Sequence
  source: /note="Description of Artificial Sequence: Synthetic peptide"
YVDPSGGDHF

SEQ ID NO: 27493 - protein, 10 aa, Artificial Sequence
  source: /note="Description of Artificial Sequence: Synthetic peptide"
DPSGGDHFCL

SEQ ID NO: 27494 - protein, 9 aa, Artificial Sequence
  source: /note="Description of Artificial Sequence: Synthetic peptide"
ALKKLRSPL

SEQ ID NO: 27495 - protein, 9 aa, Artificial Sequence
  source: /note="Description of Artificial Sequence: Synthetic peptide"
KISNWSLKK

SEQ ID NO: 27496 - protein, 9 aa, Artificial Sequence
  source: /note="Description of Artificial Sequence: Synthetic peptide"
SLKKVPALK

SEQ ID NO: 27497 - protein, 9 aa, Artificial Sequence
  source: /note="Description of Artificial Sequence: Synthetic peptide"
KLRSPLWIF

SEQ ID NO: 27498 - protein, 9 aa, Artificial Sequence
  source: /note="Description of Artificial Sequence: Synthetic peptide"
KKRKRKREK

SEQ ID NO: 27499 - protein, 9 aa, Artificial Sequence
  source: /note="Description of Artificial Sequence: Synthetic peptide"
RKREKRSQK

SEQ ID NO: 27500 - protein, 9 aa, Artificial Sequence
  source: /note="Description of Artificial Sequence: Synthetic peptide"
RSQKSRQNH

SEQ ID NO: 27501 - protein, 9 aa, Artificial Sequence
  source: /note="Description of Artificial Sequence: Synthetic peptide"
SQKSRQNHL

SEQ ID NO: 27502 - protein, 9 aa, Artificial Sequence
  source: /note="Description of Artificial Sequence: Synthetic peptide"
KSRQNHLQL

SEQ ID NO: 27503 - protein, 9 aa, Artificial Sequence
  source: /note="Description of Artificial Sequence: Synthetic peptide"
RRKISNWSL

SEQ ID NO: 27504 - protein, 9 aa, Artificial Sequence
  source: /note="Description of Artificial Sequence: Synthetic peptide"
RKISNWSLK

SEQ ID NO: 27505 - protein, 9 aa, Artificial Sequence
  source: /note="Description of Artificial Sequence: Synthetic peptide"
KVPALKKLR

SEQ ID NO: 27506 - protein, 9 aa, Artificial Sequence
  source: /note="Description of Artificial Sequence: Synthetic peptide"
HLQLKSCRR

SEQ ID NO: 27507 - protein, 9 aa, Artificial Sequence
  source: /note="Description of Artificial Sequence: Synthetic peptide"
WSLKKVPAL

SEQ ID NO: 27508 - protein, 9 aa, Artificial Sequence
  source: /note="Description of Artificial Sequence: Synthetic peptide"
RQNHLQLKS

SEQ ID NO: 27509 - protein, 9 aa, Artificial Sequence
  source: /note="Description of Artificial Sequence: Synthetic peptide"
KKVPALKKL

SEQ ID NO: 27510 - protein, 9 aa, Artificial Sequence
  source: /note="Description of Artificial Sequence: Synthetic peptide"
LKKLRSPLW

SEQ ID NO: 27511 - protein, 9 aa, Artificial Sequence
  source: /note="Description of Artificial Sequence: Synthetic peptide"
KKLRSPLWI

SEQ ID NO: 27512 - protein, 10 aa, Artificial Sequence
  source: /note="Description of Artificial Sequence: Synthetic peptide"
KISNWSLKKV

SEQ ID NO: 27513 - protein, 10 aa, Artificial Sequence
  source: /note="Description of Artificial Sequence: Synthetic peptide"
KSRQNHLQLK

SEQ ID NO: 27514 - protein, 10 aa, Artificial Sequence
  source: /note="Description of Artificial Sequence: Synthetic peptide"
SLKKVPALKK

SEQ ID NO: 27515 - protein, 10 aa, Artificial Sequence
  source: /note="Description of Artificial Sequence: Synthetic peptide"
WSLKKVPALK

SEQ ID NO: 27516 - protein, 10 aa, Artificial Sequence
  source: /note="Description of Artificial Sequence: Synthetic peptide"
KRKREKRSQK

SEQ ID NO: 27517 - protein, 10 aa, Artificial Sequence
  source: /note="Description of Artificial Sequence: Synthetic peptide"
RSQKSRQNHL

SEQ ID NO: 27518 - protein, 10 aa, Artificial Sequence
  source: /note="Description of Artificial Sequence: Synthetic peptide"
HLQLKSCRRK

SEQ ID NO: 27519 - protein, 10 aa, Artificial Sequence
  source: /note="Description of Artificial Sequence: Synthetic peptide"
RRKISNWSLK

SEQ ID NO: 27520 - protein, 10 aa, Artificial Sequence
  source: /note="Description of Artificial Sequence: Synthetic peptide"
CRRKISNWSL

SEQ ID NO: 27521 - protein, 10 aa, Artificial Sequence
  source: /note="Description of Artificial Sequence: Synthetic peptide"
NWSLKKVPAL

SEQ ID NO: 27522 - protein, 10 aa, Artificial Sequence
  source: /note="Description of Artificial Sequence: Synthetic peptide"
QKSRQNHLQL

SEQ ID NO: 27523 - protein, 10 aa, Artificial Sequence
  source: /note="Description of Artificial Sequence: Synthetic peptide"
RQNHLQLKSC

SEQ ID NO: 27524 - protein, 10 aa, Artificial Sequence
  source: /note="Description of Artificial Sequence: Synthetic peptide"
LQLKSCRRKI

SEQ ID NO: 27525 - protein, 10 aa, Artificial Sequence
  source: /note="Description of Artificial Sequence: Synthetic peptide"
ALKKLRSPLW

SEQ ID NO: 27526 - protein, 10 aa, Artificial Sequence
  source: /note="Description of Artificial Sequence: Synthetic peptide"
KKLRSPLWIF

SEQ ID NO: 27527 - protein, 9 aa, Artificial Sequence
  source: /note="Description of Artificial Sequence: Synthetic peptide"
LQARIAHQI

SEQ ID NO: 27528 - protein, 9 aa, Artificial Sequence
  source: /note="Description of Artificial Sequence: Synthetic peptide"
RIAHQIQEL

SEQ ID NO: 27529 - protein, 9 aa, Artificial Sequence
  source: /note="Description of Artificial Sequence: Synthetic peptide"
HQIQELENL

SEQ ID NO: 27530 - protein, 10 aa, Artificial Sequence
  source: /note="Description of Artificial Sequence: Synthetic peptide"
RLQARIAHQI

SEQ ID NO: 27531 - protein, 10 aa, Artificial Sequence
  source: /note="Description of Artificial Sequence: Synthetic peptide"
ARIAHQIQEL

SEQ ID NO: 27532 - protein, 9 aa, Artificial Sequence
  source: /note="Description of Artificial Sequence: Synthetic peptide"
RLLLTGTLL

SEQ ID NO: 27533 - protein, 9 aa, Artificial Sequence
  source: /note="Description of Artificial Sequence: Synthetic peptide"
LLQNKLPEL

SEQ ID NO: 27534 - protein, 9 aa, Artificial Sequence
  source: /note="Description of Artificial Sequence: Synthetic peptide"
LTGTLLQNK

SEQ ID NO: 27535 - protein, 9 aa, Artificial Sequence
  source: /note="Description of Artificial Sequence: Synthetic peptide"
RRLLLTGTL

SEQ ID NO: 27536 - protein, 10 aa, Artificial Sequence
  source: /note="Description of Artificial Sequence: Synthetic peptide"
TLLQNKLPEL

SEQ ID NO: 27537 - protein, 10 aa, Artificial Sequence
  source: /note="Description of Artificial Sequence: Synthetic peptide"
LLTGTLLQNK

SEQ ID NO: 27538 - protein, 10 aa, Artificial Sequence
  source: /note="Description of Artificial Sequence: Synthetic peptide"
RRLLLTGTLL

SEQ ID NO: 27539 - protein, 9 aa, Artificial Sequence
  source: /note="Description of Artificial Sequence: Synthetic peptide"
APKQPMFAL

SEQ ID NO: 27540 - protein, 9 aa, Artificial Sequence
  source: /note="Description of Artificial Sequence: Synthetic peptide"
LLTAPKQPM

SEQ ID NO: 27541 - protein, 9 aa, Artificial Sequence
  source: /note="Description of Artificial Sequence: Synthetic peptide"
LTAPKQPMF

SEQ ID NO: 27542 - protein, 9 aa, Artificial Sequence
  source: /note="Description of Artificial Sequence: Synthetic peptide"
KQPMFALDL

SEQ ID NO: 27543 - protein, 9 aa, Artificial Sequence
  source: /note="Description of Artificial Sequence: Synthetic peptide"
LDLKTLHRM

SEQ ID NO: 27544 - protein, 10 aa, Artificial Sequence
  source: /note="Description of Artificial Sequence: Synthetic peptide"
KQPMFALDLK

SEQ ID NO: 27545 - protein, 10 aa, Artificial Sequence
  source: /note="Description of Artificial Sequence: Synthetic peptide"
LTAPKQPMFA

SEQ ID NO: 27546 - protein, 10 aa, Artificial Sequence
  source: /note="Description of Artificial Sequence: Synthetic peptide"
FALDLKTLHR

SEQ ID NO: 27547 - protein, 10 aa, Artificial Sequence
  source: /note="Description of Artificial Sequence: Synthetic peptide"
TAPKQPMFAL

SEQ ID NO: 27548 - protein, 10 aa, Artificial Sequence
  source: /note="Description of Artificial Sequence: Synthetic peptide"
LLTAPKQPMF

SEQ ID NO: 27549 - protein, 10 aa, Artificial Sequence
  source: /note="Description of Artificial Sequence: Synthetic peptide"
PMFALDLKTL

SEQ ID NO: 27550 - protein, 10 aa, Artificial Sequence
  source: /note="Description of Artificial Sequence: Synthetic peptide"
QEEDEELLTA

SEQ ID NO: 27551 - protein, 9 aa, Artificial Sequence
  source: /note="Description of Artificial Sequence: Synthetic peptide"
KLQQCNTEL

SEQ ID NO: 27552 - protein, 10 aa, Artificial Sequence
  source: /note="Description of Artificial Sequence: Synthetic peptide"
KLQQCNTELK

SEQ ID NO: 27553 - protein, 10 aa, Artificial Sequence
  source: /note="Description of Artificial Sequence: Synthetic peptide"
QQCNTELKKY

SEQ ID NO: 27554 - protein, 10 aa, Artificial Sequence
  source: /note="Description of Artificial Sequence: Synthetic peptide"
RKLQQCNTEL

SEQ ID NO: 27555 - protein, 9 aa, Artificial Sequence
  source: /note="Description of Artificial Sequence: Synthetic peptide"
ELSAKFSRA

SEQ ID NO: 27556 - protein, 9 aa, Artificial Sequence
  source: /note="Description of Artificial Sequence: Synthetic peptide"
QQFQELSAK

SEQ ID NO: 27557 - protein, 9 aa, Artificial Sequence
  source: /note="Description of Artificial Sequence: Synthetic peptide"
QFQELSAKF

SEQ ID NO: 27558 - protein, 9 aa, Artificial Sequence
  source: /note="Description of Artificial Sequence: Synthetic peptide"
AKFSRASEC

SEQ ID NO: 27559 - protein, 10 aa, Artificial Sequence
  source: /note="Description of Artificial Sequence: Synthetic peptide"
MQQFQELSAK

SEQ ID NO: 27560 - protein, 10 aa, Artificial Sequence
  source: /note="Description of Artificial Sequence: Synthetic peptide"
KFSRASECLK

SEQ ID NO: 27561 - protein, 10 aa, Artificial Sequence
  source: /note="Description of Artificial Sequence: Synthetic peptide"
QQFQELSAKF

SEQ ID NO: 27562 - protein, 10 aa, Artificial Sequence
  source: /note="Description of Artificial Sequence: Synthetic peptide"
AKFSRASECL

SEQ ID NO: 27563 - protein, 10 aa, Artificial Sequence
  source: /note="Description of Artificial Sequence: Synthetic peptide"
QELSAKFSRA

SEQ ID NO: 27564 - protein, 9 aa, Artificial Sequence
  source: /note="Description of Artificial Sequence: Synthetic peptide"
YAPQPHPTV

SEQ ID NO: 27565 - protein, 9 aa, Artificial Sequence
  source: /note="Description of Artificial Sequence: Synthetic peptide"
APQPHPTVC

SEQ ID NO: 27566 - protein, 9 aa, Artificial Sequence
  source: /note="Description of Artificial Sequence: Synthetic peptide"
QPHPTVCQF

SEQ ID NO: 27567 - protein, 9 aa, Artificial Sequence
  source: /note="Description of Artificial Sequence: Synthetic peptide"
MQYAPQPHP

SEQ ID NO: 27568 - protein, 10 aa, Artificial Sequence
  source: /note="Description of Artificial Sequence: Synthetic peptide"
QYAPQPHPTV

SEQ ID NO: 27569 - protein, 10 aa, Artificial Sequence
  source: /note="Description of Artificial Sequence: Synthetic peptide"
YEMQYAPQPH

SEQ ID NO: 27570 - protein, 10 aa, Artificial Sequence
  source: /note="Description of Artificial Sequence: Synthetic peptide"
MQYAPQPHPT

SEQ ID NO: 27571 - protein, 10 aa, Artificial Sequence
  source: /note="Description of Artificial Sequence: Synthetic peptide"
HPTVCQFITA

SEQ ID NO: 27572 - protein, 10 aa, Artificial Sequence
  source: /note="Description of Artificial Sequence: Synthetic peptide"
QPHPTVCQFI

SEQ ID NO: 27573 - protein, 9 aa, Artificial Sequence
  source: /note="Description of Artificial Sequence: Synthetic peptide"
NEAFSHGAI

SEQ ID NO: 27574 - protein, 10 aa, Artificial Sequence
  source: /note="Description of Artificial Sequence: Synthetic peptide"
QPLEKKNEAF

SEQ ID NO: 27575 - protein, 10 aa, Artificial Sequence
  source: /note="Description of Artificial Sequence: Synthetic peptide"
KKNEAFSHGA

SEQ ID NO: 27576 - protein, 9 aa, Artificial Sequence
  source: /note="Description of Artificial Sequence: Synthetic peptide"
LIKDDFLTI

SEQ ID NO: 27577 - protein, 9 aa, Artificial Sequence
  source: /note="Description of Artificial Sequence: Synthetic peptide"
IKDDFLTIL

SEQ ID NO: 27578 - protein, 10 aa, Artificial Sequence
  source: /note="Description of Artificial Sequence: Synthetic peptide"
SLIKDDFLTI

SEQ ID NO: 27579 - protein, 10 aa, Artificial Sequence
  source: /note="Description of Artificial Sequence: Synthetic peptide"
ALSLIKDDFL

SEQ ID NO: 27580 - protein, 10 aa, Artificial Sequence
  source: /note="Description of Artificial Sequence: Synthetic peptide"
LIKDDFLTIL

SEQ ID NO: 27581 - protein, 9 aa, Artificial Sequence
  source: /note="Description of Artificial Sequence: Synthetic peptide"
TPQPPRRPS

SEQ ID NO: 27582 - protein, 10 aa, Artificial Sequence
  source: /note="Description of Artificial Sequence: Synthetic peptide"
TPQPPRRPST

SEQ ID NO: 27583 - protein, 9 aa, Artificial Sequence
  source: /note="Description of Artificial Sequence: Synthetic peptide"
AIIVRGEPR

SEQ ID NO: 27584 - protein, 10 aa, Artificial Sequence
  source: /note="Description of Artificial Sequence: Synthetic peptide"
CAIIVRGEPR

SEQ ID NO: 27585 - protein, 9 aa, Artificial Sequence
  source: /note="Description of Artificial Sequence: Synthetic peptide"
RNDIASHPL

SEQ ID NO: 27586 - protein, 10 aa, Artificial Sequence
  source: /note="Description of Artificial Sequence: Synthetic peptide"
MRNDIASHPL

SEQ ID NO: 27587 - protein, 10 aa, Artificial Sequence
  source: /note="Description of Artificial Sequence: Synthetic peptide"
AEAEELKPFL

SEQ ID NO: 27588 - protein, 9 aa, Artificial Sequence
  source: /note="Description of Artificial Sequence: Synthetic peptide"
GLHPRHAYS

SEQ ID NO: 27589 - protein, 9 aa, Artificial Sequence
  source: /note="Description of Artificial Sequence: Synthetic peptide"
LGLHPRHAY

SEQ ID NO: 27590 - protein, 9 aa, Artificial Sequence
  source: /note="Description of Artificial Sequence: Synthetic peptide"
HPRHAYSIL

SEQ ID NO: 27591 - protein, 9 aa, Artificial Sequence
  source: /note="Description of Artificial Sequence: Synthetic peptide"
SAYESLGLH

SEQ ID NO: 27592 - protein, 9 aa, Artificial Sequence
  source: /note="Description of Artificial Sequence: Synthetic peptide"
YESLGLHPR

SEQ ID NO: 27593 - protein, 10 aa, Artificial Sequence
  source: /note="Description of Artificial Sequence: Synthetic peptide"
GLHPRHAYSI

SEQ ID NO: 27594 - protein, 10 aa, Artificial Sequence
  source: /note="Description of Artificial Sequence: Synthetic peptide"
SLGLHPRHAY

SEQ ID NO: 27595 - protein, 10 aa, Artificial Sequence
  source: /note="Description of Artificial Sequence: Synthetic peptide"
YESLGLHPRH

SEQ ID NO: 27596 - protein, 9 aa, Artificial Sequence
  source: /note="Description of Artificial Sequence: Synthetic peptide"
GLKSPDPYR

SEQ ID NO: 27597 - protein, 9 aa, Artificial Sequence
  source: /note="Description of Artificial Sequence: Synthetic peptide"
LGLKSPDPY

SEQ ID NO: 27598 - protein, 9 aa, Artificial Sequence
  source: /note="Description of Artificial Sequence: Synthetic peptide"
TQDSAMLGL

SEQ ID NO: 27599 - protein, 9 aa, Artificial Sequence
  source: /note="Description of Artificial Sequence: Synthetic peptide"
LKSPDPYRL

SEQ ID NO: 27600 - protein, 10 aa, Artificial Sequence
  source: /note="Description of Artificial Sequence: Synthetic peptide"
GLKSPDPYRL

SEQ ID NO: 27601 - protein, 10 aa, Artificial Sequence
  source: /note="Description of Artificial Sequence: Synthetic peptide"
TQDSAMLGLK

SEQ ID NO: 27602 - protein, 10 aa, Artificial Sequence
  source: /note="Description of Artificial Sequence: Synthetic peptide"
MLGLKSPDPY

SEQ ID NO: 27603 - protein, 10 aa, Artificial Sequence
  source: /note="Description of Artificial Sequence: Synthetic peptide"
STQDSAMLGL

SEQ ID NO: 27604 - protein, 9 aa, Artificial Sequence
  source: /note="Description of Artificial Sequence: Synthetic peptide"
AMAVLESST

SEQ ID NO: 27605 - protein, 9 aa, Artificial Sequence
  source: /note="Description of Artificial Sequence: Synthetic peptide"
MAVLESSTV

SEQ ID NO: 27606 - protein, 10 aa, Artificial Sequence
  source: /note="Description of Artificial Sequence: Synthetic peptide"
AMAVLESSTV

SEQ ID NO: 27607 - protein, 10 aa, Artificial Sequence
  source: /note="Description of Artificial Sequence: Synthetic peptide"
AVLESSTVTV

SEQ ID NO: 27608 - protein, 9 aa, Artificial Sequence
  source: /note="Description of Artificial Sequence: Synthetic peptide"
KNEPWYKLF

SEQ ID NO: 27609 - protein, 9 aa, Artificial Sequence
  source: /note="Description of Artificial Sequence: Synthetic peptide"
PWYKLFSEL

SEQ ID NO: 27610 - protein, 9 aa, Artificial Sequence
  source: /note="Description of Artificial Sequence: Synthetic peptide"
LKNEPWYKL

SEQ ID NO: 27611 - protein, 9 aa, Artificial Sequence
  source: /note="Description of Artificial Sequence: Synthetic peptide"
YKLFSELEF

SEQ ID NO: 27612 - protein, 10 aa, Artificial Sequence
  source: /note="Description of Artificial Sequence: Synthetic peptide"
KLFSELEFGK

SEQ ID NO: 27613 - protein, 10 aa, Artificial Sequence
  source: /note="Description of Artificial Sequence: Synthetic peptide"
WYKLFSELEF

SEQ ID NO: 27614 - protein, 10 aa, Artificial Sequence
  source: /note="Description of Artificial Sequence: Synthetic peptide"
EPWYKLFSEL

SEQ ID NO: 27615 - protein, 10 aa, Artificial Sequence
  source: /note="Description of Artificial Sequence: Synthetic peptide"
LKNEPWYKLF

SEQ ID NO: 27616 - protein, 9 aa, Artificial Sequence
  source: /note="Description of Artificial Sequence: Synthetic peptide"
CLKPSDMVR

SEQ ID NO: 27617 - protein, 9 aa, Artificial Sequence
  source: /note="Description of Artificial Sequence: Synthetic peptide"
KPSDMVRCL

SEQ ID NO: 27618 - protein, 10 aa, Artificial Sequence
  source: /note="Description of Artificial Sequence: Synthetic peptide"
MVRCLSTEQR

SEQ ID NO: 27619 - protein, 10 aa, Artificial Sequence
  source: /note="Description of Artificial Sequence: Synthetic peptide"
KKSCLKPSDM

SEQ ID NO: 27620 - protein, 9 aa, Artificial Sequence
  source: /note="Description of Artificial Sequence: Synthetic peptide"
RGSLSDNSI

SEQ ID NO: 27621 - protein, 10 aa, Artificial Sequence
  source: /note="Description of Artificial Sequence: Synthetic peptide"
LSDNSILHRL

SEQ ID NO: 27622 - protein, 10 aa, Artificial Sequence
  source: /note="Description of Artificial Sequence: Synthetic peptide"
SLSDNSILHR

SEQ ID NO: 27623 - protein, 10 aa, Artificial Sequence
  source: /note="Description of Artificial Sequence: Synthetic peptide"
RGSLSDNSIL

SEQ ID NO: 27624 - protein, 9 aa, Artificial Sequence
  source: /note="Description of Artificial Sequence: Synthetic peptide"
SSEKVMSLM

SEQ ID NO: 27625 - protein, 9 aa, Artificial Sequence
  source: /note="Description of Artificial Sequence: Synthetic peptide"
KMSWSSEKV

SEQ ID NO: 27626 - protein, 9 aa, Artificial Sequence
  source: /note="Description of Artificial Sequence: Synthetic peptide"
SLMSWKSVM

SEQ ID NO: 27627 - protein, 9 aa, Artificial Sequence
  source: /note="Description of Artificial Sequence: Synthetic peptide"
LMSWKSVMT

SEQ ID NO: 27628 - protein, 9 aa, Artificial Sequence
  source: /note="Description of Artificial Sequence: Synthetic peptide"
KVMSLMSWK

SEQ ID NO: 27629 - protein, 9 aa, Artificial Sequence
  source: /note="Description of Artificial Sequence: Synthetic peptide"
CITILPGMK

SEQ ID NO: 27630 - protein, 9 aa, Artificial Sequence
  source: /note="Description of Artificial Sequence: Synthetic peptide"
RFRLCITIL

SEQ ID NO: 27631 - protein, 9 aa, Artificial Sequence
  source: /note="Description of Artificial Sequence: Synthetic peptide"
ILPGMKMSW

SEQ ID NO: 27632 - protein, 9 aa, Artificial Sequence
  source: /note="Description of Artificial Sequence: Synthetic peptide"
MSLMSWKSV

SEQ ID NO: 27633 - protein, 9 aa, Artificial Sequence
  source: /note="Description of Artificial Sequence: Synthetic peptide"
MSWKSVMTA

SEQ ID NO: 27634 - protein, 9 aa, Artificial Sequence
  source: /note="Description of Artificial Sequence: Synthetic peptide"
TTSRGCELR

SEQ ID NO: 27635 - protein, 9 aa, Artificial Sequence
  source: /note="Description of Artificial Sequence: Synthetic peptide"
MTAGLWGPQ

SEQ ID NO: 27636 - protein, 9 aa, Artificial Sequence
  source: /note="Description of Artificial Sequence: Synthetic peptide"
ETTSRGCEL

SEQ ID NO: 27637 - protein, 9 aa, Artificial Sequence
  source: /note="Description of Artificial Sequence: Synthetic peptide"
GPQEEPNSL

SEQ ID NO: 27638 - protein, 9 aa, Artificial Sequence
  source: /note="Description of Artificial Sequence: Synthetic peptide"
MSWSSEKVM

SEQ ID NO: 27639 - protein, 9 aa, Artificial Sequence
  source: /note="Description of Artificial Sequence: Synthetic peptide"
NRFRLCITI

SEQ ID NO: 27640 - protein, 9 aa, Artificial Sequence
  source: /note="Description of Artificial Sequence: Synthetic peptide"
ITILPGMKM

SEQ ID NO: 27641 - protein, 9 aa, Artificial Sequence
  source: /note="Description of Artificial Sequence: Synthetic peptide"
WSSEKVMSL

SEQ ID NO: 27642 - protein, 9 aa, Artificial Sequence
  source: /note="Description of Artificial Sequence: Synthetic peptide"
EKVMSLMSW

SEQ ID NO: 27643 - protein, 9 aa, Artificial Sequence
  source: /note="Description of Artificial Sequence: Synthetic peptide"
WKSVMTAGL

SEQ ID NO: 27644 - protein, 9 aa, Artificial Sequence
  source: /note="Description of Artificial Sequence: Synthetic peptide"
KSVMTAGLW

SEQ ID NO: 27645 - protein, 9 aa, Artificial Sequence
  source: /note="Description of Artificial Sequence: Synthetic peptide"
QEEPNSLVL

SEQ ID NO: 27646 - protein, 9 aa, Artificial Sequence
  source: /note="Description of Artificial Sequence: Synthetic peptide"
SEKVMSLMS

SEQ ID NO: 27647 - protein, 10 aa, Artificial Sequence
  source: /note="Description of Artificial Sequence: Synthetic peptide"
VMSLMSWKSV

SEQ ID NO: 27648 - protein, 10 aa, Artificial Sequence
  source: /note="Description of Artificial Sequence: Synthetic peptide"
SLMSWKSVMT

SEQ ID NO: 27649 - protein, 10 aa, Artificial Sequence
  source: /note="Description of Artificial Sequence: Synthetic peptide"
LMSWKSVMTA

SEQ ID NO: 27650 - protein, 10 aa, Artificial Sequence
  source: /note="Description of Artificial Sequence: Synthetic peptide"
RLCITILPGM

SEQ ID NO: 27651 - protein, 10 aa, Artificial Sequence
  source: /note="Description of Artificial Sequence: Synthetic peptide"
GMKMSWSSEK

SEQ ID NO: 27652 - protein, 10 aa, Artificial Sequence
  source: /note="Description of Artificial Sequence: Synthetic peptide"
LVLSPETTSR

SEQ ID NO: 27653 - protein, 10 aa, Artificial Sequence
  source: /note="Description of Artificial Sequence: Synthetic peptide"
RFRLCITILP

SEQ ID NO: 27654 - protein, 10 aa, Artificial Sequence
  source: /note="Description of Artificial Sequence: Synthetic peptide"
MSLMSWKSVM

SEQ ID NO: 27655 - protein, 10 aa, Artificial Sequence
  source: /note="Description of Artificial Sequence: Synthetic peptide"
SWKSVMTAGL

SEQ ID NO: 27656 - protein, 10 aa, Artificial Sequence
  source: /note="Description of Artificial Sequence: Synthetic peptide"
NIQGGGNRFR

SEQ ID NO: 27657 - protein, 10 aa, Artificial Sequence
  source: /note="Description of Artificial Sequence: Synthetic peptide"
ETTSRGCELR

SEQ ID NO: 27658 - protein, 10 aa, Artificial Sequence
  source: /note="Description of Artificial Sequence: Synthetic peptide"
WSSEKVMSLM

SEQ ID NO: 27659 - protein, 10 aa, Artificial Sequence
  source: /note="Description of Artificial Sequence: Synthetic peptide"
KMSWSSEKVM

SEQ ID NO: 27660 - protein, 10 aa, Artificial Sequence
  source: /note="Description of Artificial Sequence: Synthetic peptide"
IQGGGNRFRL

SEQ ID NO: 27661 - protein, 10 aa, Artificial Sequence
  source: /note="Description of Artificial Sequence: Synthetic peptide"
NRFRLCITIL

SEQ ID NO: 27662 - protein, 10 aa, Artificial Sequence
  source: /note="Description of Artificial Sequence: Synthetic peptide"
MKMSWSSEKV

SEQ ID NO: 27663 - protein, 10 aa, Artificial Sequence
  source: /note="Description of Artificial Sequence: Synthetic peptide"
SEKVMSLMSW

SEQ ID NO: 27664 - protein, 10 aa, Artificial Sequence
  source: /note="Description of Artificial Sequence: Synthetic peptide"
MSWKSVMTAG

SEQ ID NO: 27665 - protein, 10 aa, Artificial Sequence
  source: /note="Description of Artificial Sequence: Synthetic peptide"
WKSVMTAGLW

SEQ ID NO: 27666 - protein, 9 aa, Artificial Sequence
  source: /note="Description of Artificial Sequence: Synthetic peptide"
DLGGDFWYV

SEQ ID NO: 27667 - protein, 9 aa, Artificial Sequence
  source: /note="Description of Artificial Sequence: Synthetic peptide"
DFWYVTCAI

SEQ ID NO: 27668 - protein, 9 aa, Artificial Sequence
  source: /note="Description of Artificial Sequence: Synthetic peptide"
GDFWYVTCA

SEQ ID NO: 27669 - protein, 10 aa, Artificial Sequence
  source: /note="Description of Artificial Sequence: Synthetic peptide"
AQDLGGDFWY

SEQ ID NO: 27670 - protein, 10 aa, Artificial Sequence
  source: /note="Description of Artificial Sequence: Synthetic peptide"
GDFWYVTCAI

SEQ ID NO: 27671 - protein, 10 aa, Artificial Sequence
  source: /note="Description of Artificial Sequence: Synthetic peptide"
EAQDLGGDFW

SEQ ID NO: 27672 - protein, 9 aa, Artificial Sequence
  source: /note="Description of Artificial Sequence: Synthetic peptide"
LQGFSIPFL

SEQ ID NO: 27673 - protein, 9 aa, Artificial Sequence
  source: /note="Description of Artificial Sequence: Synthetic peptide"
PFLAADLLL

SEQ ID NO: 27674 - protein, 9 aa, Artificial Sequence
  source: /note="Description of Artificial Sequence: Synthetic peptide"
IPFLAADLL

SEQ ID NO: 27675 - protein, 10 aa, Artificial Sequence
  source: /note="Description of Artificial Sequence: Synthetic peptide"
TLQGFSIPFL

SEQ ID NO: 27676 - protein, 10 aa, Artificial Sequence
  source: /note="Description of Artificial Sequence: Synthetic peptide"
FLAADLLLHS

SEQ ID NO: 27677 - protein, 10 aa, Artificial Sequence
  source: /note="Description of Artificial Sequence: Synthetic peptide"
LAADLLLHSK

SEQ ID NO: 27678 - protein, 10 aa, Artificial Sequence
  source: /note="Description of Artificial Sequence: Synthetic peptide"
FSIPFLAADL

SEQ ID NO: 27679 - protein, 10 aa, Artificial Sequence
  source: /note="Description of Artificial Sequence: Synthetic peptide"
IPFLAADLLL

SEQ ID NO: 27680 - protein, 9 aa, Artificial Sequence
  source: /note="Description of Artificial Sequence: Synthetic peptide"
PFVSYSKLF

SEQ ID NO: 27681 - protein, 9 aa, Artificial Sequence
  source: /note="Description of Artificial Sequence: Synthetic peptide"
VFREPFVSY

SEQ ID NO: 27682 - protein, 9 aa, Artificial Sequence
  source: /note="Description of Artificial Sequence: Synthetic peptide"
VSYSKLFSA

SEQ ID NO: 27683 - protein, 9 aa, Artificial Sequence
  source: /note="Description of Artificial Sequence: Synthetic peptide"
EPFVSYSKL

SEQ ID NO: 27684 - protein, 9 aa, Artificial Sequence
  source: /note="Description of Artificial Sequence: Synthetic peptide"
REPFVSYSK

SEQ ID NO: 27685 - protein, 10 aa, Artificial Sequence
  source: /note="Description of Artificial Sequence: Synthetic peptide"
FVSYSKLFSA

SEQ ID NO: 27686 - protein, 10 aa, Artificial Sequence
  source: /note="Description of Artificial Sequence: Synthetic peptide"
KVFREPFVSY

SEQ ID NO: 27687 - protein, 10 aa, Artificial Sequence
  source: /note="Description of Artificial Sequence: Synthetic peptide"
VFREPFVSYS

SEQ ID NO: 27688 - protein, 10 aa, Artificial Sequence
  source: /note="Description of Artificial Sequence: Synthetic peptide"
REPFVSYSKL

SEQ ID NO: 27689 - protein, 10 aa, Artificial Sequence
  source: /note="Description of Artificial Sequence: Synthetic peptide"
EPFVSYSKLF

SEQ ID NO: 27690 - protein, 10 aa, Artificial Sequence
  source: /note="Description of Artificial Sequence: Synthetic peptide"
APGAPPLVPV

SEQ ID NO: 27691 - protein, 9 aa, Artificial Sequence
  source: /note="Description of Artificial Sequence: Synthetic peptide"
VSDAISAVY

SEQ ID NO: 27692 - protein, 9 aa, Artificial Sequence
  source: /note="Description of Artificial Sequence: Synthetic peptide"
ISAVYYCNY

SEQ ID NO: 27693 - protein, 9 aa, Artificial Sequence
  source: /note="Description of Artificial Sequence: Synthetic peptide"
VVSDAISAV

SEQ ID NO: 27694 - protein, 9 aa, Artificial Sequence
  source: /note="Description of Artificial Sequence: Synthetic peptide"
ISSVVSDAI

SEQ ID NO: 27695 - protein, 9 aa, Artificial Sequence
  source: /note="Description of Artificial Sequence: Synthetic peptide"
SDAISAVYY

SEQ ID NO: 27696 - protein, 10 aa, Artificial Sequence
  source: /note="Description of Artificial Sequence: Synthetic peptide"
VVSDAISAVY

SEQ ID NO: 27697 - protein, 10 aa, Artificial Sequence
  source: /note="Description of Artificial Sequence: Synthetic peptide"
VSDAISAVYY

SEQ ID NO: 27698 - protein, 10 aa, Artificial Sequence
  source: /note="Description of Artificial Sequence: Synthetic peptide"
SVVSDAISAV

SEQ ID NO: 27699 - protein, 10 aa, Artificial Sequence
  source: /note="Description of Artificial Sequence: Synthetic peptide"
AISSVVSDAI

SEQ ID NO: 27700 - protein, 10 aa, Artificial Sequence
  source: /note="Description of Artificial Sequence: Synthetic peptide"
AISAVYYCNY

SEQ ID NO: 27701 - protein, 9 aa, Artificial Sequence
  source: /note="Description of Artificial Sequence: Synthetic peptide"
LWIGEYKQL

SEQ ID NO: 27702 - protein, 9 aa, Artificial Sequence
  source: /note="Description of Artificial Sequence: Synthetic peptide"
GKKLWIGEY

SEQ ID NO: 27703 - protein, 10 aa, Artificial Sequence
  source: /note="Description of Artificial Sequence: Synthetic peptide"
KLWIGEYKQL

SEQ ID NO: 27704 - protein, 10 aa, Artificial Sequence
  source: /note="Description of Artificial Sequence: Synthetic peptide"
LWIGEYKQLM

SEQ ID NO: 27705 - protein, 10 aa, Artificial Sequence
  source: /note="Description of Artificial Sequence: Synthetic peptide"
WIGEYKQLMR

SEQ ID NO: 27706 - protein, 9 aa, Artificial Sequence
  source: /note="Description of Artificial Sequence: Synthetic peptide"
SHPWAPWPL

SEQ ID NO: 27707 - protein, 9 aa, Artificial Sequence
  source: /note="Description of Artificial Sequence: Synthetic peptide"
SPLHCSHPW

SEQ ID NO: 27708 - protein, 9 aa, Artificial Sequence
  source: /note="Description of Artificial Sequence: Synthetic peptide"
HPWAPWPLA

SEQ ID NO: 27709 - protein, 9 aa, Artificial Sequence
  source: /note="Description of Artificial Sequence: Synthetic peptide"
HCSHPWAPW

SEQ ID NO: 27710 - protein, 9 aa, Artificial Sequence
  source: /note="Description of Artificial Sequence: Synthetic peptide"
WPLASPPAS

SEQ ID NO: 27711 - protein, 10 aa, Artificial Sequence
  source: /note="Description of Artificial Sequence: Synthetic peptide"
CSHPWAPWPL

SEQ ID NO: 27712 - protein, 10 aa, Artificial Sequence
  source: /note="Description of Artificial Sequence: Synthetic peptide"
APWPLASPPA

SEQ ID NO: 27713 - protein, 10 aa, Artificial Sequence
  source: /note="Description of Artificial Sequence: Synthetic peptide"
LHCSHPWAPW

SEQ ID NO: 27714 - protein, 10 aa, Artificial Sequence
  source: /note="Description of Artificial Sequence: Synthetic peptide"
HPWAPWPLAS

SEQ ID NO: 27715 - protein, 9 aa, Artificial Sequence
  source: /note="Description of Artificial Sequence: Synthetic peptide"
CIRKAVSQV

SEQ ID NO: 27716 - protein, 9 aa, Artificial Sequence
  source: /note="Description of Artificial Sequence: Synthetic peptide"
RKAVSQVLK

SEQ ID NO: 27717 - protein, 9 aa, Artificial Sequence
  source: /note="Description of Artificial Sequence: Synthetic peptide"
FPVCIRKAV

SEQ ID NO: 27718 - protein, 9 aa, Artificial Sequence
  source: /note="Description of Artificial Sequence: Synthetic peptide"
IRKAVSQVL

SEQ ID NO: 27719 - protein, 10 aa, Artificial Sequence
  source: /note="Description of Artificial Sequence: Synthetic peptide"
CIRKAVSQVL

SEQ ID NO: 27720 - protein, 10 aa, Artificial Sequence
  source: /note="Description of Artificial Sequence: Synthetic peptide"
IRKAVSQVLK

SEQ ID NO: 27721 - protein, 10 aa, Artificial Sequence
  source: /note="Description of Artificial Sequence: Synthetic peptide"
KAVSQVLKGY

SEQ ID NO: 27722 - protein, 10 aa, Artificial Sequence
  source: /note="Description of Artificial Sequence: Synthetic peptide"
FPVCIRKAVS

SEQ ID NO: 27723 - protein, 9 aa, Artificial Sequence
  source: /note="Description of Artificial Sequence: Synthetic peptide"
KEEEEAAAA

SEQ ID NO: 27724 - protein, 10 aa, Artificial Sequence
  source: /note="Description of Artificial Sequence: Synthetic peptide"
KEEEEAAAAA

SEQ ID NO: 27725 - protein, 9 aa, Artificial Sequence
  source: /note="Description of Artificial Sequence: Synthetic peptide"
KEEEEAAAA

SEQ ID NO: 27726 - protein, 10 aa, Artificial Sequence
  source: /note="Description of Artificial Sequence: Synthetic peptide"
KEEEEAAAAA

SEQ ID NO: 27727 - protein, 9 aa, Artificial Sequence
  source: /note="Description of Artificial Sequence: Synthetic peptide"
ALWSCTWHS

SEQ ID NO: 27728 - protein, 9 aa, Artificial Sequence
  source: /note="Description of Artificial Sequence: Synthetic peptide"
HSRALWSCT

SEQ ID NO: 27729 - protein, 9 aa, Artificial Sequence
  source: /note="Description of Artificial Sequence: Synthetic peptide"
FEGHSRALW

SEQ ID NO: 27730 - protein, 9 aa, Artificial Sequence
  source: /note="Description of Artificial Sequence: Synthetic peptide"
SRALWSCTW

SEQ ID NO: 27731 - protein, 9 aa, Artificial Sequence
  source: /note="Description of Artificial Sequence: Synthetic peptide"
RALWSCTWH

SEQ ID NO: 27732 - protein, 10 aa, Artificial Sequence
  source: /note="Description of Artificial Sequence: Synthetic peptide"
ALWSCTWHSC

SEQ ID NO: 27733 - protein, 10 aa, Artificial Sequence
  source: /note="Description of Artificial Sequence: Synthetic peptide"
LTFEGHSRAL

SEQ ID NO: 27734 - protein, 10 aa, Artificial Sequence
  source: /note="Description of Artificial Sequence: Synthetic peptide"
TFEGHSRALW

SEQ ID NO: 27735 - protein, 10 aa, Artificial Sequence
  source: /note="Description of Artificial Sequence: Synthetic peptide"
HSRALWSCTW

SEQ ID NO: 27736 - protein, 9 aa, Artificial Sequence
  source: /note="Description of Artificial Sequence: Synthetic peptide"
EFFSFSNTL

SEQ ID NO: 27737 - protein, 9 aa, Artificial Sequence
  source: /note="Description of Artificial Sequence: Synthetic peptide"
NSIEFFSFS

SEQ ID NO: 27738 - protein, 9 aa, Artificial Sequence
  source: /note="Description of Artificial Sequence: Synthetic peptide"
VNSIEFFSF

SEQ ID NO: 27739 - protein, 9 aa, Artificial Sequence
  source: /note="Description of Artificial Sequence: Synthetic peptide"
IEFFSFSNT

SEQ ID NO: 27740 - protein, 9 aa, Artificial Sequence
  source: /note="Description of Artificial Sequence: Synthetic peptide"
FSFSNTLLT

SEQ ID NO: 27741 - protein, 10 aa, Artificial Sequence
  source: /note="Description of Artificial Sequence: Synthetic peptide"
SVNSIEFFSF

SEQ ID NO: 27742 - protein, 10 aa, Artificial Sequence
  source: /note="Description of Artificial Sequence: Synthetic peptide"
EFFSFSNTLL

SEQ ID NO: 27743 - protein, 10 aa, Artificial Sequence
  source: /note="Description of Artificial Sequence: Synthetic peptide"
IEFFSFSNTL

SEQ ID NO: 27744 - protein, 10 aa, Artificial Sequence
  source: /note="Description of Artificial Sequence: Synthetic peptide"
FSFSNTLLTS

SEQ ID NO: 27745 - protein, 9 aa, Artificial Sequence
  source: /note="Description of Artificial Sequence: Synthetic peptide"
IMVRQSYPR

SEQ ID NO: 27746 - protein, 9 aa, Artificial Sequence
  source: /note="Description of Artificial Sequence: Synthetic peptide"
MVRQSYPRG

SEQ ID NO: 27747 - protein, 10 aa, Artificial Sequence
  source: /note="Description of Artificial Sequence: Synthetic peptide"
DIMVRQSYPR

SEQ ID NO: 27748 - protein, 9 aa, Artificial Sequence
  source: /note="Description of Artificial Sequence: Synthetic peptide"
IMQSMKSCL

SEQ ID NO: 27749 - protein, 9 aa, Artificial Sequence
  source: /note="Description of Artificial Sequence: Synthetic peptide"
MQSMKSCLL

SEQ ID NO: 27750 - protein, 9 aa, Artificial Sequence
  source: /note="Description of Artificial Sequence: Synthetic peptide"
TLSIMQSMK

SEQ ID NO: 27751 - protein, 9 aa, Artificial Sequence
  source: /note="Description of Artificial Sequence: Synthetic peptide"
GTLSIMQSM

SEQ ID NO: 27752 - protein, 9 aa, Artificial Sequence
  source: /note="Description of Artificial Sequence: Synthetic peptide"
QSMKSCLLL

SEQ ID NO: 27753 - protein, 10 aa, Artificial Sequence
  source: /note="Description of Artificial Sequence: Synthetic peptide"
IMQSMKSCLL

SEQ ID NO: 27754 - protein, 10 aa, Artificial Sequence
  source: /note="Description of Artificial Sequence: Synthetic peptide"
SIMQSMKSCL

SEQ ID NO: 27755 - protein, 10 aa, Artificial Sequence
  source: /note="Description of Artificial Sequence: Synthetic peptide"
MQSMKSCLLL

SEQ ID NO: 27756 - protein, 10 aa, Artificial Sequence
  source: /note="Description of Artificial Sequence: Synthetic peptide"
GTLSIMQSMK

SEQ ID NO: 27757 - protein, 10 aa, Artificial Sequence
  source: /note="Description of Artificial Sequence: Synthetic peptide"
WGTLSIMQSM

SEQ ID NO: 27758 - protein, 9 aa, Artificial Sequence
  source: /note="Description of Artificial Sequence: Synthetic peptide"
FLGKKQYQL

SEQ ID NO: 27759 - protein, 9 aa, Artificial Sequence
  source: /note="Description of Artificial Sequence: Synthetic peptide"
KWWRSFLGK

SEQ ID NO: 27760 - protein, 9 aa, Artificial Sequence
  source: /note="Description of Artificial Sequence: Synthetic peptide"
WWRSFLGKK

SEQ ID NO: 27761 - protein, 9 aa, Artificial Sequence
  source: /note="Description of Artificial Sequence: Synthetic peptide"
RSFLGKKQY

SEQ ID NO: 27762 - protein, 9 aa, Artificial Sequence
  source: /note="Description of Artificial Sequence: Synthetic peptide"
GKKQYQLTV

SEQ ID NO: 27763 - protein, 10 aa, Artificial Sequence
  source: /note="Description of Artificial Sequence: Synthetic peptide"
FLGKKQYQLT

SEQ ID NO: 27764 - protein, 10 aa, Artificial Sequence
  source: /note="Description of Artificial Sequence: Synthetic peptide"
SFLGKKQYQL

SEQ ID NO: 27765 - protein, 10 aa, Artificial Sequence
  source: /note="Description of Artificial Sequence: Synthetic peptide"
KWWRSFLGKK

SEQ ID NO: 27766 - protein, 10 aa, Artificial Sequence
  source: /note="Description of Artificial Sequence: Synthetic peptide"
WRSFLGKKQY

SEQ ID NO: 27767 - protein, 10 aa, Artificial Sequence
  source: /note="Description of Artificial Sequence: Synthetic peptide"
KKQYQLTVQV

SEQ ID NO: 27768 - protein, 9 aa, Artificial Sequence
  source: /note="Description of Artificial Sequence: Synthetic peptide"
VSSVAQQQK

SEQ ID NO: 27769 - protein, 10 aa, Artificial Sequence
  source: /note="Description of Artificial Sequence: Synthetic peptide"
SVAQQQKQLR

SEQ ID NO: 27770 - protein, 10 aa, Artificial Sequence
  source: /note="Description of Artificial Sequence: Synthetic peptide"
GKNSCPVSSV

SEQ ID NO: 27771 - protein, 9 aa, Artificial Sequence
  source: /note="Description of Artificial Sequence: Synthetic peptide"
LAAETCFFL

SEQ ID NO: 27772 - protein, 9 aa, Artificial Sequence
  source: /note="Description of Artificial Sequence: Synthetic peptide"
LILETSAQK

SEQ ID NO: 27773 - protein, 9 aa, Artificial Sequence
  source: /note="Description of Artificial Sequence: Synthetic peptide"
KLLCWLCKK

SEQ ID NO: 27774 - protein, 9 aa, Artificial Sequence
  source: /note="Description of Artificial Sequence: Synthetic peptide"
ETCFFLELI

SEQ ID NO: 27775 - protein, 9 aa, Artificial Sequence
  source: /note="Description of Artificial Sequence: Synthetic peptide"
AETCFFLEL

SEQ ID NO: 27776 - protein, 9 aa, Artificial Sequence
  source: /note="Description of Artificial Sequence: Synthetic peptide"
LETSAQKLL

SEQ ID NO: 27777 - protein, 9 aa, Artificial Sequence
  source: /note="Description of Artificial Sequence: Synthetic peptide"
LELILETSA

SEQ ID NO: 27778 - protein, 10 aa, Artificial Sequence
  source: /note="Description of Artificial Sequence: Synthetic peptide"
NLAAETCFFL

SEQ ID NO: 27779 - protein, 10 aa, Artificial Sequence
  source: /note="Description of Artificial Sequence: Synthetic peptide"
FLELILETSA

SEQ ID NO: 27780 - protein, 10 aa, Artificial Sequence
  source: /note="Description of Artificial Sequence: Synthetic peptide"
LILETSAQKL

SEQ ID NO: 27781 - protein, 10 aa, Artificial Sequence
  source: /note="Description of Artificial Sequence: Synthetic peptide"
KLLCWLCKKM

SEQ ID NO: 27782 - protein, 10 aa, Artificial Sequence
  source: /note="Description of Artificial Sequence: Synthetic peptide"
AQKLLCWLCK

SEQ ID NO: 27783 - protein, 10 aa, Artificial Sequence
  source: /note="Description of Artificial Sequence: Synthetic peptide"
ETCFFLELIL

SEQ ID NO: 27784 - protein, 10 aa, Artificial Sequence
  source: /note="Description of Artificial Sequence: Synthetic peptide"
AETCFFLELI

SEQ ID NO: 27785 - protein, 9 aa, Artificial Sequence
  source: /note="Description of Artificial Sequence: Synthetic peptide"
FRKAFSEPV

SEQ ID NO: 27786 - protein, 9 aa, Artificial Sequence
  source: /note="Description of Artificial Sequence: Synthetic peptide"
EESENFRKA

SEQ ID NO: 27787 - protein, 10 aa, Artificial Sequence
  source: /note="Description of Artificial Sequence: Synthetic peptide"
NFRKAFSEPV

SEQ ID NO: 27788 - protein, 10 aa, Artificial Sequence
  source: /note="Description of Artificial Sequence: Synthetic peptide"
RQNREESENF

SEQ ID NO: 27789 - protein, 10 aa, Artificial Sequence
  source: /note="Description of Artificial Sequence: Synthetic peptide"
EESENFRKAF

SEQ ID NO: 27790 - protein, 10 aa, Artificial Sequence
  source: /note="Description of Artificial Sequence: Synthetic peptide"
FRKAFSEPVL

SEQ ID NO: 27791 - protein, 10 aa, Artificial Sequence
  source: /note="Description of Artificial Sequence: Synthetic peptide"
REESENFRKA

SEQ ID NO: 27792 - protein, 9 aa, Artificial Sequence
  source: /note="Description of Artificial Sequence: Synthetic peptide"
YTCKVVNEY

SEQ ID NO: 27793 - protein, 9 aa, Artificial Sequence
  source: /note="Description of Artificial Sequence: Synthetic peptide"
DAGFYTCKV

SEQ ID NO: 27794 - protein, 10 aa, Artificial Sequence
  source: /note="Description of Artificial Sequence: Synthetic peptide"
FYTCKVVNEY

SEQ ID NO: 27795 - protein, 9 aa, Artificial Sequence
  source: /note="Description of Artificial Sequence: Synthetic peptide"
FECLVAGAH

SEQ ID NO: 27796 - protein, 10 aa, Artificial Sequence
  source: /note="Description of Artificial Sequence: Synthetic peptide"
ALFECLVAGA

SEQ ID NO: 27797 - protein, 10 aa, Artificial Sequence
  source: /note="Description of Artificial Sequence: Synthetic peptide"
TLNTEGKSGK

SEQ ID NO: 27798 - protein, 9 aa, Artificial Sequence
  source: /note="Description of Artificial Sequence: Synthetic peptide"
KKHTESTPL

SEQ ID NO: 27799 - protein, 9 aa, Artificial Sequence
  source: /note="Description of Artificial Sequence: Synthetic peptide"
KHTESTPLW

SEQ ID NO: 27800 - protein, 9 aa, Artificial Sequence
  source: /note="Description of Artificial Sequence: Synthetic peptide"
TESTPLWSI

SEQ ID NO: 27801 - protein, 10 aa, Artificial Sequence
  source: /note="Description of Artificial Sequence: Synthetic peptide"
KKKHTESTPL

SEQ ID NO: 27802 - protein, 10 aa, Artificial Sequence
  source: /note="Description of Artificial Sequence: Synthetic peptide"
KKHTESTPLW

SEQ ID NO: 27803 - protein, 9 aa, Artificial Sequence
  source: /note="Description of Artificial Sequence: Synthetic peptide"
IPNGVQIFL

SEQ ID NO: 27804 - protein, 10 aa, Artificial Sequence
  source: /note="Description of Artificial Sequence: Synthetic peptide"
LIPNGVQIFL

SEQ ID NO: 27805 - protein, 9 aa, Artificial Sequence
  source: /note="Description of Artificial Sequence: Synthetic peptide"
KDEWRGVVL

SEQ ID NO: 27806 - protein, 9 aa, Artificial Sequence
  source: /note="Description of Artificial Sequence: Synthetic peptide"
VVLAQAPIM

SEQ ID NO: 27807 - protein, 9 aa, Artificial Sequence
  source: /note="Description of Artificial Sequence: Synthetic peptide"
DEWRGVVLA

SEQ ID NO: 27808 - protein, 10 aa, Artificial Sequence
  source: /note="Description of Artificial Sequence: Synthetic peptide"
VVLAQAPIMK

SEQ ID NO: 27809 - protein, 10 aa, Artificial Sequence
  source: /note="Description of Artificial Sequence: Synthetic peptide"
SKDEWRGVVL

SEQ ID NO: 27810 - protein, 10 aa, Artificial Sequence
  source: /note="Description of Artificial Sequence: Synthetic peptide"
RGVVLAQAPI

SEQ ID NO: 27811 - protein, 10 aa, Artificial Sequence
  source: /note="Description of Artificial Sequence: Synthetic peptide"
DEWRGVVLAQ

SEQ ID NO: 27812 - protein, 9 aa, Artificial Sequence
  source: /note="Description of Artificial Sequence: Synthetic peptide"
YMYTLLDDC

SEQ ID NO: 27813 - protein, 10 aa, Artificial Sequence
  source: /note="Description of Artificial Sequence: Synthetic peptide"
YMYTLLDDCK

SEQ ID NO: 27814 - protein, 9 aa, Artificial Sequence
  source: /note="Description of Artificial Sequence: Synthetic peptide"
VTFPQGPSM

SEQ ID NO: 27815 - protein, 9 aa, Artificial Sequence
  source: /note="Description of Artificial Sequence: Synthetic peptide"
GSSGAQVTF

SEQ ID NO: 27816 - protein, 10 aa, Artificial Sequence
  source: /note="Description of Artificial Sequence: Synthetic peptide"
RGSSGAQVTF

SEQ ID NO: 27817 - protein, 10 aa, Artificial Sequence
  source: /note="Description of Artificial Sequence: Synthetic peptide"
AQVTFPQGPS

SEQ ID NO: 27818 - protein, 9 aa, Artificial Sequence
  source: /note="Description of Artificial Sequence: Synthetic peptide"
KVIKSSTFS

SEQ ID NO: 27819 - protein, 9 aa, Artificial Sequence
  source: /note="Description of Artificial Sequence: Synthetic peptide"
GKVIKSSTF

SEQ ID NO: 27820 - protein, 10 aa, Artificial Sequence
  source: /note="Description of Artificial Sequence: Synthetic peptide"
FSFCREEMGK

SEQ ID NO: 27821 - protein, 10 aa, Artificial Sequence
  source: /note="Description of Artificial Sequence: Synthetic peptide"
MGKVIKSSTF

SEQ ID NO: 27822 - protein, 9 aa, Artificial Sequence
  source: /note="Description of Artificial Sequence: Synthetic peptide"
KSEVRAKVK

SEQ ID NO: 27823 - protein, 9 aa, Artificial Sequence
  source: /note="Description of Artificial Sequence: Synthetic peptide"
RAKVKFSIL

SEQ ID NO: 27824 - protein, 9 aa, Artificial Sequence
  source: /note="Description of Artificial Sequence: Synthetic peptide"
KVKFSILNA

SEQ ID NO: 27825 - protein, 9 aa, Artificial Sequence
  source: /note="Description of Artificial Sequence: Synthetic peptide"
SEVRAKVKF

SEQ ID NO: 27826 - protein, 10 aa, Artificial Sequence
  source: /note="Description of Artificial Sequence: Synthetic peptide"
KVKFSILNAK

SEQ ID NO: 27827 - protein, 10 aa, Artificial Sequence
  source: /note="Description of Artificial Sequence: Synthetic peptide"
RAKVKFSILN

SEQ ID NO: 27828 - protein, 10 aa, Artificial Sequence
  source: /note="Description of Artificial Sequence: Synthetic peptide"
EVRAKVKFSI

SEQ ID NO: 27829 - protein, 10 aa, Artificial Sequence
  source: /note="Description of Artificial Sequence: Synthetic peptide"
KSEVRAKVKF

SEQ ID NO: 27830 - protein, 10 aa, Artificial Sequence
  source: /note="Description of Artificial Sequence: Synthetic peptide"
VRAKVKFSIL

SEQ ID NO: 27831 - protein, 10 aa, Artificial Sequence
  source: /note="Description of Artificial Sequence: Synthetic peptide"
AKVKFSILNA

SEQ ID NO: 27832 - protein, 10 aa, Artificial Sequence
  source: /note="Description of Artificial Sequence: Synthetic peptide"
CPKSEVRAKV

SEQ ID NO: 27833 - protein, 9 aa, Artificial Sequence
  source: /note="Description of Artificial Sequence: Synthetic peptide"
KSEVRAKCK

SEQ ID NO: 27834 - protein, 9 aa, Artificial Sequence
  source: /note="Description of Artificial Sequence: Synthetic peptide"
RAKCKFSIL

SEQ ID NO: 27835 - protein, 9 aa, Artificial Sequence
  source: /note="Description of Artificial Sequence: Synthetic peptide"
KCKFSILNA

SEQ ID NO: 27836 - protein, 9 aa, Artificial Sequence
  source: /note="Description of Artificial Sequence: Synthetic peptide"
SEVRAKCKF

SEQ ID NO: 27837 - protein, 10 aa, Artificial Sequence
  source: /note="Description of Artificial Sequence: Synthetic peptide"
RAKCKFSILN

SEQ ID NO: 27838 - protein, 10 aa, Artificial Sequence
  source: /note="Description of Artificial Sequence: Synthetic peptide"
KCKFSILNAK

SEQ ID NO: 27839 - protein, 10 aa, Artificial Sequence
  source: /note="Description of Artificial Sequence: Synthetic peptide"
EVRAKCKFSI

SEQ ID NO: 27840 - protein, 10 aa, Artificial Sequence
  source: /note="Description of Artificial Sequence: Synthetic peptide"
KSEVRAKCKF

SEQ ID NO: 27841 - protein, 10 aa, Artificial Sequence
  source: /note="Description of Artificial Sequence: Synthetic peptide"
VRAKCKFSIL

SEQ ID NO: 27842 - protein, 9 aa, Artificial Sequence
  source: /note="Description of Artificial Sequence: Synthetic peptide"
QGKDGGFKK

SEQ ID NO: 27843 - protein, 9 aa, Artificial Sequence
  source: /note="Description of Artificial Sequence: Synthetic peptide"
GGFKKFIRR

SEQ ID NO: 27844 - protein, 9 aa, Artificial Sequence
  source: /note="Description of Artificial Sequence: Synthetic peptide"
GKDGGFKKF

SEQ ID NO: 27845 - protein, 10 aa, Artificial Sequence
  source: /note="Description of Artificial Sequence: Synthetic peptide"
RFVQGKDGGF

SEQ ID NO: 27846 - protein, 9 aa, Artificial Sequence
  source: /note="Description of Artificial Sequence: Synthetic peptide"
FVQGKDWGI

SEQ ID NO: 27847 - protein, 9 aa, Artificial Sequence
  source: /note="Description of Artificial Sequence: Synthetic peptide"
DWGIKKFIR

SEQ ID NO: 27848 - protein, 9 aa, Artificial Sequence
  source: /note="Description of Artificial Sequence: Synthetic peptide"
WGIKKFIRR

SEQ ID NO: 27849 - protein, 9 aa, Artificial Sequence
  source: /note="Description of Artificial Sequence: Synthetic peptide"
GKDWGIKKF

SEQ ID NO: 27850 - protein, 10 aa, Artificial Sequence
  source: /note="Description of Artificial Sequence: Synthetic peptide"
RFVQGKDWGI

SEQ ID NO: 27851 - protein, 10 aa, Artificial Sequence
  source: /note="Description of Artificial Sequence: Synthetic peptide"
DWGIKKFIRR

SEQ ID NO: 27852 - protein, 9 aa, Artificial Sequence
  source: /note="Description of Artificial Sequence: Synthetic peptide"
FVQGKDWGV

SEQ ID NO: 27853 - protein, 9 aa, Artificial Sequence
  source: /note="Description of Artificial Sequence: Synthetic peptide"
DWGVKKFIR

SEQ ID NO: 27854 - protein, 9 aa, Artificial Sequence
  source: /note="Description of Artificial Sequence: Synthetic peptide"
GKDWGVKKF

SEQ ID NO: 27855 - protein, 10 aa, Artificial Sequence
  source: /note="Description of Artificial Sequence: Synthetic peptide"
DWGVKKFIRR

SEQ ID NO: 27856 - protein, 9 aa, Artificial Sequence
  source: /note="Description of Artificial Sequence: Synthetic peptide"
DWGCKKFIR

SEQ ID NO: 27857 - protein, 9 aa, Artificial Sequence
  source: /note="Description of Artificial Sequence: Synthetic peptide"
GKDWGCKKF

SEQ ID NO: 27858 - protein, 10 aa, Artificial Sequence
  source: /note="Description of Artificial Sequence: Synthetic peptide"
DWGCKKFIRR

SEQ ID NO: 27859 - protein, 9 aa, Artificial Sequence
  source: /note="Description of Artificial Sequence: Synthetic peptide"
FVQGKDWGL

SEQ ID NO: 27860 - protein, 9 aa, Artificial Sequence
  source: /note="Description of Artificial Sequence: Synthetic peptide"
DWGLKKFIR

SEQ ID NO: 27861 - protein, 9 aa, Artificial Sequence
  source: /note="Description of Artificial Sequence: Synthetic peptide"
GKDWGLKKF

SEQ ID NO: 27862 - protein, 9 aa, Artificial Sequence
  source: /note="Description of Artificial Sequence: Synthetic peptide"
LKKFIRRDF

SEQ ID NO: 27863 - protein, 10 aa, Artificial Sequence
  source: /note="Description of Artificial Sequence: Synthetic peptide"
FVQGKDWGLK

SEQ ID NO: 27864 - protein, 10 aa, Artificial Sequence
  source: /note="Description of Artificial Sequence: Synthetic peptide"
RFVQGKDWGL

SEQ ID NO: 27865 - protein, 10 aa, Artificial Sequence
  source: /note="Description of Artificial Sequence: Synthetic peptide"
DWGLKKFIRR

SEQ ID NO: 27866 - protein, 9 aa, Artificial Sequence
  source: /note="Description of Artificial Sequence: Synthetic peptide"
WIEETLIRV

SEQ ID NO: 27867 - protein, 9 aa, Artificial Sequence
  source: /note="Description of Artificial Sequence: Synthetic peptide"
EESWIEETL

SEQ ID NO: 27868 - protein, 10 aa, Artificial Sequence
  source: /note="Description of Artificial Sequence: Synthetic peptide"
SWIEETLIRV

SEQ ID NO: 27869 - protein, 10 aa, Artificial Sequence
  source: /note="Description of Artificial Sequence: Synthetic peptide"
TLIRVSSQDY

SEQ ID NO: 27870 - protein, 10 aa, Artificial Sequence
  source: /note="Description of Artificial Sequence: Synthetic peptide"
ESWIEETLIR

SEQ ID NO: 27871 - protein, 10 aa, Artificial Sequence
  source: /note="Description of Artificial Sequence: Synthetic peptide"
DEESWIEETL

SEQ ID NO: 27872 - protein, 10 aa, Artificial Sequence
  source: /note="Description of Artificial Sequence: Synthetic peptide"
EESWIEETLI

SEQ ID NO: 27873 - protein, 9 aa, Artificial Sequence
  source: /note="Description of Artificial Sequence: Synthetic peptide"
RYVALLKRW

SEQ ID NO: 27874 - protein, 9 aa, Artificial Sequence
  source: /note="Description of Artificial Sequence: Synthetic peptide"
AIEERYVAL

SEQ ID NO: 27875 - protein, 9 aa, Artificial Sequence
  source: /note="Description of Artificial Sequence: Synthetic peptide"
KAIEERYVA

SEQ ID NO: 27876 - protein, 9 aa, Artificial Sequence
  source: /note="Description of Artificial Sequence: Synthetic peptide"
IEERYVALL

SEQ ID NO: 27877 - protein, 10 aa, Artificial Sequence
  source: /note="Description of Artificial Sequence: Synthetic peptide"
AIEERYVALL

SEQ ID NO: 27878 - protein, 10 aa, Artificial Sequence
  source: /note="Description of Artificial Sequence: Synthetic peptide"
KAIEERYVAL

SEQ ID NO: 27879 - protein, 9 aa, Artificial Sequence
  source: /note="Description of Artificial Sequence: Synthetic peptide"
LAQQWYQLY

SEQ ID NO: 27880 - protein, 9 aa, Artificial Sequence
  source: /note="Description of Artificial Sequence: Synthetic peptide"
GLAQQWYQL

SEQ ID NO: 27881 - protein, 9 aa, Artificial Sequence
  source: /note="Description of Artificial Sequence: Synthetic peptide"
QQWYQLYQL

SEQ ID NO: 27882 - protein, 9 aa, Artificial Sequence
  source: /note="Description of Artificial Sequence: Synthetic peptide"
WYQLYQLGL

SEQ ID NO: 27883 - protein, 9 aa, Artificial Sequence
  source: /note="Description of Artificial Sequence: Synthetic peptide"
AQQWYQLYQ

SEQ ID NO: 27884 - protein, 10 aa, Artificial Sequence
  source: /note="Description of Artificial Sequence: Synthetic peptide"
STIGLAQQWY

SEQ ID NO: 27885 - protein, 10 aa, Artificial Sequence
  source: /note="Description of Artificial Sequence: Synthetic peptide"
AQQWYQLYQL

SEQ ID NO: 27886 - protein, 10 aa, Artificial Sequence
  source: /note="Description of Artificial Sequence: Synthetic peptide"
QWYQLYQLGL

SEQ ID NO: 27887 - protein, 10 aa, Artificial Sequence
  source: /note="Description of Artificial Sequence: Synthetic peptide"
GLAQQWYQLY

SEQ ID NO: 27888 - protein, 10 aa, Artificial Sequence
  source: /note="Description of Artificial Sequence: Synthetic peptide"
WYQLYQLGLR

SEQ ID NO: 27889 - protein, 10 aa, Artificial Sequence
  source: /note="Description of Artificial Sequence: Synthetic peptide"
YQLYQLGLRM

SEQ ID NO: 27890 - protein, 9 aa, Artificial Sequence
  source: /note="Description of Artificial Sequence: Synthetic peptide"
ALAECKSYI

SEQ ID NO: 27891 - protein, 9 aa, Artificial Sequence
  source: /note="Description of Artificial Sequence: Synthetic peptide"
QALAECKSY

SEQ ID NO: 27892 - protein, 10 aa, Artificial Sequence
  source: /note="Description of Artificial Sequence: Synthetic peptide"
ALAECKSYIT

SEQ ID NO: 27893 - protein, 10 aa, Artificial Sequence
  source: /note="Description of Artificial Sequence: Synthetic peptide"
NAFQALAECK

SEQ ID NO: 27894 - protein, 10 aa, Artificial Sequence
  source: /note="Description of Artificial Sequence: Synthetic peptide"
FQALAECKSY

SEQ ID NO: 27895 - protein, 10 aa, Artificial Sequence
  source: /note="Description of Artificial Sequence: Synthetic peptide"
CKSYITKEDM

SEQ ID NO: 27896 - protein, 9 aa, Artificial Sequence
  source: /note="Description of Artificial Sequence: Synthetic peptide"
RLLIKLLEV

SEQ ID NO: 27897 - protein, 9 aa, Artificial Sequence
  source: /note="Description of Artificial Sequence: Synthetic peptide"
LLIKLLEVL

SEQ ID NO: 27898 - protein, 9 aa, Artificial Sequence
  source: /note="Description of Artificial Sequence: Synthetic peptide"
RDGRLLIKL

SEQ ID NO: 27899 - protein, 10 aa, Artificial Sequence
  source: /note="Description of Artificial Sequence: Synthetic peptide"
RLLIKLLEVL

SEQ ID NO: 27900 - protein, 10 aa, Artificial Sequence
  source: /note="Description of Artificial Sequence: Synthetic peptide"
DLRDGRLLIK

SEQ ID NO: 27901 - protein, 9 aa, Artificial Sequence
  source: /note="Description of Artificial Sequence: Synthetic peptide"
ATRLQTVYA

SEQ ID NO: 27902 - protein, 9 aa, Artificial Sequence
  source: /note="Description of Artificial Sequence: Synthetic peptide"
VATRLQTVY

SEQ ID NO: 27903 - protein, 9 aa, Artificial Sequence
  source: /note="Description of Artificial Sequence: Synthetic peptide"
DVATRLQTV

SEQ ID NO: 27904 - protein, 10 aa, Artificial Sequence
  source: /note="Description of Artificial Sequence: Synthetic peptide"
RLQTVYAGEK

SEQ ID NO: 27905 - protein, 10 aa, Artificial Sequence
  source: /note="Description of Artificial Sequence: Synthetic peptide"
VYAGEKAEAI

SEQ ID NO: 27906 - protein, 10 aa, Artificial Sequence
  source: /note="Description of Artificial Sequence: Synthetic peptide"
ATRLQTVYAG

SEQ ID NO: 27907 - protein, 10 aa, Artificial Sequence
  source: /note="Description of Artificial Sequence: Synthetic peptide"
TVYAGEKAEA

SEQ ID NO: 27908 - protein, 10 aa, Artificial Sequence
  source: /note="Description of Artificial Sequence: Synthetic peptide"
DVATRLQTVY

SEQ ID NO: 27909 - protein, 10 aa, Artificial Sequence
  source: /note="Description of Artificial Sequence: Synthetic peptide"
LQTVYAGEKA

SEQ ID NO: 27910 - protein, 9 aa, Artificial Sequence
  source: /note="Description of Artificial Sequence: Synthetic peptide"
ELEVRVPEL

SEQ ID NO: 27911 - protein, 9 aa, Artificial Sequence
  source: /note="Description of Artificial Sequence: Synthetic peptide"
TELEVRVPE

SEQ ID NO: 27912 - protein, 10 aa, Artificial Sequence
  source: /note="Description of Artificial Sequence: Synthetic peptide"
GLKTELEVRV

SEQ ID NO: 27913 - protein, 10 aa, Artificial Sequence
  source: /note="Description of Artificial Sequence: Synthetic peptide"
HQGLKTELEV

SEQ ID NO: 27914 - protein, 10 aa, Artificial Sequence
  source: /note="Description of Artificial Sequence: Synthetic peptide"
TELEVRVPEL

SEQ ID NO: 27915 - protein, 10 aa, Artificial Sequence
  source: /note="Description of Artificial Sequence: Synthetic peptide"
LEVRVPELTT

SEQ ID NO: 27916 - protein, 10 aa, Artificial Sequence
  source: /note="Description of Artificial Sequence: Synthetic peptide"
KKEQKDFVPL

SEQ ID NO: 27917 - protein, 9 aa, Artificial Sequence
  source: /note="Description of Artificial Sequence: Synthetic peptide"
GPRGGLSVA

SEQ ID NO: 27918 - protein, 10 aa, Artificial Sequence
  source: /note="Description of Artificial Sequence: Synthetic peptide"
GLGPRGGLSV

SEQ ID NO: 27919 - protein, 10 aa, Artificial Sequence
  source: /note="Description of Artificial Sequence: Synthetic peptide"
GPRGGLSVAL

SEQ ID NO: 27920 - protein, 9 aa, Artificial Sequence
  source: /note="Description of Artificial Sequence: Synthetic peptide"
GLPGGKAEA

SEQ ID NO: 27921 - protein, 9 aa, Artificial Sequence
  source: /note="Description of Artificial Sequence: Synthetic peptide"
RQPPPTTSF

SEQ ID NO: 27922 - protein, 9 aa, Artificial Sequence
  source: /note="Description of Artificial Sequence: Synthetic peptide"
TSFPFLSGL

SEQ ID NO: 27923 - protein, 9 aa, Artificial Sequence
  source: /note="Description of Artificial Sequence: Synthetic peptide"
RPRRQPPPT

SEQ ID NO: 27924 - protein, 9 aa, Artificial Sequence
  source: /note="Description of Artificial Sequence: Synthetic peptide"
FPFLSGLPG

SEQ ID NO: 27925 - protein, 10 aa, Artificial Sequence
  source: /note="Description of Artificial Sequence: Synthetic peptide"
FLSGLPGGKA

SEQ ID NO: 27926 - protein, 10 aa, Artificial Sequence
  source: /note="Description of Artificial Sequence: Synthetic peptide"
GLPGGKAEAA

SEQ ID NO: 27927 - protein, 10 aa, Artificial Sequence
  source: /note="Description of Artificial Sequence: Synthetic peptide"
TTSFPFLSGL

SEQ ID NO: 27928 - protein, 10 aa, Artificial Sequence
  source: /note="Description of Artificial Sequence: Synthetic peptide"
RPRRQPPPTT

SEQ ID NO: 27929 - protein, 10 aa, Artificial Sequence
  source: /note="Description of Artificial Sequence: Synthetic peptide"
QPPPTTSFPF

SEQ ID NO: 27930 - protein, 10 aa, Artificial Sequence
  source: /note="Description of Artificial Sequence: Synthetic peptide"
RRQPPPTTSF

SEQ ID NO: 27931 - protein, 10 aa, Artificial Sequence
  source: /note="Description of Artificial Sequence: Synthetic peptide"
FPFLSGLPGG

SEQ ID NO: 27932 - protein, 9 aa, Artificial Sequence
  source: /note="Description of Artificial Sequence: Synthetic peptide"
GLPGGKAEA

SEQ ID NO: 27933 - protein, 9 aa, Artificial Sequence
  source: /note="Description of Artificial Sequence: Synthetic peptide"
RQPPPTTSF

SEQ ID NO: 27934 - protein, 9 aa, Artificial Sequence
  source: /note="Description of Artificial Sequence: Synthetic peptide"
TSFPFLSGL

SEQ ID NO: 27935 - protein, 9 aa, Artificial Sequence
  source: /note="Description of Artificial Sequence: Synthetic peptide"
RPRRQPPPT

SEQ ID NO: 27936 - protein, 9 aa, Artificial Sequence
  source: /note="Description of Artificial Sequence: Synthetic peptide"
FPFLSGLPG

SEQ ID NO: 27937 - protein, 10 aa, Artificial Sequence
  source: /note="Description of Artificial Sequence: Synthetic peptide"
FLSGLPGGKA

SEQ ID NO: 27938 - protein, 10 aa, Artificial Sequence
  source: /note="Description of Artificial Sequence: Synthetic peptide"
GLPGGKAEAA

SEQ ID NO: 27939 - protein, 10 aa, Artificial Sequence
  source: /note="Description of Artificial Sequence: Synthetic peptide"
TTSFPFLSGL

SEQ ID NO: 27940 - protein, 10 aa, Artificial Sequence
  source: /note="Description of Artificial Sequence: Synthetic peptide"
RPRRQPPPTT

SEQ ID NO: 27941 - protein, 10 aa, Artificial Sequence
  source: /note="Description of Artificial Sequence: Synthetic peptide"
QPPPTTSFPF

SEQ ID NO: 27942 - protein, 10 aa, Artificial Sequence
  source: /note="Description of Artificial Sequence: Synthetic peptide"
RRQPPPTTSF

SEQ ID NO: 27943 - protein, 10 aa, Artificial Sequence
  source: /note="Description of Artificial Sequence: Synthetic peptide"
FPFLSGLPGG

SEQ ID NO: 27944 - protein, 9 aa, Artificial Sequence
  source: /note="Description of Artificial Sequence: Synthetic peptide"
FEMPPPAPR

SEQ ID NO: 27945 - protein, 9 aa, Artificial Sequence
  source: /note="Description of Artificial Sequence: Synthetic peptide"
VDFEMPPPA

SEQ ID NO: 27946 - protein, 10 aa, Artificial Sequence
  source: /note="Description of Artificial Sequence: Synthetic peptide"
DFEMPPPAPR

SEQ ID NO: 27947 - protein, 9 aa, Artificial Sequence
  source: /note="Description of Artificial Sequence: Synthetic peptide"
RWLCHPWAR

SEQ ID NO: 27948 - protein, 9 aa, Artificial Sequence
  source: /note="Description of Artificial Sequence: Synthetic peptide"
RSFSWSGAG

SEQ ID NO: 27949 - protein, 9 aa, Artificial Sequence
  source: /note="Description of Artificial Sequence: Synthetic peptide"
HPWARSFSW

SEQ ID NO: 27950 - protein, 9 aa, Artificial Sequence
  source: /note="Description of Artificial Sequence: Synthetic peptide"
SLRWLCHPW

SEQ ID NO: 27951 - protein, 9 aa, Artificial Sequence
  source: /note="Description of Artificial Sequence: Synthetic peptide"
LCHPWARSF

SEQ ID NO: 27952 - protein, 10 aa, Artificial Sequence
  source: /note="Description of Artificial Sequence: Synthetic peptide"
SLRWLCHPWA

SEQ ID NO: 27953 - protein, 10 aa, Artificial Sequence
  source: /note="Description of Artificial Sequence: Synthetic peptide"
CHPWARSFSW

SEQ ID NO: 27954 - protein, 10 aa, Artificial Sequence
  source: /note="Description of Artificial Sequence: Synthetic peptide"
RWLCHPWARS

SEQ ID NO: 27955 - protein, 10 aa, Artificial Sequence
  source: /note="Description of Artificial Sequence: Synthetic peptide"
WARSFSWSGA

SEQ ID NO: 27956 - protein, 10 aa, Artificial Sequence
  source: /note="Description of Artificial Sequence: Synthetic peptide"
RSFSWSGAGL

SEQ ID NO: 27957 - protein, 10 aa, Artificial Sequence
  source: /note="Description of Artificial Sequence: Synthetic peptide"
HPWARSFSWS

SEQ ID NO: 27958 - protein, 10 aa, Artificial Sequence
  source: /note="Description of Artificial Sequence: Synthetic peptide"
WLCHPWARSF

SEQ ID NO: 27959 - protein, 10 aa, Artificial Sequence
  source: /note="Description of Artificial Sequence: Synthetic peptide"
DSLRWLCHPW

SEQ ID NO: 27960 - protein, 9 aa, Artificial Sequence
  source: /note="Description of Artificial Sequence: Synthetic peptide"
MEYSRNLEK

SEQ ID NO: 27961 - protein, 9 aa, Artificial Sequence
  source: /note="Description of Artificial Sequence: Synthetic peptide"
KKAEIEMEY

SEQ ID NO: 27962 - protein, 9 aa, Artificial Sequence
  source: /note="Description of Artificial Sequence: Synthetic peptide"
IEMEYSRNL

SEQ ID NO: 27963 - protein, 10 aa, Artificial Sequence
  source: /note="Description of Artificial Sequence: Synthetic peptide"
RKKAEIEMEY

SEQ ID NO: 27964 - protein, 10 aa, Artificial Sequence
  source: /note="Description of Artificial Sequence: Synthetic peptide"
MEYSRNLEKL

SEQ ID NO: 27965 - protein, 9 aa, Artificial Sequence
  source: /note="Description of Artificial Sequence: Synthetic peptide"
SAGGTFQPY

SEQ ID NO: 27966 - protein, 10 aa, Artificial Sequence
  source: /note="Description of Artificial Sequence: Synthetic peptide"
GSAGGTFQPY

SEQ ID NO: 27967 - protein, 10 aa, Artificial Sequence
  source: /note="Description of Artificial Sequence: Synthetic peptide"
ADGGSAGGTF

SEQ ID NO: 27968 - protein, 9 aa, Artificial Sequence
  source: /note="Description of Artificial Sequence: Synthetic peptide"
NLSDSRTPA

SEQ ID NO: 27969 - protein, 10 aa, Artificial Sequence
  source: /note="Description of Artificial Sequence: Synthetic peptide"
NLSDSRTPAA

SEQ ID NO: 27970 - protein, 9 aa, Artificial Sequence
  source: /note="Description of Artificial Sequence: Synthetic peptide"
RWRRWWWRR

SEQ ID NO: 27971 - protein, 9 aa, Artificial Sequence
  source: /note="Description of Artificial Sequence: Synthetic peptide"
RWWWRRRRR

SEQ ID NO: 27972 - protein, 10 aa, Artificial Sequence
  source: /note="Description of Artificial Sequence: Synthetic peptide"
GARWRRWWWR

SEQ ID NO: 27973 - protein, 10 aa, Artificial Sequence
  source: /note="Description of Artificial Sequence: Synthetic peptide"
RWRRWWWRRR

SEQ ID NO: 27974 - protein, 10 aa, Artificial Sequence
  source: /note="Description of Artificial Sequence: Synthetic peptide"
RWWWRRRRRH

SEQ ID NO: 27975 - protein, 10 aa, Artificial Sequence
  source: /note="Description of Artificial Sequence: Synthetic peptide"
WWWRRRRRHR

SEQ ID NO: 27976 - protein, 9 aa, Artificial Sequence
  source: /note="Description of Artificial Sequence: Synthetic peptide"
ALAPAPWGT

SEQ ID NO: 27977 - protein, 9 aa, Artificial Sequence
  source: /note="Description of Artificial Sequence: Synthetic peptide"
ALSPRAHPC

SEQ ID NO: 27978 - protein, 9 aa, Artificial Sequence
  source: /note="Description of Artificial Sequence: Synthetic peptide"
RASPALSPR

SEQ ID NO: 27979 - protein, 9 aa, Artificial Sequence
  source: /note="Description of Artificial Sequence: Synthetic peptide"
SASGAPAPR

SEQ ID NO: 27980 - protein, 9 aa, Artificial Sequence
  source: /note="Description of Artificial Sequence: Synthetic peptide"
QSRASPALS

SEQ ID NO: 27981 - protein, 9 aa, Artificial Sequence
  source: /note="Description of Artificial Sequence: Synthetic peptide"
RAHPCACRA

SEQ ID NO: 27982 - protein, 9 aa, Artificial Sequence
  source: /note="Description of Artificial Sequence: Synthetic peptide"
RGSASGAPA

SEQ ID NO: 27983 - protein, 9 aa, Artificial Sequence
  source: /note="Description of Artificial Sequence: Synthetic peptide"
SPALSPRAH

SEQ ID NO: 27984 - protein, 9 aa, Artificial Sequence
  source: /note="Description of Artificial Sequence: Synthetic peptide"
SPRAHPCAC

SEQ ID NO: 27985 - protein, 9 aa, Artificial Sequence
  source: /note="Description of Artificial Sequence: Synthetic peptide"
APAPWGTAG

SEQ ID NO: 27986 - protein, 9 aa, Artificial Sequence
  source: /note="Description of Artificial Sequence: Synthetic peptide"
EQSRASPAL

SEQ ID NO: 27987 - protein, 9 aa, Artificial Sequence
  source: /note="Description of Artificial Sequence: Synthetic peptide"
CRALAPAPW

SEQ ID NO: 27988 - protein, 9 aa, Artificial Sequence
  source: /note="Description of Artificial Sequence: Synthetic peptide"
EEQSRASPA

SEQ ID NO: 27989 - protein, 10 aa, Artificial Sequence
  source: /note="Description of Artificial Sequence: Synthetic peptide"
ALAPAPWGTA

SEQ ID NO: 27990 - protein, 10 aa, Artificial Sequence
  source: /note="Description of Artificial Sequence: Synthetic peptide"
ALSPRAHPCA

SEQ ID NO: 27991 - protein, 10 aa, Artificial Sequence
  source: /note="Description of Artificial Sequence: Synthetic peptide"
GSASGAPAPR

SEQ ID NO: 27992 - protein, 10 aa, Artificial Sequence
  source: /note="Description of Artificial Sequence: Synthetic peptide"
RASPALSPRA

SEQ ID NO: 27993 - protein, 10 aa, Artificial Sequence
  source: /note="Description of Artificial Sequence: Synthetic peptide"
RAHPCACRAL

SEQ ID NO: 27994 - protein, 10 aa, Artificial Sequence
  source: /note="Description of Artificial Sequence: Synthetic peptide"
REEQSRASPA

SEQ ID NO: 27995 - protein, 10 aa, Artificial Sequence
  source: /note="Description of Artificial Sequence: Synthetic peptide"
EEQSRASPAL

SEQ ID NO: 27996 - protein, 10 aa, Artificial Sequence
  source: /note="Description of Artificial Sequence: Synthetic peptide"
ACRALAPAPW

SEQ ID NO: 27997 - protein, 9 aa, Artificial Sequence
  source: /note="Description of Artificial Sequence: Synthetic peptide"
GSGQVTGNY

SEQ ID NO: 27998 - protein, 9 aa, Artificial Sequence
  source: /note="Description of Artificial Sequence: Synthetic peptide"
GQVTGNYAS

SEQ ID NO: 27999 - protein, 10 aa, Artificial Sequence
  source: /note="Description of Artificial Sequence: Synthetic peptide"
QVTGNYASHR

SEQ ID NO: 28000 - protein, 10 aa, Artificial Sequence
  source: /note="Description of Artificial Sequence: Synthetic peptide"
GQVTGNYASH

SEQ ID NO: 28001 - protein, 9 aa, Artificial Sequence
  source: /note="Description of Artificial Sequence: Synthetic peptide"
LLANLPAGS

SEQ ID NO: 28002 - protein, 9 aa, Artificial Sequence
  source: /note="Description of Artificial Sequence: Synthetic peptide"
QQQLLLANL

SEQ ID NO: 28003 - protein, 9 aa, Artificial Sequence
  source: /note="Description of Artificial Sequence: Synthetic peptide"
LANLPAGSL

SEQ ID NO: 28004 - protein, 10 aa, Artificial Sequence
  source: /note="Description of Artificial Sequence: Synthetic peptide"
LLANLPAGSL

SEQ ID NO: 28005 - protein, 10 aa, Artificial Sequence
  source: /note="Description of Artificial Sequence: Synthetic peptide"
NLPAGSLRCI

SEQ ID NO: 28006 - protein, 10 aa, Artificial Sequence
  source: /note="Description of Artificial Sequence: Synthetic peptide"
LANLPAGSLR

SEQ ID NO: 28007 - protein, 10 aa, Artificial Sequence
  source: /note="Description of Artificial Sequence: Synthetic peptide"
QQLLLANLPA

SEQ ID NO: 28008 - protein, 9 aa, Artificial Sequence
  source: /note="Description of Artificial Sequence: Synthetic peptide"
GLGACLQPL

SEQ ID NO: 28009 - protein, 9 aa, Artificial Sequence
  source: /note="Description of Artificial Sequence: Synthetic peptide"
RGCARWAGV

SEQ ID NO: 28010 - protein, 9 aa, Artificial Sequence
  source: /note="Description of Artificial Sequence: Synthetic peptide"
CARWAGVAA

SEQ ID NO: 28011 - protein, 9 aa, Artificial Sequence
  source: /note="Description of Artificial Sequence: Synthetic peptide"
RWAGVAAAA

SEQ ID NO: 28012 - protein, 9 aa, Artificial Sequence
  source: /note="Description of Artificial Sequence: Synthetic peptide"
IAAAPWVGA

SEQ ID NO: 28013 - protein, 9 aa, Artificial Sequence
  source: /note="Description of Artificial Sequence: Synthetic peptide"
QPLPGIAAA

SEQ ID NO: 28014 - protein, 9 aa, Artificial Sequence
  source: /note="Description of Artificial Sequence: Synthetic peptide"
ARWAGVAAA

SEQ ID NO: 28015 - protein, 9 aa, Artificial Sequence
  source: /note="Description of Artificial Sequence: Synthetic peptide"
LQPLPGIAA

SEQ ID NO: 28016 - protein, 9 aa, Artificial Sequence
  source: /note="Description of Artificial Sequence: Synthetic peptide"
LPGIAAAPW

SEQ ID NO: 28017 - protein, 10 aa, Artificial Sequence
  source: /note="Description of Artificial Sequence: Synthetic peptide"
GIAAAPWVGA

SEQ ID NO: 28018 - protein, 10 aa, Artificial Sequence
  source: /note="Description of Artificial Sequence: Synthetic peptide"
RGCARWAGVA

SEQ ID NO: 28019 - protein, 10 aa, Artificial Sequence
  source: /note="Description of Artificial Sequence: Synthetic peptide"
CARWAGVAAA

SEQ ID NO: 28020 - protein, 10 aa, Artificial Sequence
  source: /note="Description of Artificial Sequence: Synthetic peptide"
LLPPPRGCAR

SEQ ID NO: 28021 - protein, 10 aa, Artificial Sequence
  source: /note="Description of Artificial Sequence: Synthetic peptide"
ARWAGVAAAA

SEQ ID NO: 28022 - protein, 10 aa, Artificial Sequence
  source: /note="Description of Artificial Sequence: Synthetic peptide"
AAAAGLGACL

SEQ ID NO: 28023 - protein, 10 aa, Artificial Sequence
  source: /note="Description of Artificial Sequence: Synthetic peptide"
AGLGACLQPL

SEQ ID NO: 28024 - protein, 10 aa, Artificial Sequence
  source: /note="Description of Artificial Sequence: Synthetic peptide"
LQPLPGIAAA

SEQ ID NO: 28025 - protein, 10 aa, Artificial Sequence
  source: /note="Description of Artificial Sequence: Synthetic peptide"
LPPPRGCARW

SEQ ID NO: 28026 - protein, 10 aa, Artificial Sequence
  source: /note="Description of Artificial Sequence: Synthetic peptide"
LPGIAAAPWV

SEQ ID NO: 28027 - protein, 9 aa, Artificial Sequence
  source: /note="Description of Artificial Sequence: Synthetic peptide"
VLNNKFWLR

SEQ ID NO: 28028 - protein, 9 aa, Artificial Sequence
  source: /note="Description of Artificial Sequence: Synthetic peptide"
WLRCKNCKT

SEQ ID NO: 28029 - protein, 10 aa, Artificial Sequence
  source: /note="Description of Artificial Sequence: Synthetic peptide"
IVLNNKFWLR

SEQ ID NO: 28030 - protein, 10 aa, Artificial Sequence
  source: /note="Description of Artificial Sequence: Synthetic peptide"
RMIVLNNKFW

SEQ ID NO: 28031 - protein, 10 aa, Artificial Sequence
  source: /note="Description of Artificial Sequence: Synthetic peptide"
KFWLRCKNCK

SEQ ID NO: 28032 - protein, 10 aa, Artificial Sequence
  source: /note="Description of Artificial Sequence: Synthetic peptide"
MIVLNNKFWL

SEQ ID NO: 28033 - protein, 9 aa, Artificial Sequence
  source: /note="Description of Artificial Sequence: Synthetic peptide"
KHKAEILKK

SEQ ID NO: 28034 - protein, 10 aa, Artificial Sequence
  source: /note="Description of Artificial Sequence: Synthetic peptide"
YLQSKNKHKA

SEQ ID NO: 28035 - protein, 10 aa, Artificial Sequence
  source: /note="Description of Artificial Sequence: Synthetic peptide"
KNKHKAEILK

SEQ ID NO: 28036 - protein, 10 aa, Artificial Sequence
  source: /note="Description of Artificial Sequence: Synthetic peptide"
SKNKHKAEIL

SEQ ID NO: 28037 - protein, 9 aa, Artificial Sequence
  source: /note="Description of Artificial Sequence: Synthetic peptide"
HVQRTAQPL

SEQ ID NO: 28038 - protein, 10 aa, Artificial Sequence
  source: /note="Description of Artificial Sequence: Synthetic peptide"
RTAQPLPQSI

SEQ ID NO: 28039 - protein, 10 aa, Artificial Sequence
  source: /note="Description of Artificial Sequence: Synthetic peptide"
IHVQRTAQPL

SEQ ID NO: 28040 - protein, 9 aa, Artificial Sequence
  source: /note="Description of Artificial Sequence: Synthetic peptide"
LLCWPRPQL

SEQ ID NO: 28041 - protein, 9 aa, Artificial Sequence
  source: /note="Description of Artificial Sequence: Synthetic peptide"
AVLLLCWPR

SEQ ID NO: 28042 - protein, 9 aa, Artificial Sequence
  source: /note="Description of Artificial Sequence: Synthetic peptide"
FSNPPNGPL

SEQ ID NO: 28043 - protein, 9 aa, Artificial Sequence
  source: /note="Description of Artificial Sequence: Synthetic peptide"
ELAGPCSQL

SEQ ID NO: 28044 - protein, 9 aa, Artificial Sequence
  source: /note="Description of Artificial Sequence: Synthetic peptide"
NPPNGPLEL

SEQ ID NO: 28045 - protein, 9 aa, Artificial Sequence
  source: /note="Description of Artificial Sequence: Synthetic peptide"
WPRPQLRPA

SEQ ID NO: 28046 - protein, 9 aa, Artificial Sequence
  source: /note="Description of Artificial Sequence: Synthetic peptide"
RPQLRPAEH

SEQ ID NO: 28047 - protein, 9 aa, Artificial Sequence
  source: /note="Description of Artificial Sequence: Synthetic peptide"
QQFFSNPPN

SEQ ID NO: 28048 - protein, 9 aa, Artificial Sequence
  source: /note="Description of Artificial Sequence: Synthetic peptide"
AEHAEKQAV

SEQ ID NO: 28049 - protein, 10 aa, Artificial Sequence
  source: /note="Description of Artificial Sequence: Synthetic peptide"
LLLCWPRPQL

SEQ ID NO: 28050 - protein, 10 aa, Artificial Sequence
  source: /note="Description of Artificial Sequence: Synthetic peptide"
QLRPAEHAEK

SEQ ID NO: 28051 - protein, 10 aa, Artificial Sequence
  source: /note="Description of Artificial Sequence: Synthetic peptide"
SQLAVLLLCW

SEQ ID NO: 28052 - protein, 10 aa, Artificial Sequence
  source: /note="Description of Artificial Sequence: Synthetic peptide"
LAVLLLCWPR

SEQ ID NO: 28053 - protein, 10 aa, Artificial Sequence
  source: /note="Description of Artificial Sequence: Synthetic peptide"
LLCWPRPQLR

SEQ ID NO: 28054 - protein, 10 aa, Artificial Sequence
  source: /note="Description of Artificial Sequence: Synthetic peptide"
ELAGPCSQLA

SEQ ID NO: 28055 - protein, 10 aa, Artificial Sequence
  source: /note="Description of Artificial Sequence: Synthetic peptide"
WPRPQLRPAE

SEQ ID NO: 28056 - protein, 10 aa, Artificial Sequence
  source: /note="Description of Artificial Sequence: Synthetic peptide"
RPQLRPAEHA

SEQ ID NO: 28057 - protein, 10 aa, Artificial Sequence
  source: /note="Description of Artificial Sequence: Synthetic peptide"
RPAEHAEKQA

SEQ ID NO: 28058 - protein, 10 aa, Artificial Sequence
  source: /note="Description of Artificial Sequence: Synthetic peptide"
QQFFSNPPNG

SEQ ID NO: 28059 - protein, 10 aa, Artificial Sequence
  source: /note="Description of Artificial Sequence: Synthetic peptide"
FFSNPPNGPL

SEQ ID NO: 28060 - protein, 10 aa, Artificial Sequence
  source: /note="Description of Artificial Sequence: Synthetic peptide"
LELAGPCSQL

SEQ ID NO: 28061 - protein, 10 aa, Artificial Sequence
  source: /note="Description of Artificial Sequence: Synthetic peptide"
AEKQAVRAEL

SEQ ID NO: 28062 - protein, 9 aa, Artificial Sequence
  source: /note="Description of Artificial Sequence: Synthetic peptide"
IIMGYKIMV

SEQ ID NO: 28063 - protein, 9 aa, Artificial Sequence
  source: /note="Description of Artificial Sequence: Synthetic peptide"
IMGYKIMVA

SEQ ID NO: 28064 - protein, 9 aa, Artificial Sequence
  source: /note="Description of Artificial Sequence: Synthetic peptide"
IMVATNILV

SEQ ID NO: 28065 - protein, 9 aa, Artificial Sequence
  source: /note="Description of Artificial Sequence: Synthetic peptide"
KIMVATNIL

SEQ ID NO: 28066 - protein, 9 aa, Artificial Sequence
  source: /note="Description of Artificial Sequence: Synthetic peptide"
YKIMVATNI

SEQ ID NO: 28067 - protein, 10 aa, Artificial Sequence
  source: /note="Description of Artificial Sequence: Synthetic peptide"
IIMGYKIMVA

SEQ ID NO: 28068 - protein, 10 aa, Artificial Sequence
  source: /note="Description of Artificial Sequence: Synthetic peptide"
KIMVATNILV

SEQ ID NO: 28069 - protein, 10 aa, Artificial Sequence
  source: /note="Description of Artificial Sequence: Synthetic peptide"
IMGYKIMVAT

SEQ ID NO: 28070 - protein, 10 aa, Artificial Sequence
  source: /note="Description of Artificial Sequence: Synthetic peptide"
GYKIMVATNI

SEQ ID NO: 28071 - protein, 10 aa, Artificial Sequence
  source: /note="Description of Artificial Sequence: Synthetic peptide"
EIIMGYKIMV

SEQ ID NO: 28072 - protein, 10 aa, Artificial Sequence
  source: /note="Description of Artificial Sequence: Synthetic peptide"
YKIMVATNIL

SEQ ID NO: 28073 - protein, 10 aa, Artificial Sequence
  source: /note="Description of Artificial Sequence: Synthetic peptide"
IMVATNILVS

SEQ ID NO: 28074 - protein, 10 aa, Artificial Sequence
  source: /note="Description of Artificial Sequence: Synthetic peptide"
VATNILVSPL

SEQ ID NO: 28075 - protein, 10 aa, Artificial Sequence
  source: /note="Description of Artificial Sequence: Synthetic peptide"
HMNPPPGEGH

SEQ ID NO: 28076 - protein, 9 aa, Artificial Sequence
  source: /note="Description of Artificial Sequence: Synthetic peptide"
LLCPVQEPA

SEQ ID NO: 28077 - protein, 9 aa, Artificial Sequence
  source: /note="Description of Artificial Sequence: Synthetic peptide"
ASGSWGWSR

SEQ ID NO: 28078 - protein, 9 aa, Artificial Sequence
  source: /note="Description of Artificial Sequence: Synthetic peptide"
SGSWGWSRK

SEQ ID NO: 28079 - protein, 9 aa, Artificial Sequence
  source: /note="Description of Artificial Sequence: Synthetic peptide"
SWGWSRKHW

SEQ ID NO: 28080 - protein, 9 aa, Artificial Sequence
  source: /note="Description of Artificial Sequence: Synthetic peptide"
RFLGAPSQA

SEQ ID NO: 28081 - protein, 9 aa, Artificial Sequence
  source: /note="Description of Artificial Sequence: Synthetic peptide"
WSRKHWRNH

SEQ ID NO: 28082 - protein, 9 aa, Artificial Sequence
  source: /note="Description of Artificial Sequence: Synthetic peptide"
WGWSRKHWR

SEQ ID NO: 28083 - protein, 9 aa, Artificial Sequence
  source: /note="Description of Artificial Sequence: Synthetic peptide"
REAGAGAEC

SEQ ID NO: 28084 - protein, 9 aa, Artificial Sequence
  source: /note="Description of Artificial Sequence: Synthetic peptide"
RNHQQHCAL

SEQ ID NO: 28085 - protein, 9 aa, Artificial Sequence
  source: /note="Description of Artificial Sequence: Synthetic peptide"
CALGEQHSW

SEQ ID NO: 28086 - protein, 9 aa, Artificial Sequence
  source: /note="Description of Artificial Sequence: Synthetic peptide"
GEQHSWELL

SEQ ID NO: 28087 - protein, 9 aa, Artificial Sequence
  source: /note="Description of Artificial Sequence: Synthetic peptide"
EQHSWELLL

SEQ ID NO: 28088 - protein, 9 aa, Artificial Sequence
  source: /note="Description of Artificial Sequence: Synthetic peptide"
WELLLCPVQ

SEQ ID NO: 28089 - protein, 10 aa, Artificial Sequence
  source: /note="Description of Artificial Sequence: Synthetic peptide"
FLGAPSQASA

SEQ ID NO: 28090 - protein, 10 aa, Artificial Sequence
  source: /note="Description of Artificial Sequence: Synthetic peptide"
ALGEQHSWEL

SEQ ID NO: 28091 - protein, 10 aa, Artificial Sequence
  source: /note="Description of Artificial Sequence: Synthetic peptide"
HSWELLLCPV

SEQ ID NO: 28092 - protein, 10 aa, Artificial Sequence
  source: /note="Description of Artificial Sequence: Synthetic peptide"
LLLCPVQEPA

SEQ ID NO: 28093 - protein, 10 aa, Artificial Sequence
  source: /note="Description of Artificial Sequence: Synthetic peptide"
CASGSWGWSR

SEQ ID NO: 28094 - protein, 10 aa, Artificial Sequence
  source: /note="Description of Artificial Sequence: Synthetic peptide"
ASGSWGWSRK

SEQ ID NO: 28095 - protein, 10 aa, Artificial Sequence
  source: /note="Description of Artificial Sequence: Synthetic peptide"
HWRNHQQHCA

SEQ ID NO: 28096 - protein, 10 aa, Artificial Sequence
  source: /note="Description of Artificial Sequence: Synthetic peptide"
SWGWSRKHWR

SEQ ID NO: 28097 - protein, 10 aa, Artificial Sequence
  source: /note="Description of Artificial Sequence: Synthetic peptide"
LRFLGAPSQA

SEQ ID NO: 28098 - protein, 10 aa, Artificial Sequence
  source: /note="Description of Artificial Sequence: Synthetic peptide"
SQASAGQGRH

SEQ ID NO: 28099 - protein, 10 aa, Artificial Sequence
  source: /note="Description of Artificial Sequence: Synthetic peptide"
REAGAGAECA

SEQ ID NO: 28100 - protein, 10 aa, Artificial Sequence
  source: /note="Description of Artificial Sequence: Synthetic peptide"
AGAECASGSW

SEQ ID NO: 28101 - protein, 10 aa, Artificial Sequence
  source: /note="Description of Artificial Sequence: Synthetic peptide"
AECASGSWGW

SEQ ID NO: 28102 - protein, 10 aa, Artificial Sequence
  source: /note="Description of Artificial Sequence: Synthetic peptide"
GSWGWSRKHW

SEQ ID NO: 28103 - protein, 10 aa, Artificial Sequence
  source: /note="Description of Artificial Sequence: Synthetic peptide"
RKHWRNHQQH

SEQ ID NO: 28104 - protein, 10 aa, Artificial Sequence
  source: /note="Description of Artificial Sequence: Synthetic peptide"
WRNHQQHCAL

SEQ ID NO: 28105 - protein, 10 aa, Artificial Sequence
  source: /note="Description of Artificial Sequence: Synthetic peptide"
QQHCALGEQH

SEQ ID NO: 28106 - protein, 10 aa, Artificial Sequence
  source: /note="Description of Artificial Sequence: Synthetic peptide"
GEQHSWELLL

SEQ ID NO: 28107 - protein, 9 aa, Artificial Sequence
  source: /note="Description of Artificial Sequence: Synthetic peptide"
HGNQHNNAK

SEQ ID NO: 28108 - protein, 9 aa, Artificial Sequence
  source: /note="Description of Artificial Sequence: Synthetic peptide"
NQHNNAKAT

SEQ ID NO: 28109 - protein, 10 aa, Artificial Sequence
  source: /note="Description of Artificial Sequence: Synthetic peptide"
NQHNNAKATI

SEQ ID NO: 28110 - protein, 10 aa, Artificial Sequence
  source: /note="Description of Artificial Sequence: Synthetic peptide"
YAIPGDCGPR

SEQ ID NO: 28111 - protein, 10 aa, Artificial Sequence
  source: /note="Description of Artificial Sequence: Synthetic peptide"
IPGDCGPRSL

SEQ ID NO: 28112 - protein, 9 aa, Artificial Sequence
  source: /note="Description of Artificial Sequence: Synthetic peptide"
SLQELEELL

SEQ ID NO: 28113 - protein, 9 aa, Artificial Sequence
  source: /note="Description of Artificial Sequence: Synthetic peptide"
QELEELLSA

SEQ ID NO: 28114 - protein, 10 aa, Artificial Sequence
  source: /note="Description of Artificial Sequence: Synthetic peptide"
LICSRSLQEL

SEQ ID NO: 28115 - protein, 10 aa, Artificial Sequence
  source: /note="Description of Artificial Sequence: Synthetic peptide"
RSLQELEELL

SEQ ID NO: 28116 - protein, 10 aa, Artificial Sequence
  source: /note="Description of Artificial Sequence: Synthetic peptide"
LQELEELLSA

SEQ ID NO: 28117 - protein, 10 aa, Artificial Sequence
  source: /note="Description of Artificial Sequence: Synthetic peptide"
QELEELLSAC

SEQ ID NO: 28118 - protein, 9 aa, Artificial Sequence
  source: /note="Description of Artificial Sequence: Synthetic peptide"
SAPENPIFR

SEQ ID NO: 28119 - protein, 9 aa, Artificial Sequence
  source: /note="Description of Artificial Sequence: Synthetic peptide"
NPIFRFSSL

SEQ ID NO: 28120 - protein, 9 aa, Artificial Sequence
  source: /note="Description of Artificial Sequence: Synthetic peptide"
CSAPENPIF

SEQ ID NO: 28121 - protein, 10 aa, Artificial Sequence
  source: /note="Description of Artificial Sequence: Synthetic peptide"
CSAPENPIFR

SEQ ID NO: 28122 - protein, 10 aa, Artificial Sequence
  source: /note="Description of Artificial Sequence: Synthetic peptide"
SAPENPIFRF

SEQ ID NO: 28123 - protein, 10 aa, Artificial Sequence
  source: /note="Description of Artificial Sequence: Synthetic peptide"
RHCSAPENPI

SEQ ID NO: 28124 - protein, 10 aa, Artificial Sequence
  source: /note="Description of Artificial Sequence: Synthetic peptide"
HCSAPENPIF

SEQ ID NO: 28125 - protein, 10 aa, Artificial Sequence
  source: /note="Description of Artificial Sequence: Synthetic peptide"
NPIFRFSSLH

SEQ ID NO: 28126 - protein, 9 aa, Artificial Sequence
  source: /note="Description of Artificial Sequence: Synthetic peptide"
IIQRQWRGK

SEQ ID NO: 28127 - protein, 9 aa, Artificial Sequence
  source: /note="Description of Artificial Sequence: Synthetic peptide"
LPGRGRCEL

SEQ ID NO: 28128 - protein, 9 aa, Artificial Sequence
  source: /note="Description of Artificial Sequence: Synthetic peptide"
QRQWRGKPL

SEQ ID NO: 28129 - protein, 9 aa, Artificial Sequence
  source: /note="Description of Artificial Sequence: Synthetic peptide"
RQWRGKPLP

SEQ ID NO: 28130 - protein, 10 aa, Artificial Sequence
  source: /note="Description of Artificial Sequence: Synthetic peptide"
AIIQRQWRGK

SEQ ID NO: 28131 - protein, 10 aa, Artificial Sequence
  source: /note="Description of Artificial Sequence: Synthetic peptide"
QWRGKPLPGR

SEQ ID NO: 28132 - protein, 10 aa, Artificial Sequence
  source: /note="Description of Artificial Sequence: Synthetic peptide"
RGKPLPGRGR

SEQ ID NO: 28133 - protein, 10 aa, Artificial Sequence
  source: /note="Description of Artificial Sequence: Synthetic peptide"
IQRQWRGKPL

SEQ ID NO: 28134 - protein, 10 aa, Artificial Sequence
  source: /note="Description of Artificial Sequence: Synthetic peptide"
RQWRGKPLPG

SEQ ID NO: 28135 - protein, 9 aa, Artificial Sequence
  source: /note="Description of Artificial Sequence: Synthetic peptide"
ILVLPCIYV

SEQ ID NO: 28136 - protein, 9 aa, Artificial Sequence
  source: /note="Description of Artificial Sequence: Synthetic peptide"
VLPCIYVFV

SEQ ID NO: 28137 - protein, 9 aa, Artificial Sequence
  source: /note="Description of Artificial Sequence: Synthetic peptide"
YVFVKVDLR

SEQ ID NO: 28138 - protein, 9 aa, Artificial Sequence
  source: /note="Description of Artificial Sequence: Synthetic peptide"
LVLPCIYVF

SEQ ID NO: 28139 - protein, 9 aa, Artificial Sequence
  source: /note="Description of Artificial Sequence: Synthetic peptide"
IYVFVKVDL

SEQ ID NO: 28140 - protein, 9 aa, Artificial Sequence
  source: /note="Description of Artificial Sequence: Synthetic peptide"
LILVLPCIY

SEQ ID NO: 28141 - protein, 10 aa, Artificial Sequence
  source: /note="Description of Artificial Sequence: Synthetic peptide"
LILVLPCIYV

SEQ ID NO: 28142 - protein, 10 aa, Artificial Sequence
  source: /note="Description of Artificial Sequence: Synthetic peptide"
LVLPCIYVFV

SEQ ID NO: 28143 - protein, 10 aa, Artificial Sequence
  source: /note="Description of Artificial Sequence: Synthetic peptide"
VLPCIYVFVK

SEQ ID NO: 28144 - protein, 10 aa, Artificial Sequence
  source: /note="Description of Artificial Sequence: Synthetic peptide"
ILVLPCIYVF

SEQ ID NO: 28145 - protein, 10 aa, Artificial Sequence
  source: /note="Description of Artificial Sequence: Synthetic peptide"
GLILVLPCIY

SEQ ID NO: 28146 - protein, 10 aa, Artificial Sequence
  source: /note="Description of Artificial Sequence: Synthetic peptide"
IYVFVKVDLR

SEQ ID NO: 28147 - protein, 10 aa, Artificial Sequence
  source: /note="Description of Artificial Sequence: Synthetic peptide"
LPCIYVFVKV

SEQ ID NO: 28148 - protein, 9 aa, Artificial Sequence
  source: /note="Description of Artificial Sequence: Synthetic peptide"
CLCFVNGSL

SEQ ID NO: 28149 - protein, 9 aa, Artificial Sequence
  source: /note="Description of Artificial Sequence: Synthetic peptide"
FVNGSLECF

SEQ ID NO: 28150 - protein, 9 aa, Artificial Sequence
  source: /note="Description of Artificial Sequence: Synthetic peptide"
GSLECFLTL

SEQ ID NO: 28151 - protein, 10 aa, Artificial Sequence
  source: /note="Description of Artificial Sequence: Synthetic peptide"
FVNGSLECFL

SEQ ID NO: 28152 - protein, 10 aa, Artificial Sequence
  source: /note="Description of Artificial Sequence: Synthetic peptide"
CFVNGSLECF

SEQ ID NO: 28153 - protein, 9 aa, Artificial Sequence
  source: /note="Description of Artificial Sequence: Synthetic peptide"
GSWYIDEPR

SEQ ID NO: 28154 - protein, 9 aa, Artificial Sequence
  source: /note="Description of Artificial Sequence: Synthetic peptide"
TLWSSAFSA

SEQ ID NO: 28155 - protein, 9 aa, Artificial Sequence
  source: /note="Description of Artificial Sequence: Synthetic peptide"
WSSAFSATR

SEQ ID NO: 28156 - protein, 9 aa, Artificial Sequence
  source: /note="Description of Artificial Sequence: Synthetic peptide"
VTRPPTPTT

SEQ ID NO: 28157 - protein, 9 aa, Artificial Sequence
  source: /note="Description of Artificial Sequence: Synthetic peptide"
ATRMPGPVP

SEQ ID NO: 28158 - protein, 9 aa, Artificial Sequence
  source: /note="Description of Artificial Sequence: Synthetic peptide"
TTLWSSAFS

SEQ ID NO: 28159 - protein, 9 aa, Artificial Sequence
  source: /note="Description of Artificial Sequence: Synthetic peptide"
STTLWSSAF

SEQ ID NO: 28160 - protein, 9 aa, Artificial Sequence
  source: /note="Description of Artificial Sequence: Synthetic peptide"
SSAFSATRM

SEQ ID NO: 28161 - protein, 9 aa, Artificial Sequence
  source: /note="Description of Artificial Sequence: Synthetic peptide"
TRMPGPVPA

SEQ ID NO: 28162 - protein, 9 aa, Artificial Sequence
  source: /note="Description of Artificial Sequence: Synthetic peptide"
MPGPVPAPS

SEQ ID NO: 28163 - protein, 9 aa, Artificial Sequence
  source: /note="Description of Artificial Sequence: Synthetic peptide"
SPPTSTTLW

SEQ ID NO: 28164 - protein, 10 aa, Artificial Sequence
  source: /note="Description of Artificial Sequence: Synthetic peptide"
TLWSSAFSAT

SEQ ID NO: 28165 - protein, 10 aa, Artificial Sequence
  source: /note="Description of Artificial Sequence: Synthetic peptide"
FSATRMPGPV

SEQ ID NO: 28166 - protein, 10 aa, Artificial Sequence
  source: /note="Description of Artificial Sequence: Synthetic peptide"
TTLWSSAFSA

SEQ ID NO: 28167 - protein, 10 aa, Artificial Sequence
  source: /note="Description of Artificial Sequence: Synthetic peptide"
ATRMPGPVPA

SEQ ID NO: 28168 - protein, 10 aa, Artificial Sequence
  source: /note="Description of Artificial Sequence: Synthetic peptide"
STPGPPTVTR

SEQ ID NO: 28169 - protein, 10 aa, Artificial Sequence
  source: /note="Description of Artificial Sequence: Synthetic peptide"
LWSSAFSATR

SEQ ID NO: 28170 - protein, 10 aa, Artificial Sequence
  source: /note="Description of Artificial Sequence: Synthetic peptide"
TTSTPGPPTV

SEQ ID NO: 28171 - protein, 10 aa, Artificial Sequence
  source: /note="Description of Artificial Sequence: Synthetic peptide"
EPSPPTSTTL

SEQ ID NO: 28172 - protein, 10 aa, Artificial Sequence
  source: /note="Description of Artificial Sequence: Synthetic peptide"
TSTTLWSSAF

SEQ ID NO: 28173 - protein, 10 aa, Artificial Sequence
  source: /note="Description of Artificial Sequence: Synthetic peptide"
WSSAFSATRM

SEQ ID NO: 28174 - protein, 9 aa, Artificial Sequence
  source: /note="Description of Artificial Sequence: Synthetic peptide"
ETNNLEQIL

SEQ ID NO: 28175 - protein, 9 aa, Artificial Sequence
  source: /note="Description of Artificial Sequence: Synthetic peptide"
VETNNLEQI

SEQ ID NO: 28176 - protein, 10 aa, Artificial Sequence
  source: /note="Description of Artificial Sequence: Synthetic peptide"
VETNNLEQIL

SEQ ID NO: 28177 - protein, 9 aa, Artificial Sequence
  source: /note="Description of Artificial Sequence: Synthetic peptide"
ILDYFREAY

SEQ ID NO: 28178 - protein, 9 aa, Artificial Sequence
  source: /note="Description of Artificial Sequence: Synthetic peptide"
NILDYFREA

SEQ ID NO: 28179 - protein, 9 aa, Artificial Sequence
  source: /note="Description of Artificial Sequence: Synthetic peptide"
DYFREAYFW

SEQ ID NO: 28180 - protein, 9 aa, Artificial Sequence
  source: /note="Description of Artificial Sequence: Synthetic peptide"
YFREAYFWL

SEQ ID NO: 28181 - protein, 9 aa, Artificial Sequence
  source: /note="Description of Artificial Sequence: Synthetic peptide"
GTRNILDYF

SEQ ID NO: 28182 - protein, 9 aa, Artificial Sequence
  source: /note="Description of Artificial Sequence: Synthetic peptide"
LDYFREAYF

SEQ ID NO: 28183 - protein, 10 aa, Artificial Sequence
  source: /note="Description of Artificial Sequence: Synthetic peptide"
GTRNILDYFR

SEQ ID NO: 28184 - protein, 10 aa, Artificial Sequence
  source: /note="Description of Artificial Sequence: Synthetic peptide"
DYFREAYFWL

SEQ ID NO: 28185 - protein, 10 aa, Artificial Sequence
  source: /note="Description of Artificial Sequence: Synthetic peptide"
YFREAYFWLR

SEQ ID NO: 28186 - protein, 10 aa, Artificial Sequence
  source: /note="Description of Artificial Sequence: Synthetic peptide"
NILDYFREAY

SEQ ID NO: 28187 - protein, 10 aa, Artificial Sequence
  source: /note="Description of Artificial Sequence: Synthetic peptide"
ILDYFREAYF

SEQ ID NO: 28188 - protein, 9 aa, Artificial Sequence
  source: /note="Description of Artificial Sequence: Synthetic peptide"
DESGNLTSV

SEQ ID NO: 28189 - protein, 10 aa, Artificial Sequence
  source: /note="Description of Artificial Sequence: Synthetic peptide"
LTSVDLRIRR

SEQ ID NO: 28190 - protein, 9 aa, Artificial Sequence
  source: /note="Description of Artificial Sequence: Synthetic peptide"
NIRARQEGK

SEQ ID NO: 28191 - protein, 9 aa, Artificial Sequence
  source: /note="Description of Artificial Sequence: Synthetic peptide"
ETKKLSNIR

SEQ ID NO: 28192 - protein, 9 aa, Artificial Sequence
  source: /note="Description of Artificial Sequence: Synthetic peptide"
RQVNGINPN

SEQ ID NO: 28193 - protein, 9 aa, Artificial Sequence
  source: /note="Description of Artificial Sequence: Synthetic peptide"
NPNGDSAEF

SEQ ID NO: 28194 - protein, 10 aa, Artificial Sequence
  source: /note="Description of Artificial Sequence: Synthetic peptide"
RQVNGINPNG

SEQ ID NO: 28195 - protein, 9 aa, Artificial Sequence
  source: /note="Description of Artificial Sequence: Synthetic peptide"
QQFPFLEMK

SEQ ID NO: 28196 - protein, 9 aa, Artificial Sequence
  source: /note="Description of Artificial Sequence: Synthetic peptide"
QFPFLEMKI

SEQ ID NO: 28197 - protein, 9 aa, Artificial Sequence
  source: /note="Description of Artificial Sequence: Synthetic peptide"
APTHQQFPF

SEQ ID NO: 28198 - protein, 9 aa, Artificial Sequence
  source: /note="Description of Artificial Sequence: Synthetic peptide"
HQQFPFLEM

SEQ ID NO: 28199 - protein, 9 aa, Artificial Sequence
  source: /note="Description of Artificial Sequence: Synthetic peptide"
KRAPTHQQF

SEQ ID NO: 28200 - protein, 10 aa, Artificial Sequence
  source: /note="Description of Artificial Sequence: Synthetic peptide"
HQQFPFLEMK

SEQ ID NO: 28201 - protein, 10 aa, Artificial Sequence
  source: /note="Description of Artificial Sequence: Synthetic peptide"
RAPTHQQFPF

SEQ ID NO: 28202 - protein, 10 aa, Artificial Sequence
  source: /note="Description of Artificial Sequence: Synthetic peptide"
KSKRAPTHQQ

SEQ ID NO: 28203 - protein, 10 aa, Artificial Sequence
  source: /note="Description of Artificial Sequence: Synthetic peptide"
APTHQQFPFL

SEQ ID NO: 28204 - protein, 10 aa, Artificial Sequence
  source: /note="Description of Artificial Sequence: Synthetic peptide"
SKRAPTHQQF

SEQ ID NO: 28205 - protein, 10 aa, Artificial Sequence
  source: /note="Description of Artificial Sequence: Synthetic peptide"
THQQFPFLEM

SEQ ID NO: 28206 - protein, 10 aa, Artificial Sequence
  source: /note="Description of Artificial Sequence: Synthetic peptide"
QQFPFLEMKI

SEQ ID NO: 28207 - protein, 9 aa, Artificial Sequence
  source: /note="Description of Artificial Sequence: Synthetic peptide"
VIFNQIPFL

SEQ ID NO: 28208 - protein, 9 aa, Artificial Sequence
  source: /note="Description of Artificial Sequence: Synthetic peptide"
DVIFNQIPF

SEQ ID NO: 28209 - protein, 9 aa, Artificial Sequence
  source: /note="Description of Artificial Sequence: Synthetic peptide"
KEDVIFNQI

SEQ ID NO: 28210 - protein, 10 aa, Artificial Sequence
  source: /note="Description of Artificial Sequence: Synthetic peptide"
DVIFNQIPFL

SEQ ID NO: 28211 - protein, 9 aa, Artificial Sequence
  source: /note="Description of Artificial Sequence: Synthetic peptide"
EMFEWSFVF

SEQ ID NO: 28212 - protein, 9 aa, Artificial Sequence
  source: /note="Description of Artificial Sequence: Synthetic peptide"
EWSFVFEDF

SEQ ID NO: 28213 - protein, 9 aa, Artificial Sequence
  source: /note="Description of Artificial Sequence: Synthetic peptide"
AEMFEWSFV

SEQ ID NO: 28214 - protein, 9 aa, Artificial Sequence
  source: /note="Description of Artificial Sequence: Synthetic peptide"
FEWSFVFED

SEQ ID NO: 28215 - protein, 9 aa, Artificial Sequence
  source: /note="Description of Artificial Sequence: Synthetic peptide"
EAEMFEWSF

SEQ ID NO: 28216 - protein, 9 aa, Artificial Sequence
  source: /note="Description of Artificial Sequence: Synthetic peptide"
TEAEMFEWS

SEQ ID NO: 28217 - protein, 10 aa, Artificial Sequence
  source: /note="Description of Artificial Sequence: Synthetic peptide"
AEMFEWSFVF

SEQ ID NO: 28218 - protein, 10 aa, Artificial Sequence
  source: /note="Description of Artificial Sequence: Synthetic peptide"
EAEMFEWSFV

SEQ ID NO: 28219 - protein, 10 aa, Artificial Sequence
  source: /note="Description of Artificial Sequence: Synthetic peptide"
TEAEMFEWSF

SEQ ID NO: 28220 - protein, 10 aa, Artificial Sequence
  source: /note="Description of Artificial Sequence: Synthetic peptide"
FEWSFVFEDF

SEQ ID NO: 28221 - protein, 9 aa, Artificial Sequence
  source: /note="Description of Artificial Sequence: Synthetic peptide"
FSNWGHQKY

SEQ ID NO: 28222 - protein, 9 aa, Artificial Sequence
  source: /note="Description of Artificial Sequence: Synthetic peptide"
IFSNWGHQK

SEQ ID NO: 28223 - protein, 9 aa, Artificial Sequence
  source: /note="Description of Artificial Sequence: Synthetic peptide"
HQKYTCLYR

SEQ ID NO: 28224 - protein, 9 aa, Artificial Sequence
  source: /note="Description of Artificial Sequence: Synthetic peptide"
GHQKYTCLY

SEQ ID NO: 28225 - protein, 9 aa, Artificial Sequence
  source: /note="Description of Artificial Sequence: Synthetic peptide"
WGHQKYTCL

SEQ ID NO: 28226 - protein, 9 aa, Artificial Sequence
  source: /note="Description of Artificial Sequence: Synthetic peptide"
QKYTCLYRF

SEQ ID NO: 28227 - protein, 10 aa, Artificial Sequence
  source: /note="Description of Artificial Sequence: Synthetic peptide"
NIFSNWGHQK

SEQ ID NO: 28228 - protein, 10 aa, Artificial Sequence
  source: /note="Description of Artificial Sequence: Synthetic peptide"
HQKYTCLYRF

SEQ ID NO: 28229 - protein, 10 aa, Artificial Sequence
  source: /note="Description of Artificial Sequence: Synthetic peptide"
IFSNWGHQKY

SEQ ID NO: 28230 - protein, 10 aa, Artificial Sequence
  source: /note="Description of Artificial Sequence: Synthetic peptide"
WGHQKYTCLY

SEQ ID NO: 28231 - protein, 9 aa, Artificial Sequence
  source: /note="Description of Artificial Sequence: Synthetic peptide"
QIIFLIEQI

SEQ ID NO: 28232 - protein, 9 aa, Artificial Sequence
  source: /note="Description of Artificial Sequence: Synthetic peptide"
NFRQIIFLI

SEQ ID NO: 28233 - protein, 9 aa, Artificial Sequence
  source: /note="Description of Artificial Sequence: Synthetic peptide"
LENNFRQII

SEQ ID NO: 28234 - protein, 9 aa, Artificial Sequence
  source: /note="Description of Artificial Sequence: Synthetic peptide"
RQIIFLIEQ

SEQ ID NO: 28235 - protein, 10 aa, Artificial Sequence
  source: /note="Description of Artificial Sequence: Synthetic peptide"
RQIIFLIEQI

SEQ ID NO: 28236 - protein, 10 aa, Artificial Sequence
  source: /note="Description of Artificial Sequence: Synthetic peptide"
IFLIEQIDVL

SEQ ID NO: 28237 - protein, 10 aa, Artificial Sequence
  source: /note="Description of Artificial Sequence: Synthetic peptide"
LENNFRQIIF

SEQ ID NO: 28238 - protein, 9 aa, Artificial Sequence
  source: /note="Description of Artificial Sequence: Synthetic peptide"
FLIKQIDVL

SEQ ID NO: 28239 - protein, 9 aa, Artificial Sequence
  source: /note="Description of Artificial Sequence: Synthetic peptide"
KQIDVLKAL

SEQ ID NO: 28240 - protein, 9 aa, Artificial Sequence
  source: /note="Description of Artificial Sequence: Synthetic peptide"
LIKQIDVLK

SEQ ID NO: 28241 - protein, 10 aa, Artificial Sequence
  source: /note="Description of Artificial Sequence: Synthetic peptide"
ILFLIKQIDV

SEQ ID NO: 28242 - protein, 10 aa, Artificial Sequence
  source: /note="Description of Artificial Sequence: Synthetic peptide"
KQIDVLKALL

SEQ ID NO: 28243 - protein, 10 aa, Artificial Sequence
  source: /note="Description of Artificial Sequence: Synthetic peptide"
RQILFLIKQI

SEQ ID NO: 28244 - protein, 10 aa, Artificial Sequence
  source: /note="Description of Artificial Sequence: Synthetic peptide"
FLIKQIDVLK

SEQ ID NO: 28245 - protein, 10 aa, Artificial Sequence
  source: /note="Description of Artificial Sequence: Synthetic peptide"
NFRQILFLIK

SEQ ID NO: 28246 - protein, 10 aa, Artificial Sequence
  source: /note="Description of Artificial Sequence: Synthetic peptide"
IKQIDVLKAL

SEQ ID NO: 28247 - protein, 9 aa, Artificial Sequence
  source: /note="Description of Artificial Sequence: Synthetic peptide"
TLYCEFINR

SEQ ID NO: 28248 - protein, 9 aa, Artificial Sequence
  source: /note="Description of Artificial Sequence: Synthetic peptide"
LLNTLYCEF

SEQ ID NO: 28249 - protein, 9 aa, Artificial Sequence
  source: /note="Description of Artificial Sequence: Synthetic peptide"
VKEELLNTL

SEQ ID NO: 28250 - protein, 9 aa, Artificial Sequence
  source: /note="Description of Artificial Sequence: Synthetic peptide"
KEELLNTLY

SEQ ID NO: 28251 - protein, 10 aa, Artificial Sequence
  source: /note="Description of Artificial Sequence: Synthetic peptide"
LLNTLYCEFI

SEQ ID NO: 28252 - protein, 10 aa, Artificial Sequence
  source: /note="Description of Artificial Sequence: Synthetic peptide"
TLYCEFINRV

SEQ ID NO: 28253 - protein, 10 aa, Artificial Sequence
  source: /note="Description of Artificial Sequence: Synthetic peptide"
NTLYCEFINR

SEQ ID NO: 28254 - protein, 10 aa, Artificial Sequence
  source: /note="Description of Artificial Sequence: Synthetic peptide"
ELLNTLYCEF

SEQ ID NO: 28255 - protein, 10 aa, Artificial Sequence
  source: /note="Description of Artificial Sequence: Synthetic peptide"
VKEELLNTLY

SEQ ID NO: 28256 - protein, 9 aa, Artificial Sequence
  source: /note="Description of Artificial Sequence: Synthetic peptide"
MESVCEETV

SEQ ID NO: 28257 - protein, 9 aa, Artificial Sequence
  source: /note="Description of Artificial Sequence: Synthetic peptide"
CEETVNLTT

SEQ ID NO: 28258 - protein, 9 aa, Artificial Sequence
  source: /note="Description of Artificial Sequence: Synthetic peptide"
TPNHIPSMI

SEQ ID NO: 28259 - protein, 9 aa, Artificial Sequence
  source: /note="Description of Artificial Sequence: Synthetic peptide"
SMIMATTQP

SEQ ID NO: 28260 - protein, 9 aa, Artificial Sequence
  source: /note="Description of Artificial Sequence: Synthetic peptide"
MIMATTQPP

SEQ ID NO: 28261 - protein, 9 aa, Artificial Sequence
  source: /note="Description of Artificial Sequence: Synthetic peptide"
IPSMIMATT

SEQ ID NO: 28262 - protein, 10 aa, Artificial Sequence
  source: /note="Description of Artificial Sequence: Synthetic peptide"
MIMATTQPPV

SEQ ID NO: 28263 - protein, 10 aa, Artificial Sequence
  source: /note="Description of Artificial Sequence: Synthetic peptide"
KQTPNHIPSM

SEQ ID NO: 28264 - protein, 10 aa, Artificial Sequence
  source: /note="Description of Artificial Sequence: Synthetic peptide"
QTPNHIPSMI

SEQ ID NO: 28265 - protein, 10 aa, Artificial Sequence
  source: /note="Description of Artificial Sequence: Synthetic peptide"
TPNHIPSMIM

SEQ ID NO: 28266 - protein, 10 aa, Artificial Sequence
  source: /note="Description of Artificial Sequence: Synthetic peptide"
SMIMATTQPP

SEQ ID NO: 28267 - protein, 9 aa, Artificial Sequence
  source: /note="Description of Artificial Sequence: Synthetic peptide"
SMKPSYGSV

SEQ ID NO: 28268 - protein, 9 aa, Artificial Sequence
  source: /note="Description of Artificial Sequence: Synthetic peptide"
KPSYGSVAT

SEQ ID NO: 28269 - protein, 9 aa, Artificial Sequence
  source: /note="Description of Artificial Sequence: Synthetic peptide"
WPNSMKPSY

SEQ ID NO: 28270 - protein, 9 aa, Artificial Sequence
  source: /note="Description of Artificial Sequence: Synthetic peptide"
NEKNWPNSM

SEQ ID NO: 28271 - protein, 9 aa, Artificial Sequence
  source: /note="Description of Artificial Sequence: Synthetic peptide"
MKPSYGSVA

SEQ ID NO: 28272 - protein, 9 aa, Artificial Sequence
  source: /note="Description of Artificial Sequence: Synthetic peptide"
AASSGHCIL

SEQ ID NO: 28273 - protein, 10 aa, Artificial Sequence
  source: /note="Description of Artificial Sequence: Synthetic peptide"
SMKPSYGSVA

SEQ ID NO: 28274 - protein, 10 aa, Artificial Sequence
  source: /note="Description of Artificial Sequence: Synthetic peptide"
GGRGRHNDGK

SEQ ID NO: 28275 - protein, 10 aa, Artificial Sequence
  source: /note="Description of Artificial Sequence: Synthetic peptide"
NWPNSMKPSY

SEQ ID NO: 28276 - protein, 10 aa, Artificial Sequence
  source: /note="Description of Artificial Sequence: Synthetic peptide"
NSMKPSYGSV

SEQ ID NO: 28277 - protein, 10 aa, Artificial Sequence
  source: /note="Description of Artificial Sequence: Synthetic peptide"
KPSYGSVATA

SEQ ID NO: 28278 - protein, 10 aa, Artificial Sequence
  source: /note="Description of Artificial Sequence: Synthetic peptide"
KNEKNWPNSM

SEQ ID NO: 28279 - protein, 10 aa, Artificial Sequence
  source: /note="Description of Artificial Sequence: Synthetic peptide"
MKPSYGSVAT

SEQ ID NO: 28280 - protein, 10 aa, Artificial Sequence
  source: /note="Description of Artificial Sequence: Synthetic peptide"
TAASSGHCIL

SEQ ID NO: 28281 - protein, 10 aa, Artificial Sequence
  source: /note="Description of Artificial Sequence: Synthetic peptide"
SGHCILCLVW

SEQ ID NO: 28282 - protein, 10 aa, Artificial Sequence
  source: /note="Description of Artificial Sequence: Synthetic peptide"
YYQAGETYNG

SEQ ID NO: 28283 - protein, 10 aa, Artificial Sequence
  source: /note="Description of Artificial Sequence: Synthetic peptide"
DDYYQAGETY

SEQ ID NO: 28284 - protein, 10 aa, Artificial Sequence
  source: /note="Description of Artificial Sequence: Synthetic peptide"
TTDTHSLESK

SEQ ID NO: 28285 - protein, 9 aa, Artificial Sequence
  source: /note="Description of Artificial Sequence: Synthetic peptide"
KGICWKWPV

SEQ ID NO: 28286 - protein, 9 aa, Artificial Sequence
  source: /note="Description of Artificial Sequence: Synthetic peptide"
PWKGICWKW

SEQ ID NO: 28287 - protein, 9 aa, Artificial Sequence
  source: /note="Description of Artificial Sequence: Synthetic peptide"
CTRGGGKRK

SEQ ID NO: 28288 - protein, 9 aa, Artificial Sequence
  source: /note="Description of Artificial Sequence: Synthetic peptide"
RGGGKRKKK

SEQ ID NO: 28289 - protein, 9 aa, Artificial Sequence
  source: /note="Description of Artificial Sequence: Synthetic peptide"
CWKWPVTVA

SEQ ID NO: 28290 - protein, 9 aa, Artificial Sequence
  source: /note="Description of Artificial Sequence: Synthetic peptide"
FQGGWWCTR

SEQ ID NO: 28291 - protein, 9 aa, Artificial Sequence
  source: /note="Description of Artificial Sequence: Synthetic peptide"
LQCFQGGWW

SEQ ID NO: 28292 - protein, 9 aa, Artificial Sequence
  source: /note="Description of Artificial Sequence: Synthetic peptide"
CKVSGGCTA

SEQ ID NO: 28293 - protein, 9 aa, Artificial Sequence
  source: /note="Description of Artificial Sequence: Synthetic peptide"
WKWPVTVAA

SEQ ID NO: 28294 - protein, 9 aa, Artificial Sequence
  source: /note="Description of Artificial Sequence: Synthetic peptide"
VERCPWKGI

SEQ ID NO: 28295 - protein, 10 aa, Artificial Sequence
  source: /note="Description of Artificial Sequence: Synthetic peptide"
KVSGGCTACV

SEQ ID NO: 28296 - protein, 10 aa, Artificial Sequence
  source: /note="Description of Artificial Sequence: Synthetic peptide"
GICWKWPVTV

SEQ ID NO: 28297 - protein, 10 aa, Artificial Sequence
  source: /note="Description of Artificial Sequence: Synthetic peptide"
TACVERCPWK

SEQ ID NO: 28298 - protein, 10 aa, Artificial Sequence
  source: /note="Description of Artificial Sequence: Synthetic peptide"
CFLQCFQGGW

SEQ ID NO: 28299 - protein, 10 aa, Artificial Sequence
  source: /note="Description of Artificial Sequence: Synthetic peptide"
GWWCTRGGGK

SEQ ID NO: 28300 - protein, 10 aa, Artificial Sequence
  source: /note="Description of Artificial Sequence: Synthetic peptide"
CTRGGGKRKK

SEQ ID NO: 28301 - protein, 10 aa, Artificial Sequence
  source: /note="Description of Artificial Sequence: Synthetic peptide"
GGKRKKKMCK

SEQ ID NO: 28302 - protein, 10 aa, Artificial Sequence
  source: /note="Description of Artificial Sequence: Synthetic peptide"
CWKWPVTVAA

SEQ ID NO: 28303 - protein, 10 aa, Artificial Sequence
  source: /note="Description of Artificial Sequence: Synthetic peptide"
CFQGGWWCTR

SEQ ID NO: 28304 - protein, 10 aa, Artificial Sequence
  source: /note="Description of Artificial Sequence: Synthetic peptide"
CPWKGICWKW

SEQ ID NO: 28305 - protein, 9 aa, Artificial Sequence
  source: /note="Description of Artificial Sequence: Synthetic peptide"
KTTPSNRKM

SEQ ID NO: 28306 - protein, 9 aa, Artificial Sequence
  source: /note="Description of Artificial Sequence: Synthetic peptide"
NRKMSEASM

SEQ ID NO: 28307 - protein, 10 aa, Artificial Sequence
  source: /note="Description of Artificial Sequence: Synthetic peptide"
TPSNRKMSEA

SEQ ID NO: 28308 - protein, 10 aa, Artificial Sequence
  source: /note="Description of Artificial Sequence: Synthetic peptide"
SQLEKTTPSN

SEQ ID NO: 28309 - protein, 10 aa, Artificial Sequence
  source: /note="Description of Artificial Sequence: Synthetic peptide"
SNRKMSEASM

SEQ ID NO: 28310 - protein, 9 aa, Artificial Sequence
  source: /note="Description of Artificial Sequence: Synthetic peptide"
IGRNMPSSK

SEQ ID NO: 28311 - protein, 9 aa, Artificial Sequence
  source: /note="Description of Artificial Sequence: Synthetic peptide"
PQAEIGRNM

SEQ ID NO: 28312 - protein, 9 aa, Artificial Sequence
  source: /note="Description of Artificial Sequence: Synthetic peptide"
AEIGRNMPS

SEQ ID NO: 28313 - protein, 10 aa, Artificial Sequence
  source: /note="Description of Artificial Sequence: Synthetic peptide"
TPQAEIGRNM

SEQ ID NO: 28314 - protein, 10 aa, Artificial Sequence
  source: /note="Description of Artificial Sequence: Synthetic peptide"
AEIGRNMPSS

SEQ ID NO: 28315 - protein, 10 aa, Artificial Sequence
  source: /note="Description of Artificial Sequence: Synthetic peptide"
LQRPEPQQPT

SEQ ID NO: 28316 - protein, 9 aa, Artificial Sequence
  source: /note="Description of Artificial Sequence: Synthetic peptide"
YLSADDIKI

SEQ ID NO: 28317 - protein, 9 aa, Artificial Sequence
  source: /note="Description of Artificial Sequence: Synthetic peptide"
FIYLSADDI

SEQ ID NO: 28318 - protein, 9 aa, Artificial Sequence
  source: /note="Description of Artificial Sequence: Synthetic peptide"
YPDGKFIYL

SEQ ID NO: 28319 - protein, 10 aa, Artificial Sequence
  source: /note="Description of Artificial Sequence: Synthetic peptide"
FIYLSADDIK

SEQ ID NO: 28320 - protein, 10 aa, Artificial Sequence
  source: /note="Description of Artificial Sequence: Synthetic peptide"
EYPDGKFIYL

SEQ ID NO: 28321 - protein, 10 aa, Artificial Sequence
  source: /note="Description of Artificial Sequence: Synthetic peptide"
KFIYLSADDI

SEQ ID NO: 28322 - protein, 10 aa, Artificial Sequence
  source: /note="Description of Artificial Sequence: Synthetic peptide"
IYLSADDIKI

SEQ ID NO: 28323 - protein, 10 aa, Artificial Sequence
  source: /note="Description of Artificial Sequence: Synthetic peptide"
LEYPDGKFIY

SEQ ID NO: 28324 - protein, 9 aa, Artificial Sequence
  source: /note="Description of Artificial Sequence: Synthetic peptide"
CLCDEIINK

SEQ ID NO: 28325 - protein, 9 aa, Artificial Sequence
  source: /note="Description of Artificial Sequence: Synthetic peptide"
IINKLNENK

SEQ ID NO: 28326 - protein, 9 aa, Artificial Sequence
  source: /note="Description of Artificial Sequence: Synthetic peptide"
NKLNENKTF

SEQ ID NO: 28327 - protein, 10 aa, Artificial Sequence
  source: /note="Description of Artificial Sequence: Synthetic peptide"
CLCDEIINKL

SEQ ID NO: 28328 - protein, 9 aa, Artificial Sequence
  source: /note="Description of Artificial Sequence: Synthetic peptide"
LQNDAPVPY

SEQ ID NO: 28329 - protein, 10 aa, Artificial Sequence
  source: /note="Description of Artificial Sequence: Synthetic peptide"
FQDLQNDAPV

SEQ ID NO: 28330 - protein, 10 aa, Artificial Sequence
  source: /note="Description of Artificial Sequence: Synthetic peptide"
LQNDAPVPYK

SEQ ID NO: 28331 - protein, 10 aa, Artificial Sequence
  source: /note="Description of Artificial Sequence: Synthetic peptide"
DLQNDAPVPY

SEQ ID NO: 28332 - protein, 9 aa, Artificial Sequence
  source: /note="Description of Artificial Sequence: Synthetic peptide"
FVFFRPQHA

SEQ ID NO: 28333 - protein, 9 aa, Artificial Sequence
  source: /note="Description of Artificial Sequence: Synthetic peptide"
GVCLFVFFR

SEQ ID NO: 28334 - protein, 9 aa, Artificial Sequence
  source: /note="Description of Artificial Sequence: Synthetic peptide"
VGVCLFVFF

SEQ ID NO: 28335 - protein, 9 aa, Artificial Sequence
  source: /note="Description of Artificial Sequence: Synthetic peptide"
FFRPQHAPF

SEQ ID NO: 28336 - protein, 10 aa, Artificial Sequence
  source: /note="Description of Artificial Sequence: Synthetic peptide"
VFFRPQHAPF

SEQ ID NO: 28337 - protein, 10 aa, Artificial Sequence
  source: /note="Description of Artificial Sequence: Synthetic peptide"
FFRPQHAPFI

SEQ ID NO: 28338 - protein, 10 aa, Artificial Sequence
  source: /note="Description of Artificial Sequence: Synthetic peptide"
VGVCLFVFFR

SEQ ID NO: 28339 - protein, 9 aa, Artificial Sequence
  source: /note="Description of Artificial Sequence: Synthetic peptide"
TVRHTWSPG

SEQ ID NO: 28340 - protein, 10 aa, Artificial Sequence
  source: /note="Description of Artificial Sequence: Synthetic peptide"
TVRHTWSPGA

SEQ ID NO: 28341 - protein, 9 aa, Artificial Sequence
  source: /note="Description of Artificial Sequence: Synthetic peptide"
HLLRHPWTV

SEQ ID NO: 28342 - protein, 9 aa, Artificial Sequence
  source: /note="Description of Artificial Sequence: Synthetic peptide"
TVFNFADGK

SEQ ID NO: 28343 - protein, 9 aa, Artificial Sequence
  source: /note="Description of Artificial Sequence: Synthetic peptide"
TSQGSDWNK

SEQ ID NO: 28344 - protein, 9 aa, Artificial Sequence
  source: /note="Description of Artificial Sequence: Synthetic peptide"
RFNGEKVGF

SEQ ID NO: 28345 - protein, 9 aa, Artificial Sequence
  source: /note="Description of Artificial Sequence: Synthetic peptide"
RHPWTVFNF

SEQ ID NO: 28346 - protein, 9 aa, Artificial Sequence
  source: /note="Description of Artificial Sequence: Synthetic peptide"
KVGFRCVHL

SEQ ID NO: 28347 - protein, 9 aa, Artificial Sequence
  source: /note="Description of Artificial Sequence: Synthetic peptide"
GFRCVHLLR

SEQ ID NO: 28348 - protein, 9 aa, Artificial Sequence
  source: /note="Description of Artificial Sequence: Synthetic peptide"
KTSTRSTSA

SEQ ID NO: 28349 - protein, 9 aa, Artificial Sequence
  source: /note="Description of Artificial Sequence: Synthetic peptide"
STRSTSATS

SEQ ID NO: 28350 - protein, 9 aa, Artificial Sequence
  source: /note="Description of Artificial Sequence: Synthetic peptide"
LLRHPWTVF

SEQ ID NO: 28351 - protein, 9 aa, Artificial Sequence
  source: /note="Description of Artificial Sequence: Synthetic peptide"
CVHLLRHPW

SEQ ID NO: 28352 - protein, 9 aa, Artificial Sequence
  source: /note="Description of Artificial Sequence: Synthetic peptide"
HPWTVFNFA

SEQ ID NO: 28353 - protein, 9 aa, Artificial Sequence
  source: /note="Description of Artificial Sequence: Synthetic peptide"
GEKVGFRCV

SEQ ID NO: 28354 - protein, 10 aa, Artificial Sequence
  source: /note="Description of Artificial Sequence: Synthetic peptide"
VGFRCVHLLR

SEQ ID NO: 28355 - protein, 10 aa, Artificial Sequence
  source: /note="Description of Artificial Sequence: Synthetic peptide"
WTVFNFADGK

SEQ ID NO: 28356 - protein, 10 aa, Artificial Sequence
  source: /note="Description of Artificial Sequence: Synthetic peptide"
ATSQGSDWNK

SEQ ID NO: 28357 - protein, 10 aa, Artificial Sequence
  source: /note="Description of Artificial Sequence: Synthetic peptide"
HLLRHPWTVF

SEQ ID NO: 28358 - protein, 10 aa, Artificial Sequence
  source: /note="Description of Artificial Sequence: Synthetic peptide"
LRHPWTVFNF

SEQ ID NO: 28359 - protein, 10 aa, Artificial Sequence
  source: /note="Description of Artificial Sequence: Synthetic peptide"
KVGFRCVHLL

SEQ ID NO: 28360 - protein, 10 aa, Artificial Sequence
  source: /note="Description of Artificial Sequence: Synthetic peptide"
GFRCVHLLRH

SEQ ID NO: 28361 - protein, 10 aa, Artificial Sequence
  source: /note="Description of Artificial Sequence: Synthetic peptide"
KTSTRSTSAT

SEQ ID NO: 28362 - protein, 10 aa, Artificial Sequence
  source: /note="Description of Artificial Sequence: Synthetic peptide"
STRSTSATSQ

SEQ ID NO: 28363 - protein, 10 aa, Artificial Sequence
  source: /note="Description of Artificial Sequence: Synthetic peptide"
RFNGEKVGFR

SEQ ID NO: 28364 - protein, 10 aa, Artificial Sequence
  source: /note="Description of Artificial Sequence: Synthetic peptide"
NFADGKTSTR

SEQ ID NO: 28365 - protein, 10 aa, Artificial Sequence
  source: /note="Description of Artificial Sequence: Synthetic peptide"
PQRPPPSNRF

SEQ ID NO: 28366 - protein, 10 aa, Artificial Sequence
  source: /note="Description of Artificial Sequence: Synthetic peptide"
NRFNGEKVGF

SEQ ID NO: 28367 - protein, 10 aa, Artificial Sequence
  source: /note="Description of Artificial Sequence: Synthetic peptide"
RCVHLLRHPW

SEQ ID NO: 28368 - protein, 9 aa, Artificial Sequence
  source: /note="Description of Artificial Sequence: Synthetic peptide"
TIQTKPEEK

SEQ ID NO: 28369 - protein, 9 aa, Artificial Sequence
  source: /note="Description of Artificial Sequence: Synthetic peptide"
IQTKPEEKM

SEQ ID NO: 28370 - protein, 10 aa, Artificial Sequence
  source: /note="Description of Artificial Sequence: Synthetic peptide"
RNRPETIQTK

SEQ ID NO: 28371 - protein, 10 aa, Artificial Sequence
  source: /note="Description of Artificial Sequence: Synthetic peptide"
IQTKPEEKMF

SEQ ID NO: 28372 - protein, 9 aa, Artificial Sequence
  source: /note="Description of Artificial Sequence: Synthetic peptide"
GQPQIHVYF

SEQ ID NO: 28373 - protein, 9 aa, Artificial Sequence
  source: /note="Description of Artificial Sequence: Synthetic peptide"
MARRGQPQI

SEQ ID NO: 28374 - protein, 9 aa, Artificial Sequence
  source: /note="Description of Artificial Sequence: Synthetic peptide"
RGQPQIHVY

SEQ ID NO: 28375 - protein, 9 aa, Artificial Sequence
  source: /note="Description of Artificial Sequence: Synthetic peptide"
QPQIHVYFR

SEQ ID NO: 28376 - protein, 9 aa, Artificial Sequence
  source: /note="Description of Artificial Sequence: Synthetic peptide"
AQGDPESRL

SEQ ID NO: 28377 - protein, 10 aa, Artificial Sequence
  source: /note="Description of Artificial Sequence: Synthetic peptide"
SMARRGQPQI

SEQ ID NO: 28378 - protein, 10 aa, Artificial Sequence
  source: /note="Description of Artificial Sequence: Synthetic peptide"
RGQPQIHVYF

SEQ ID NO: 28379 - protein, 10 aa, Artificial Sequence
  source: /note="Description of Artificial Sequence: Synthetic peptide"
MARRGQPQIH

SEQ ID NO: 28380 - protein, 10 aa, Artificial Sequence
  source: /note="Description of Artificial Sequence: Synthetic peptide"
RRGQPQIHVY

SEQ ID NO: 28381 - protein, 9 aa, Artificial Sequence
  source: /note="Description of Artificial Sequence: Synthetic peptide"
HLAWSSQSL

SEQ ID NO: 28382 - protein, 9 aa, Artificial Sequence
  source: /note="Description of Artificial Sequence: Synthetic peptide"
SLSLHGSAV

SEQ ID NO: 28383 - protein, 9 aa, Artificial Sequence
  source: /note="Description of Artificial Sequence: Synthetic peptide"
CLRELIFTL

SEQ ID NO: 28384 - protein, 9 aa, Artificial Sequence
  source: /note="Description of Artificial Sequence: Synthetic peptide"
LLHTSLCMC

SEQ ID NO: 28385 - protein, 9 aa, Artificial Sequence
  source: /note="Description of Artificial Sequence: Synthetic peptide"
SLCMCLREL

SEQ ID NO: 28386 - protein, 9 aa, Artificial Sequence
  source: /note="Description of Artificial Sequence: Synthetic peptide"
WLRSPPAGK

SEQ ID NO: 28387 - protein, 9 aa, Artificial Sequence
  source: /note="Description of Artificial Sequence: Synthetic peptide"
HTSLCMCLR

SEQ ID NO: 28388 - protein, 9 aa, Artificial Sequence
  source: /note="Description of Artificial Sequence: Synthetic peptide"
QWWGSSVHL

SEQ ID NO: 28389 - protein, 9 aa, Artificial Sequence
  source: /note="Description of Artificial Sequence: Synthetic peptide"
AVRENHPSL

SEQ ID NO: 28390 - protein, 9 aa, Artificial Sequence
  source: /note="Description of Artificial Sequence: Synthetic peptide"
LTRLLHTSL

SEQ ID NO: 28391 - protein, 9 aa, Artificial Sequence
  source: /note="Description of Artificial Sequence: Synthetic peptide"
LSLHGSAVR

SEQ ID NO: 28392 - protein, 9 aa, Artificial Sequence
  source: /note="Description of Artificial Sequence: Synthetic peptide"
SPPAGKNLM

SEQ ID NO: 28393 - protein, 9 aa, Artificial Sequence
  source: /note="Description of Artificial Sequence: Synthetic peptide"
SPQWWGSSV

SEQ ID NO: 28394 - protein, 9 aa, Artificial Sequence
  source: /note="Description of Artificial Sequence: Synthetic peptide"
RLLHTSLCM

SEQ ID NO: 28395 - protein, 9 aa, Artificial Sequence
  source: /note="Description of Artificial Sequence: Synthetic peptide"
KNLMKSPQW

SEQ ID NO: 28396 - protein, 9 aa, Artificial Sequence
  source: /note="Description of Artificial Sequence: Synthetic peptide"
PQWWGSSVH

SEQ ID NO: 28397 - protein, 9 aa, Artificial Sequence
  source: /note="Description of Artificial Sequence: Synthetic peptide"
WGSSVHLAW

SEQ ID NO: 28398 - protein, 9 aa, Artificial Sequence
  source: /note="Description of Artificial Sequence: Synthetic peptide"
AWSSQSLSL

SEQ ID NO: 28399 - protein, 9 aa, Artificial Sequence
  source: /note="Description of Artificial Sequence: Synthetic peptide"
CMCLRELIF

SEQ ID NO: 28400 - protein, 9 aa, Artificial Sequence
  source: /note="Description of Artificial Sequence: Synthetic peptide"
RELIFTLKT

SEQ ID NO: 28401 - protein, 10 aa, Artificial Sequence
  source: /note="Description of Artificial Sequence: Synthetic peptide"
SLTRLLHTSL

SEQ ID NO: 28402 - protein, 10 aa, Artificial Sequence
  source: /note="Description of Artificial Sequence: Synthetic peptide"
LLHTSLCMCL

SEQ ID NO: 28403 - protein, 10 aa, Artificial Sequence
  source: /note="Description of Artificial Sequence: Synthetic peptide"
SLCMCLRELI

SEQ ID NO: 28404 - protein, 10 aa, Artificial Sequence
  source: /note="Description of Artificial Sequence: Synthetic peptide"
CLRELIFTLK

SEQ ID NO: 28405 - protein, 10 aa, Artificial Sequence
  source: /note="Description of Artificial Sequence: Synthetic peptide"
WWGSSVHLAW

SEQ ID NO: 28406 - protein, 10 aa, Artificial Sequence
  source: /note="Description of Artificial Sequence: Synthetic peptide"
KSPQWWGSSV

SEQ ID NO: 28407 - protein, 10 aa, Artificial Sequence
  source: /note="Description of Artificial Sequence: Synthetic peptide"
AVRENHPSLT

SEQ ID NO: 28408 - protein, 10 aa, Artificial Sequence
  source: /note="Description of Artificial Sequence: Synthetic peptide"
SLSLHGSAVR

SEQ ID NO: 28409 - protein, 10 aa, Artificial Sequence
  source: /note="Description of Artificial Sequence: Synthetic peptide"
HPSLTRLLHT

SEQ ID NO: 28410 - protein, 10 aa, Artificial Sequence
  source: /note="Description of Artificial Sequence: Synthetic peptide"
LAWSSQSLSL

SEQ ID NO: 28411 - protein, 10 aa, Artificial Sequence
  source: /note="Description of Artificial Sequence: Synthetic peptide"
GKNLMKSPQW

SEQ ID NO: 28412 - protein, 10 aa, Artificial Sequence
  source: /note="Description of Artificial Sequence: Synthetic peptide"
PQWWGSSVHL

SEQ ID NO: 28413 - protein, 10 aa, Artificial Sequence
  source: /note="Description of Artificial Sequence: Synthetic peptide"
VHLAWSSQSL

SEQ ID NO: 28414 - protein, 10 aa, Artificial Sequence
  source: /note="Description of Artificial Sequence: Synthetic peptide"
SQSLSLHGSA

SEQ ID NO: 28415 - protein, 10 aa, Artificial Sequence
  source: /note="Description of Artificial Sequence: Synthetic peptide"
SAVRENHPSL

SEQ ID NO: 28416 - protein, 10 aa, Artificial Sequence
  source: /note="Description of Artificial Sequence: Synthetic peptide"
RENHPSLTRL

SEQ ID NO: 28417 - protein, 10 aa, Artificial Sequence
  source: /note="Description of Artificial Sequence: Synthetic peptide"
TRLLHTSLCM

SEQ ID NO: 28418 - protein, 10 aa, Artificial Sequence
  source: /note="Description of Artificial Sequence: Synthetic peptide"
LCMCLRELIF

SEQ ID NO: 28419 - protein, 10 aa, Artificial Sequence
  source: /note="Description of Artificial Sequence: Synthetic peptide"
SPQWWGSSVH

SEQ ID NO: 28420 - protein, 9 aa, Artificial Sequence
  source: /note="Description of Artificial Sequence: Synthetic peptide"
KLREMTIII

SEQ ID NO: 28421 - protein, 9 aa, Artificial Sequence
  source: /note="Description of Artificial Sequence: Synthetic peptide"
IPTEKLREM

SEQ ID NO: 28422 - protein, 9 aa, Artificial Sequence
  source: /note="Description of Artificial Sequence: Synthetic peptide"
REMTIIITV

SEQ ID NO: 28423 - protein, 9 aa, Artificial Sequence
  source: /note="Description of Artificial Sequence: Synthetic peptide"
EMTIIITVM

SEQ ID NO: 28424 - protein, 10 aa, Artificial Sequence
  source: /note="Description of Artificial Sequence: Synthetic peptide"
MTIIITVMDK

SEQ ID NO: 28425 - protein, 10 aa, Artificial Sequence
  source: /note="Description of Artificial Sequence: Synthetic peptide"
KLREMTIIIT

SEQ ID NO: 28426 - protein, 10 aa, Artificial Sequence
  source: /note="Description of Artificial Sequence: Synthetic peptide"
REMTIIITVM

SEQ ID NO: 28427 - protein, 9 aa, Artificial Sequence
  source: /note="Description of Artificial Sequence: Synthetic peptide"
QWHPLRPAR

SEQ ID NO: 28428 - protein, 9 aa, Artificial Sequence
  source: /note="Description of Artificial Sequence: Synthetic peptide"
PIAQWHPLR

SEQ ID NO: 28429 - protein, 9 aa, Artificial Sequence
  source: /note="Description of Artificial Sequence: Synthetic peptide"
RPIAQWHPL

SEQ ID NO: 28430 - protein, 9 aa, Artificial Sequence
  source: /note="Description of Artificial Sequence: Synthetic peptide"
HARRPIAQW

SEQ ID NO: 28431 - protein, 9 aa, Artificial Sequence
  source: /note="Description of Artificial Sequence: Synthetic peptide"
AQWHPLRPA

SEQ ID NO: 28432 - protein, 10 aa, Artificial Sequence
  source: /note="Description of Artificial Sequence: Synthetic peptide"
HARRPIAQWH

SEQ ID NO: 28433 - protein, 10 aa, Artificial Sequence
  source: /note="Description of Artificial Sequence: Synthetic peptide"
RPIAQWHPLR

SEQ ID NO: 28434 - protein, 10 aa, Artificial Sequence
  source: /note="Description of Artificial Sequence: Synthetic peptide"
AHARRPIAQW

SEQ ID NO: 28435 - protein, 10 aa, Artificial Sequence
  source: /note="Description of Artificial Sequence: Synthetic peptide"
RRPIAQWHPL

SEQ ID NO: 28436 - protein, 9 aa, Artificial Sequence
  source: /note="Description of Artificial Sequence: Synthetic peptide"
QSMENSPTM

SEQ ID NO: 28437 - protein, 10 aa, Artificial Sequence
  source: /note="Description of Artificial Sequence: Synthetic peptide"
PQSMENSPTM

SEQ ID NO: 28438 - protein, 9 aa, Artificial Sequence
  source: /note="Description of Artificial Sequence: Synthetic peptide"
QTVPTALQI

SEQ ID NO: 28439 - protein, 9 aa, Artificial Sequence
  source: /note="Description of Artificial Sequence: Synthetic peptide"
LPSGQTVPT

SEQ ID NO: 28440 - protein, 9 aa, Artificial Sequence
  source: /note="Description of Artificial Sequence: Synthetic peptide"
TALQILPQI

SEQ ID NO: 28441 - protein, 10 aa, Artificial Sequence
  source: /note="Description of Artificial Sequence: Synthetic peptide"
GQTVPTALQI

SEQ ID NO: 28442 - protein, 10 aa, Artificial Sequence
  source: /note="Description of Artificial Sequence: Synthetic peptide"
LPSGQTVPTA

SEQ ID NO: 28443 - protein, 9 aa, Artificial Sequence
  source: /note="Description of Artificial Sequence: Synthetic peptide"
FTLWGPEAK

SEQ ID NO: 28444 - protein, 9 aa, Artificial Sequence
  source: /note="Description of Artificial Sequence: Synthetic peptide"
EAKGGWTSR

SEQ ID NO: 28445 - protein, 10 aa, Artificial Sequence
  source: /note="Description of Artificial Sequence: Synthetic peptide"
RFTLWGPEAK

SEQ ID NO: 28446 - protein, 9 aa, Artificial Sequence
  source: /note="Description of Artificial Sequence: Synthetic peptide"
IWKRLKLCA

SEQ ID NO: 28447 - protein, 9 aa, Artificial Sequence
  source: /note="Description of Artificial Sequence: Synthetic peptide"
HSESSIWKR

SEQ ID NO: 28448 - protein, 9 aa, Artificial Sequence
  source: /note="Description of Artificial Sequence: Synthetic peptide"
SESSIWKRL

SEQ ID NO: 28449 - protein, 10 aa, Artificial Sequence
  source: /note="Description of Artificial Sequence: Synthetic peptide"
FPSHSESSIW

SEQ ID NO: 28450 - protein, 10 aa, Artificial Sequence
  source: /note="Description of Artificial Sequence: Synthetic peptide"
WKRLKLCADF

SEQ ID NO: 28451 - protein, 9 aa, Artificial Sequence
  source: /note="Description of Artificial Sequence: Synthetic peptide"
SSMEILINL

SEQ ID NO: 28452 - protein, 9 aa, Artificial Sequence
  source: /note="Description of Artificial Sequence: Synthetic peptide"
SMEILINLI

SEQ ID NO: 28453 - protein, 9 aa, Artificial Sequence
  source: /note="Description of Artificial Sequence: Synthetic peptide"
NTSSMEILI

SEQ ID NO: 28454 - protein, 9 aa, Artificial Sequence
  source: /note="Description of Artificial Sequence: Synthetic peptide"
RHGENTSSM

SEQ ID NO: 28455 - protein, 9 aa, Artificial Sequence
  source: /note="Description of Artificial Sequence: Synthetic peptide"
GENTSSMEI

SEQ ID NO: 28456 - protein, 9 aa, Artificial Sequence
  source: /note="Description of Artificial Sequence: Synthetic peptide"
MEILINLIQ

SEQ ID NO: 28457 - protein, 10 aa, Artificial Sequence
  source: /note="Description of Artificial Sequence: Synthetic peptide"
SSMEILINLI

SEQ ID NO: 28458 - protein, 10 aa, Artificial Sequence
  source: /note="Description of Artificial Sequence: Synthetic peptide"
WRHGENTSSM

SEQ ID NO: 28459 - protein, 10 aa, Artificial Sequence
  source: /note="Description of Artificial Sequence: Synthetic peptide"
GENTSSMEIL

SEQ ID NO: 28460 - protein, 10 aa, Artificial Sequence
  source: /note="Description of Artificial Sequence: Synthetic peptide"
MEILINLIQA

SEQ ID NO: 28461 - protein, 9 aa, Artificial Sequence
  source: /note="Description of Artificial Sequence: Synthetic peptide"
GTFLDLPCF

SEQ ID NO: 28462 - protein, 9 aa, Artificial Sequence
  source: /note="Description of Artificial Sequence: Synthetic peptide"
LDLPCFPDI

SEQ ID NO: 28463 - protein, 10 aa, Artificial Sequence
  source: /note="Description of Artificial Sequence: Synthetic peptide"
FLDLPCFPDI

SEQ ID NO: 28464 - protein, 10 aa, Artificial Sequence
  source: /note="Description of Artificial Sequence: Synthetic peptide"
VGTFLDLPCF

SEQ ID NO: 28465 - protein, 9 aa, Artificial Sequence
  source: /note="Description of Artificial Sequence: Synthetic peptide"
DIKKPFLPI

SEQ ID NO: 28466 - protein, 9 aa, Artificial Sequence
  source: /note="Description of Artificial Sequence: Synthetic peptide"
RMEDIKKPF

SEQ ID NO: 28467 - protein, 9 aa, Artificial Sequence
  source: /note="Description of Artificial Sequence: Synthetic peptide"
MEDIKKPFL

SEQ ID NO: 28468 - protein, 10 aa, Artificial Sequence
  source: /note="Description of Artificial Sequence: Synthetic peptide"
KPFLPIQKAA

SEQ ID NO: 28469 - protein, 10 aa, Artificial Sequence
  source: /note="Description of Artificial Sequence: Synthetic peptide"
IRMEDIKKPF

SEQ ID NO: 28470 - protein, 10 aa, Artificial Sequence
  source: /note="Description of Artificial Sequence: Synthetic peptide"
RMEDIKKPFL

SEQ ID NO: 28471 - protein, 9 aa, Artificial Sequence
  source: /note="Description of Artificial Sequence: Synthetic peptide"
LLEEAVAGA

SEQ ID NO: 28472 - protein, 9 aa, Artificial Sequence
  source: /note="Description of Artificial Sequence: Synthetic peptide"
EEAVAGAGA

SEQ ID NO: 28473 - protein, 10 aa, Artificial Sequence
  source: /note="Description of Artificial Sequence: Synthetic peptide"
GLLEEAVAGA

SEQ ID NO: 28474 - protein, 10 aa, Artificial Sequence
  source: /note="Description of Artificial Sequence: Synthetic peptide"
LEEAVAGAGA

SEQ ID NO: 28475 - protein, 9 aa, Artificial Sequence
  source: /note="Description of Artificial Sequence: Synthetic peptide"
NQDSDLVVL

SEQ ID NO: 28476 - protein, 9 aa, Artificial Sequence
  source: /note="Description of Artificial Sequence: Synthetic peptide"
FPNQDSDLV

SEQ ID NO: 28477 - protein, 10 aa, Artificial Sequence
  source: /note="Description of Artificial Sequence: Synthetic peptide"
KPFPNQDSDL

SEQ ID NO: 28478 - protein, 10 aa, Artificial Sequence
  source: /note="Description of Artificial Sequence: Synthetic peptide"
FPNQDSDLVV

SEQ ID NO: 28479 - protein, 10 aa, Artificial Sequence
  source: /note="Description of Artificial Sequence: Synthetic peptide"
RIRSLLERQG

SEQ ID NO: 28480 - protein, 9 aa, Artificial Sequence
  source: /note="Description of Artificial Sequence: Synthetic peptide"
RVISVLKNA

SEQ ID NO: 28481 - protein, 9 aa, Artificial Sequence
  source: /note="Description of Artificial Sequence: Synthetic peptide"
IWRVISVLK

SEQ ID NO: 28482 - protein, 9 aa, Artificial Sequence
  source: /note="Description of Artificial Sequence: Synthetic peptide"
NPIWRVISV

SEQ ID NO: 28483 - protein, 10 aa, Artificial Sequence
  source: /note="Description of Artificial Sequence: Synthetic peptide"
VLKNASIQHL

SEQ ID NO: 28484 - protein, 10 aa, Artificial Sequence
  source: /note="Description of Artificial Sequence: Synthetic peptide"
PIWRVISVLK

SEQ ID NO: 28485 - protein, 10 aa, Artificial Sequence
  source: /note="Description of Artificial Sequence: Synthetic peptide"
NPIWRVISVL

SEQ ID NO: 28486 - protein, 9 aa, Artificial Sequence
  source: /note="Description of Artificial Sequence: Synthetic peptide"
AARPFRRLK

SEQ ID NO: 28487 - protein, 9 aa, Artificial Sequence
  source: /note="Description of Artificial Sequence: Synthetic peptide"
RLKASRDQL

SEQ ID NO: 28488 - protein, 9 aa, Artificial Sequence
  source: /note="Description of Artificial Sequence: Synthetic peptide"
RPFRRLKAS

SEQ ID NO: 28489 - protein, 10 aa, Artificial Sequence
  source: /note="Description of Artificial Sequence: Synthetic peptide"
AAARPFRRLK

SEQ ID NO: 28490 - protein, 10 aa, Artificial Sequence
  source: /note="Description of Artificial Sequence: Synthetic peptide"
AARPFRRLKA

SEQ ID NO: 28491 - protein, 10 aa, Artificial Sequence
  source: /note="Description of Artificial Sequence: Synthetic peptide"
RPFRRLKASR

SEQ ID NO: 28492 - protein, 10 aa, Artificial Sequence
  source: /note="Description of Artificial Sequence: Synthetic peptide"
RLKASRDQLR

SEQ ID NO: 28493 - protein, 10 aa, Artificial Sequence
  source: /note="Description of Artificial Sequence: Synthetic peptide"
RRLKASRDQL

SEQ ID NO: 28494 - protein, 9 aa, Artificial Sequence
  source: /note="Description of Artificial Sequence: Synthetic peptide"
TYWEDNPEM

SEQ ID NO: 28495 - protein, 10 aa, Artificial Sequence
  source: /note="Description of Artificial Sequence: Synthetic peptide"
STYWEDNPEM

SEQ ID NO: 28496 - protein, 10 aa, Artificial Sequence
  source: /note="Description of Artificial Sequence: Synthetic peptide"
WEDNPEMETL

SEQ ID NO: 28497 - protein, 9 aa, Artificial Sequence
  source: /note="Description of Artificial Sequence: Synthetic peptide"
KLQQSTACV

SEQ ID NO: 28498 - protein, 9 aa, Artificial Sequence
  source: /note="Description of Artificial Sequence: Synthetic peptide"
LQQSTACVV

SEQ ID NO: 28499 - protein, 9 aa, Artificial Sequence
  source: /note="Description of Artificial Sequence: Synthetic peptide"
STACVVVVF

SEQ ID NO: 28500 - protein, 9 aa, Artificial Sequence
  source: /note="Description of Artificial Sequence: Synthetic peptide"
QSTACVVVV

SEQ ID NO: 28501 - protein, 9 aa, Artificial Sequence
  source: /note="Description of Artificial Sequence: Synthetic peptide"
QQSTACVVV

SEQ ID NO: 28502 - protein, 10 aa, Artificial Sequence
  source: /note="Description of Artificial Sequence: Synthetic peptide"
KLQQSTACVV

SEQ ID NO: 28503 - protein, 10 aa, Artificial Sequence
  source: /note="Description of Artificial Sequence: Synthetic peptide"
QQSTACVVVV

SEQ ID NO: 28504 - protein, 10 aa, Artificial Sequence
  source: /note="Description of Artificial Sequence: Synthetic peptide"
STACVVVVFS

SEQ ID NO: 28505 - protein, 10 aa, Artificial Sequence
  source: /note="Description of Artificial Sequence: Synthetic peptide"
LQQSTACVVV

SEQ ID NO: 28506 - protein, 10 aa, Artificial Sequence
  source: /note="Description of Artificial Sequence: Synthetic peptide"
QSTACVVVVF

SEQ ID NO: 28507 - protein, 9 aa, Artificial Sequence
  source: /note="Description of Artificial Sequence: Synthetic peptide"
CVDCKAGSY

SEQ ID NO: 28508 - protein, 10 aa, Artificial Sequence
  source: /note="Description of Artificial Sequence: Synthetic peptide"
CVDCKAGSYR

SEQ ID NO: 28509 - protein, 9 aa, Artificial Sequence
  source: /note="Description of Artificial Sequence: Synthetic peptide"
QIFSFVAEL

SEQ ID NO: 28510 - protein, 9 aa, Artificial Sequence
  source: /note="Description of Artificial Sequence: Synthetic peptide"
FVAELSVPL

SEQ ID NO: 28511 - protein, 9 aa, Artificial Sequence
  source: /note="Description of Artificial Sequence: Synthetic peptide"
FSFVAELSV

SEQ ID NO: 28512 - protein, 9 aa, Artificial Sequence
  source: /note="Description of Artificial Sequence: Synthetic peptide"
ELSVPLLIF

SEQ ID NO: 28513 - protein, 9 aa, Artificial Sequence
  source: /note="Description of Artificial Sequence: Synthetic peptide"
AELSVPLLI

SEQ ID NO: 28514 - protein, 10 aa, Artificial Sequence
  source: /note="Description of Artificial Sequence: Synthetic peptide"
IQIFSFVAEL

SEQ ID NO: 28515 - protein, 10 aa, Artificial Sequence
  source: /note="Description of Artificial Sequence: Synthetic peptide"
FVAELSVPLL

SEQ ID NO: 28516 - protein, 10 aa, Artificial Sequence
  source: /note="Description of Artificial Sequence: Synthetic peptide"
IFSFVAELSV

SEQ ID NO: 28517 - protein, 10 aa, Artificial Sequence
  source: /note="Description of Artificial Sequence: Synthetic peptide"
SFVAELSVPL

SEQ ID NO: 28518 - protein, 10 aa, Artificial Sequence
  source: /note="Description of Artificial Sequence: Synthetic peptide"
LSVPLLIFLF

SEQ ID NO: 28519 - protein, 10 aa, Artificial Sequence
  source: /note="Description of Artificial Sequence: Synthetic peptide"
ELSVPLLIFL

SEQ ID NO: 28520 - protein, 10 aa, Artificial Sequence
  source: /note="Description of Artificial Sequence: Synthetic peptide"
FSFVAELSVP

SEQ ID NO: 28521 - protein, 10 aa, Artificial Sequence
  source: /note="Description of Artificial Sequence: Synthetic peptide"
AELSVPLLIF

SEQ ID NO: 28522 - protein, 9 aa, Artificial Sequence
  source: /note="Description of Artificial Sequence: Synthetic peptide"
QYHFQAHTV

SEQ ID NO: 28523 - protein, 9 aa, Artificial Sequence
  source: /note="Description of Artificial Sequence: Synthetic peptide"
HFQAHTVAL

SEQ ID NO: 28524 - protein, 9 aa, Artificial Sequence
  source: /note="Description of Artificial Sequence: Synthetic peptide"
LENFHQYHF

SEQ ID NO: 28525 - protein, 9 aa, Artificial Sequence
  source: /note="Description of Artificial Sequence: Synthetic peptide"
FHQYHFQAH

SEQ ID NO: 28526 - protein, 9 aa, Artificial Sequence
  source: /note="Description of Artificial Sequence: Synthetic peptide"
HQYHFQAHT

SEQ ID NO: 28527 - protein, 9 aa, Artificial Sequence
  source: /note="Description of Artificial Sequence: Synthetic peptide"
YHFQAHTVA

SEQ ID NO: 28528 - protein, 10 aa, Artificial Sequence
  source: /note="Description of Artificial Sequence: Synthetic peptide"
HQYHFQAHTV

SEQ ID NO: 28529 - protein, 10 aa, Artificial Sequence
  source: /note="Description of Artificial Sequence: Synthetic peptide"
KLENFHQYHF

SEQ ID NO: 28530 - protein, 10 aa, Artificial Sequence
  source: /note="Description of Artificial Sequence: Synthetic peptide"
YHFQAHTVAL

SEQ ID NO: 28531 - protein, 9 aa, Artificial Sequence
  source: /note="Description of Artificial Sequence: Synthetic peptide"
RSLAILFIV

SEQ ID NO: 28532 - protein, 9 aa, Artificial Sequence
  source: /note="Description of Artificial Sequence: Synthetic peptide"
FTALRSLAI

SEQ ID NO: 28533 - protein, 9 aa, Artificial Sequence
  source: /note="Description of Artificial Sequence: Synthetic peptide"
ILFIVFTSY

SEQ ID NO: 28534 - protein, 9 aa, Artificial Sequence
  source: /note="Description of Artificial Sequence: Synthetic peptide"
SLAILFIVF

SEQ ID NO: 28535 - protein, 9 aa, Artificial Sequence
  source: /note="Description of Artificial Sequence: Synthetic peptide"
ALRSLAILF

SEQ ID NO: 28536 - protein, 9 aa, Artificial Sequence
  source: /note="Description of Artificial Sequence: Synthetic peptide"
TALRSLAIL

SEQ ID NO: 28537 - protein, 10 aa, Artificial Sequence
  source: /note="Description of Artificial Sequence: Synthetic peptide"
ALRSLAILFI

SEQ ID NO: 28538 - protein, 10 aa, Artificial Sequence
  source: /note="Description of Artificial Sequence: Synthetic peptide"
FTALRSLAIL

SEQ ID NO: 28539 - protein, 10 aa, Artificial Sequence
  source: /note="Description of Artificial Sequence: Synthetic peptide"
SLAILFIVFT

SEQ ID NO: 28540 - protein, 10 aa, Artificial Sequence
  source: /note="Description of Artificial Sequence: Synthetic peptide"
RFTALRSLAI

SEQ ID NO: 28541 - protein, 10 aa, Artificial Sequence
  source: /note="Description of Artificial Sequence: Synthetic peptide"
TALRSLAILF

SEQ ID NO: 28542 - protein, 10 aa, Artificial Sequence
  source: /note="Description of Artificial Sequence: Synthetic peptide"
RSLAILFIVF

SEQ ID NO: 28543 - protein, 10 aa, Artificial Sequence
  source: /note="Description of Artificial Sequence: Synthetic peptide"
ILFIVFTSYF

SEQ ID NO: 28544 - protein, 10 aa, Artificial Sequence
  source: /note="Description of Artificial Sequence: Synthetic peptide"
AILFIVFTSY

SEQ ID NO: 28545 - protein, 9 aa, Artificial Sequence
  source: /note="Description of Artificial Sequence: Synthetic peptide"
FLLVMCHLL

SEQ ID NO: 28546 - protein, 9 aa, Artificial Sequence
  source: /note="Description of Artificial Sequence: Synthetic peptide"
LVMCHLLSV

SEQ ID NO: 28547 - protein, 9 aa, Artificial Sequence
  source: /note="Description of Artificial Sequence: Synthetic peptide"
HLLSVHDHI

SEQ ID NO: 28548 - protein, 9 aa, Artificial Sequence
  source: /note="Description of Artificial Sequence: Synthetic peptide"
SFLLVMCHL

SEQ ID NO: 28549 - protein, 9 aa, Artificial Sequence
  source: /note="Description of Artificial Sequence: Synthetic peptide"
QTVTSFLLV

SEQ ID NO: 28550 - protein, 9 aa, Artificial Sequence
  source: /note="Description of Artificial Sequence: Synthetic peptide"
TVTSFLLVM

SEQ ID NO: 28551 - protein, 9 aa, Artificial Sequence
  source: /note="Description of Artificial Sequence: Synthetic peptide"
VMCHLLSVH

SEQ ID NO: 28552 - protein, 9 aa, Artificial Sequence
  source: /note="Description of Artificial Sequence: Synthetic peptide"
LSVHDHISL

SEQ ID NO: 28553 - protein, 10 aa, Artificial Sequence
  source: /note="Description of Artificial Sequence: Synthetic peptide"
LLVMCHLLSV

SEQ ID NO: 28554 - protein, 10 aa, Artificial Sequence
  source: /note="Description of Artificial Sequence: Synthetic peptide"
LLSVHDHISL

SEQ ID NO: 28555 - protein, 10 aa, Artificial Sequence
  source: /note="Description of Artificial Sequence: Synthetic peptide"
SFLLVMCHLL

SEQ ID NO: 28556 - protein, 10 aa, Artificial Sequence
  source: /note="Description of Artificial Sequence: Synthetic peptide"
QTVTSFLLVM

SEQ ID NO: 28557 - protein, 10 aa, Artificial Sequence
  source: /note="Description of Artificial Sequence: Synthetic peptide"
LVMCHLLSVH

SEQ ID NO: 28558 - protein, 10 aa, Artificial Sequence
  source: /note="Description of Artificial Sequence: Synthetic peptide"
LQTVTSFLLV

SEQ ID NO: 28559 - protein, 10 aa, Artificial Sequence
  source: /note="Description of Artificial Sequence: Synthetic peptide"
TSFLLVMCHL

SEQ ID NO: 28560 - protein, 9 aa, Artificial Sequence
  source: /note="Description of Artificial Sequence: Synthetic peptide"
AVMTTLLWA

SEQ ID NO: 28561 - protein, 9 aa, Artificial Sequence
  source: /note="Description of Artificial Sequence: Synthetic peptide"
TLLWAQSSL

SEQ ID NO: 28562 - protein, 9 aa, Artificial Sequence
  source: /note="Description of Artificial Sequence: Synthetic peptide"
RAVMTTLLW

SEQ ID NO: 28563 - protein, 9 aa, Artificial Sequence
  source: /note="Description of Artificial Sequence: Synthetic peptide"
KLRRAVMTT

SEQ ID NO: 28564 - protein, 9 aa, Artificial Sequence
  source: /note="Description of Artificial Sequence: Synthetic peptide"
LRRAVMTTL

SEQ ID NO: 28565 - protein, 9 aa, Artificial Sequence
  source: /note="Description of Artificial Sequence: Synthetic peptide"
RRAVMTTLL

SEQ ID NO: 28566 - protein, 10 aa, Artificial Sequence
  source: /note="Description of Artificial Sequence: Synthetic peptide"
KLRRAVMTTL

SEQ ID NO: 28567 - protein, 10 aa, Artificial Sequence
  source: /note="Description of Artificial Sequence: Synthetic peptide"
TLLWAQSSLK

SEQ ID NO: 28568 - protein, 10 aa, Artificial Sequence
  source: /note="Description of Artificial Sequence: Synthetic peptide"
RRAVMTTLLW

SEQ ID NO: 28569 - protein, 10 aa, Artificial Sequence
  source: /note="Description of Artificial Sequence: Synthetic peptide"
RAVMTTLLWA

SEQ ID NO: 28570 - protein, 10 aa, Artificial Sequence
  source: /note="Description of Artificial Sequence: Synthetic peptide"
TTLLWAQSSL

SEQ ID NO: 28571 - protein, 10 aa, Artificial Sequence
  source: /note="Description of Artificial Sequence: Synthetic peptide"
LRRAVMTTLL

SEQ ID NO: 28572 - protein, 9 aa, Artificial Sequence
  source: /note="Description of Artificial Sequence: Synthetic peptide"
FLSLIIDAT

SEQ ID NO: 28573 - protein, 9 aa, Artificial Sequence
  source: /note="Description of Artificial Sequence: Synthetic peptide"
LIIDATKFI

SEQ ID NO: 28574 - protein, 9 aa, Artificial Sequence
  source: /note="Description of Artificial Sequence: Synthetic peptide"
LSLIIDATK

SEQ ID NO: 28575 - protein, 9 aa, Artificial Sequence
  source: /note="Description of Artificial Sequence: Synthetic peptide"
SLIIDATKF

SEQ ID NO: 28576 - protein, 9 aa, Artificial Sequence
  source: /note="Description of Artificial Sequence: Synthetic peptide"
IDATKFISM

SEQ ID NO: 28577 - protein, 10 aa, Artificial Sequence
  source: /note="Description of Artificial Sequence: Synthetic peptide"
SLIIDATKFI

SEQ ID NO: 28578 - protein, 10 aa, Artificial Sequence
  source: /note="Description of Artificial Sequence: Synthetic peptide"
LSLIIDATKF

SEQ ID NO: 28579 - protein, 10 aa, Artificial Sequence
  source: /note="Description of Artificial Sequence: Synthetic peptide"
IIDATKFISM

SEQ ID NO: 28580 - protein, 10 aa, Artificial Sequence
  source: /note="Description of Artificial Sequence: Synthetic peptide"
TKFISMQNDF

SEQ ID NO: 28581 - protein, 9 aa, Artificial Sequence
  source: /note="Description of Artificial Sequence: Synthetic peptide"
YLNMCITTC

SEQ ID NO: 28582 - protein, 9 aa, Artificial Sequence
  source: /note="Description of Artificial Sequence: Synthetic peptide"
FANYLNMCI

SEQ ID NO: 28583 - protein, 9 aa, Artificial Sequence
  source: /note="Description of Artificial Sequence: Synthetic peptide"
LNMCITTCL

SEQ ID NO: 28584 - protein, 9 aa, Artificial Sequence
  source: /note="Description of Artificial Sequence: Synthetic peptide"
CITTCLNVF

SEQ ID NO: 28585 - protein, 10 aa, Artificial Sequence
  source: /note="Description of Artificial Sequence: Synthetic peptide"
YLNMCITTCL

SEQ ID NO: 28586 - protein, 10 aa, Artificial Sequence
  source: /note="Description of Artificial Sequence: Synthetic peptide"
NMCITTCLNV

SEQ ID NO: 28587 - protein, 10 aa, Artificial Sequence
  source: /note="Description of Artificial Sequence: Synthetic peptide"
TFANYLNMCI

SEQ ID NO: 28588 - protein, 10 aa, Artificial Sequence
  source: /note="Description of Artificial Sequence: Synthetic peptide"
CITTCLNVFY

SEQ ID NO: 28589 - protein, 10 aa, Artificial Sequence
  source: /note="Description of Artificial Sequence: Synthetic peptide"
MCITTCLNVF

SEQ ID NO: 28590 - protein, 9 aa, Artificial Sequence
  source: /note="Description of Artificial Sequence: Synthetic peptide"
HEQNITWKF

SEQ ID NO: 28591 - protein, 9 aa, Artificial Sequence
  source: /note="Description of Artificial Sequence: Synthetic peptide"
FKVSHEQNI

SEQ ID NO: 28592 - protein, 9 aa, Artificial Sequence
  source: /note="Description of Artificial Sequence: Synthetic peptide"
VSHEQNITW

SEQ ID NO: 28593 - protein, 10 aa, Artificial Sequence
  source: /note="Description of Artificial Sequence: Synthetic peptide"
VSHEQNITWK

SEQ ID NO: 28594 - protein, 10 aa, Artificial Sequence
  source: /note="Description of Artificial Sequence: Synthetic peptide"
KVSHEQNITW

SEQ ID NO: 28595 - protein, 10 aa, Artificial Sequence
  source: /note="Description of Artificial Sequence: Synthetic peptide"
SHEQNITWKF

SEQ ID NO: 28596 - protein, 9 aa, Artificial Sequence
  source: /note="Description of Artificial Sequence: Synthetic peptide"
GLRPVHPSG

SEQ ID NO: 28597 - protein, 9 aa, Artificial Sequence
  source: /note="Description of Artificial Sequence: Synthetic peptide"
PVHPSGAMY

SEQ ID NO: 28598 - protein, 9 aa, Artificial Sequence
  source: /note="Description of Artificial Sequence: Synthetic peptide"
RPVHPSGAM

SEQ ID NO: 28599 - protein, 9 aa, Artificial Sequence
  source: /note="Description of Artificial Sequence: Synthetic peptide"
HPSGAMYLM

SEQ ID NO: 28600 - protein, 10 aa, Artificial Sequence
  source: /note="Description of Artificial Sequence: Synthetic peptide"
GLRPVHPSGA

SEQ ID NO: 28601 - protein, 10 aa, Artificial Sequence
  source: /note="Description of Artificial Sequence: Synthetic peptide"
RPVHPSGAMY

SEQ ID NO: 28602 - protein, 10 aa, Artificial Sequence
  source: /note="Description of Artificial Sequence: Synthetic peptide"
HPSGAMYLMV

SEQ ID NO: 28603 - protein, 10 aa, Artificial Sequence
  source: /note="Description of Artificial Sequence: Synthetic peptide"
AAIPGLRPVH

SEQ ID NO: 28604 - protein, 10 aa, Artificial Sequence
  source: /note="Description of Artificial Sequence: Synthetic peptide"
LRPVHPSGAM

SEQ ID NO: 28605 - protein, 9 aa, Artificial Sequence
  source: /note="Description of Artificial Sequence: Synthetic peptide"
RLCVSPFGL

SEQ ID NO: 28606 - protein, 9 aa, Artificial Sequence
  source: /note="Description of Artificial Sequence: Synthetic peptide"
QVRLCVSPF

SEQ ID NO: 28607 - protein, 10 aa, Artificial Sequence
  source: /note="Description of Artificial Sequence: Synthetic peptide"
RLCVSPFGLR

SEQ ID NO: 28608 - protein, 10 aa, Artificial Sequence
  source: /note="Description of Artificial Sequence: Synthetic peptide"
KQVRLCVSPF

SEQ ID NO: 28609 - protein, 10 aa, Artificial Sequence
  source: /note="Description of Artificial Sequence: Synthetic peptide"
QVRLCVSPFG

SEQ ID NO: 28610 - protein, 10 aa, Artificial Sequence
  source: /note="Description of Artificial Sequence: Synthetic peptide"
VRLCVSPFGL

SEQ ID NO: 28611 - protein, 9 aa, Artificial Sequence
  source: /note="Description of Artificial Sequence: Synthetic peptide"
HLISGRNIV

SEQ ID NO: 28612 - protein, 10 aa, Artificial Sequence
  source: /note="Description of Artificial Sequence: Synthetic peptide"
DIENHLISGR

SEQ ID NO: 28613 - protein, 9 aa, Artificial Sequence
  source: /note="Description of Artificial Sequence: Synthetic peptide"
NLEEADAYI

SEQ ID NO: 28614 - protein, 9 aa, Artificial Sequence
  source: /note="Description of Artificial Sequence: Synthetic peptide"
AYIAFANLL

SEQ ID NO: 28615 - protein, 9 aa, Artificial Sequence
  source: /note="Description of Artificial Sequence: Synthetic peptide"
EADAYIAFA

SEQ ID NO: 28616 - protein, 9 aa, Artificial Sequence
  source: /note="Description of Artificial Sequence: Synthetic peptide"
DAYIAFANL

SEQ ID NO: 28617 - protein, 9 aa, Artificial Sequence
  source: /note="Description of Artificial Sequence: Synthetic peptide"
EEADAYIAF

SEQ ID NO: 28618 - protein, 9 aa, Artificial Sequence
  source: /note="Description of Artificial Sequence: Synthetic peptide"
LNLEEADAY

SEQ ID NO: 28619 - protein, 9 aa, Artificial Sequence
  source: /note="Description of Artificial Sequence: Synthetic peptide"
LEEADAYIA

SEQ ID NO: 28620 - protein, 10 aa, Artificial Sequence
  source: /note="Description of Artificial Sequence: Synthetic peptide"
YIAFANLLNK

SEQ ID NO: 28621 - protein, 10 aa, Artificial Sequence
  source: /note="Description of Artificial Sequence: Synthetic peptide"
ILNLEEADAY

SEQ ID NO: 28622 - protein, 10 aa, Artificial Sequence
  source: /note="Description of Artificial Sequence: Synthetic peptide"
DAYIAFANLL

SEQ ID NO: 28623 - protein, 10 aa, Artificial Sequence
  source: /note="Description of Artificial Sequence: Synthetic peptide"
LEEADAYIAF

SEQ ID NO: 28624 - protein, 10 aa, Artificial Sequence
  source: /note="Description of Artificial Sequence: Synthetic peptide"
EEADAYIAFA

SEQ ID NO: 28625 - protein, 10 aa, Artificial Sequence
  source: /note="Description of Artificial Sequence: Synthetic peptide"
ADAYIAFANL

SEQ ID NO: 28626 - protein, 9 aa, Artificial Sequence
  source: /note="Description of Artificial Sequence: Synthetic peptide"
QIRNQRAYH

SEQ ID NO: 28627 - protein, 9 aa, Artificial Sequence
  source: /note="Description of Artificial Sequence: Synthetic peptide"
NQRAYHLEK

SEQ ID NO: 28628 - protein, 9 aa, Artificial Sequence
  source: /note="Description of Artificial Sequence: Synthetic peptide"
RQIRNQRAY

SEQ ID NO: 28629 - protein, 9 aa, Artificial Sequence
  source: /note="Description of Artificial Sequence: Synthetic peptide"
IRNQRAYHL

SEQ ID NO: 28630 - protein, 10 aa, Artificial Sequence
  source: /note="Description of Artificial Sequence: Synthetic peptide"
RQIRNQRAYH

SEQ ID NO: 28631 - protein, 10 aa, Artificial Sequence
  source: /note="Description of Artificial Sequence: Synthetic peptide"
QIRNQRAYHL

SEQ ID NO: 28632 - protein, 10 aa, Artificial Sequence
  source: /note="Description of Artificial Sequence: Synthetic peptide"
RNQRAYHLEK

SEQ ID NO: 28633 - protein, 10 aa, Artificial Sequence
  source: /note="Description of Artificial Sequence: Synthetic peptide"
LRQIRNQRAY

SEQ ID NO: 28634 - protein, 10 aa, Artificial Sequence
  source: /note="Description of Artificial Sequence: Synthetic peptide"
NQRAYHLEKV

SEQ ID NO: 28635 - protein, 9 aa, Artificial Sequence
  source: /note="Description of Artificial Sequence: Synthetic peptide"
ALVKYFDKT

SEQ ID NO: 28636 - protein, 9 aa, Artificial Sequence
  source: /note="Description of Artificial Sequence: Synthetic peptide"
KTVCMMARI

SEQ ID NO: 28637 - protein, 9 aa, Artificial Sequence
  source: /note="Description of Artificial Sequence: Synthetic peptide"
KYFDKTVCM

SEQ ID NO: 28638 - protein, 9 aa, Artificial Sequence
  source: /note="Description of Artificial Sequence: Synthetic peptide"
YFDKTVCMM

SEQ ID NO: 28639 - protein, 10 aa, Artificial Sequence
  source: /note="Description of Artificial Sequence: Synthetic peptide"
ALVKYFDKTV

SEQ ID NO: 28640 - protein, 10 aa, Artificial Sequence
  source: /note="Description of Artificial Sequence: Synthetic peptide"
KYFDKTVCMM

SEQ ID NO: 28641 - protein, 10 aa, Artificial Sequence
  source: /note="Description of Artificial Sequence: Synthetic peptide"
VKYFDKTVCM

SEQ ID NO: 28642 - protein, 9 aa, Artificial Sequence
  source: /note="Description of Artificial Sequence: Synthetic peptide"
YVCWAFACA

SEQ ID NO: 28643 - protein, 9 aa, Artificial Sequence
  source: /note="Description of Artificial Sequence: Synthetic peptide"
CAYEPQELK

SEQ ID NO: 28644 - protein, 9 aa, Artificial Sequence
  source: /note="Description of Artificial Sequence: Synthetic peptide"
VCWAFACAY

SEQ ID NO: 28645 - protein, 10 aa, Artificial Sequence
  source: /note="Description of Artificial Sequence: Synthetic peptide"
YVCWAFACAY

SEQ ID NO: 28646 - protein, 10 aa, Artificial Sequence
  source: /note="Description of Artificial Sequence: Synthetic peptide"
FACAYEPQEL

SEQ ID NO: 28647 - protein, 9 aa, Artificial Sequence
  source: /note="Description of Artificial Sequence: Synthetic peptide"
QMGRRMEHI

SEQ ID NO: 28648 - protein, 9 aa, Artificial Sequence
  source: /note="Description of Artificial Sequence: Synthetic peptide"
KTQQMGRRM

SEQ ID NO: 28649 - protein, 9 aa, Artificial Sequence
  source: /note="Description of Artificial Sequence: Synthetic peptide"
MGRRMEHIL

SEQ ID NO: 28650 - protein, 9 aa, Artificial Sequence
  source: /note="Description of Artificial Sequence: Synthetic peptide"
ASQQGSAKM

SEQ ID NO: 28651 - protein, 9 aa, Artificial Sequence
  source: /note="Description of Artificial Sequence: Synthetic peptide"
AKMEKTQQM

SEQ ID NO: 28652 - protein, 9 aa, Artificial Sequence
  source: /note="Description of Artificial Sequence: Synthetic peptide"
QQMGRRMEH

SEQ ID NO: 28653 - protein, 10 aa, Artificial Sequence
  source: /note="Description of Artificial Sequence: Synthetic peptide"
QQMGRRMEHI

SEQ ID NO: 28654 - protein, 10 aa, Artificial Sequence
  source: /note="Description of Artificial Sequence: Synthetic peptide"
SQQGSAKMEK

SEQ ID NO: 28655 - protein, 10 aa, Artificial Sequence
  source: /note="Description of Artificial Sequence: Synthetic peptide"
AASQQGSAKM

SEQ ID NO: 28656 - protein, 10 aa, Artificial Sequence
  source: /note="Description of Artificial Sequence: Synthetic peptide"
TQQMGRRMEH

SEQ ID NO: 28657 - protein, 9 aa, Artificial Sequence
  source: /note="Description of Artificial Sequence: Synthetic peptide"
YIYPDSPAT

SEQ ID NO: 28658 - protein, 9 aa, Artificial Sequence
  source: /note="Description of Artificial Sequence: Synthetic peptide"
EMPKRMYIY

SEQ ID NO: 28659 - protein, 9 aa, Artificial Sequence
  source: /note="Description of Artificial Sequence: Synthetic peptide"
MYIYPDSPA

SEQ ID NO: 28660 - protein, 9 aa, Artificial Sequence
  source: /note="Description of Artificial Sequence: Synthetic peptide"
RMYIYPDSP

SEQ ID NO: 28661 - protein, 10 aa, Artificial Sequence
  source: /note="Description of Artificial Sequence: Synthetic peptide"
RMYIYPDSPA

SEQ ID NO: 28662 - protein, 10 aa, Artificial Sequence
  source: /note="Description of Artificial Sequence: Synthetic peptide"
PEMPKRMYIY

SEQ ID NO: 28663 - protein, 9 aa, Artificial Sequence
  source: /note="Description of Artificial Sequence: Synthetic peptide"
RSPLPTTSK

SEQ ID NO: 28664 - protein, 10 aa, Artificial Sequence
  source: /note="Description of Artificial Sequence: Synthetic peptide"
GEDHYFRSPL

SEQ ID NO: 28665 - protein, 9 aa, Artificial Sequence
  source: /note="Description of Artificial Sequence: Synthetic peptide"
LSAPALQEK

SEQ ID NO: 28666 - protein, 9 aa, Artificial Sequence
  source: /note="Description of Artificial Sequence: Synthetic peptide"
KAAFPGRRV

SEQ ID NO: 28667 - protein, 9 aa, Artificial Sequence
  source: /note="Description of Artificial Sequence: Synthetic peptide"
LQEKAAFPG

SEQ ID NO: 28668 - protein, 10 aa, Artificial Sequence
  source: /note="Description of Artificial Sequence: Synthetic peptide"
ALSAPALQEK

SEQ ID NO: 28669 - protein, 10 aa, Artificial Sequence
  source: /note="Description of Artificial Sequence: Synthetic peptide"
APALQEKAAF

SEQ ID NO: 28670 - protein, 9 aa, Artificial Sequence
  source: /note="Description of Artificial Sequence: Synthetic peptide"
QPPQPQPPL

SEQ ID NO: 28671 - protein, 10 aa, Artificial Sequence
  source: /note="Description of Artificial Sequence: Synthetic peptide"
GQPPQPQPPL

SEQ ID NO: 28672 - protein, 9 aa, Artificial Sequence
  source: /note="Description of Artificial Sequence: Synthetic peptide"
MQKEEKNSK

SEQ ID NO: 28673 - protein, 9 aa, Artificial Sequence
  source: /note="Description of Artificial Sequence: Synthetic peptide"
NSKKPPQSK

SEQ ID NO: 28674 - protein, 9 aa, Artificial Sequence
  source: /note="Description of Artificial Sequence: Synthetic peptide"
QSKRTNGMK

SEQ ID NO: 28675 - protein, 9 aa, Artificial Sequence
  source: /note="Description of Artificial Sequence: Synthetic peptide"
RTNGMKMNM

SEQ ID NO: 28676 - protein, 9 aa, Artificial Sequence
  source: /note="Description of Artificial Sequence: Synthetic peptide"
KMNMKGPEG

SEQ ID NO: 28677 - protein, 9 aa, Artificial Sequence
  source: /note="Description of Artificial Sequence: Synthetic peptide"
MNMKGPEGR

SEQ ID NO: 28678 - protein, 9 aa, Artificial Sequence
  source: /note="Description of Artificial Sequence: Synthetic peptide"
NMKGPEGRR

SEQ ID NO: 28679 - protein, 9 aa, Artificial Sequence
  source: /note="Description of Artificial Sequence: Synthetic peptide"
SKRTNGMKM

SEQ ID NO: 28680 - protein, 10 aa, Artificial Sequence
  source: /note="Description of Artificial Sequence: Synthetic peptide"
RTNGMKMNMK

SEQ ID NO: 28681 - protein, 10 aa, Artificial Sequence
  source: /note="Description of Artificial Sequence: Synthetic peptide"
MQKEEKNSKK

SEQ ID NO: 28682 - protein, 10 aa, Artificial Sequence
  source: /note="Description of Artificial Sequence: Synthetic peptide"
KNSKKPPQSK

SEQ ID NO: 28683 - protein, 10 aa, Artificial Sequence
  source: /note="Description of Artificial Sequence: Synthetic peptide"
KMNMKGPEGR

SEQ ID NO: 28684 - protein, 10 aa, Artificial Sequence
  source: /note="Description of Artificial Sequence: Synthetic peptide"
NSKKPPQSKR

SEQ ID NO: 28685 - protein, 10 aa, Artificial Sequence
  source: /note="Description of Artificial Sequence: Synthetic peptide"
MNMKGPEGRR

SEQ ID NO: 28686 - protein, 10 aa, Artificial Sequence
  source: /note="Description of Artificial Sequence: Synthetic peptide"
KRTNGMKMNM

SEQ ID NO: 28687 - protein, 10 aa, Artificial Sequence
  source: /note="Description of Artificial Sequence: Synthetic peptide"
MKMNMKGPEG

SEQ ID NO: 28688 - protein, 9 aa, Artificial Sequence
  source: /note="Description of Artificial Sequence: Synthetic peptide"
RSKKKKLGA

SEQ ID NO: 28689 - protein, 9 aa, Artificial Sequence
  source: /note="Description of Artificial Sequence: Synthetic peptide"
TPRSKKKKL

SEQ ID NO: 28690 - protein, 10 aa, Artificial Sequence
  source: /note="Description of Artificial Sequence: Synthetic peptide"
RSKKKKLGAG

SEQ ID NO: 28691 - protein, 10 aa, Artificial Sequence
  source: /note="Description of Artificial Sequence: Synthetic peptide"
ALPPAKRARK

SEQ ID NO: 28692 - protein, 10 aa, Artificial Sequence
  source: /note="Description of Artificial Sequence: Synthetic peptide"
NLIDIENYWL

SEQ ID NO: 28693 - protein, 10 aa, Artificial Sequence
  source: /note="Description of Artificial Sequence: Synthetic peptide"
IENYWLRCCM

SEQ ID NO: 28694 - protein, 10 aa, Artificial Sequence
  source: /note="Description of Artificial Sequence: Synthetic peptide"
TANLIDIENY

SEQ ID NO: 28695 - protein, 9 aa, Artificial Sequence
  source: /note="Description of Artificial Sequence: Synthetic peptide"
MPQLTKHLL

SEQ ID NO: 28696 - protein, 10 aa, Artificial Sequence
  source: /note="Description of Artificial Sequence: Synthetic peptide"
QLTKHLLENI

SEQ ID NO: 28697 - protein, 10 aa, Artificial Sequence
  source: /note="Description of Artificial Sequence: Synthetic peptide"
LTKHLLENIK

SEQ ID NO: 28698 - protein, 9 aa, Artificial Sequence
  source: /note="Description of Artificial Sequence: Synthetic peptide"
LLLKSEHEK

SEQ ID NO: 28699 - protein, 9 aa, Artificial Sequence
  source: /note="Description of Artificial Sequence: Synthetic peptide"
LKSEHEKTL

SEQ ID NO: 28700 - protein, 9 aa, Artificial Sequence
  source: /note="Description of Artificial Sequence: Synthetic peptide"
NELLLKSEH

SEQ ID NO: 28701 - protein, 9 aa, Artificial Sequence
  source: /note="Description of Artificial Sequence: Synthetic peptide"
HEKTLLELV

SEQ ID NO: 28702 - protein, 10 aa, Artificial Sequence
  source: /note="Description of Artificial Sequence: Synthetic peptide"
LKSEHEKTLL

SEQ ID NO: 28703 - protein, 10 aa, Artificial Sequence
  source: /note="Description of Artificial Sequence: Synthetic peptide"
SEHEKTLLEL

SEQ ID NO: 28704 - protein, 9 aa, Artificial Sequence
  source: /note="Description of Artificial Sequence: Synthetic peptide"
DTCAVVMFI

SEQ ID NO: 28705 - protein, 9 aa, Artificial Sequence
  source: /note="Description of Artificial Sequence: Synthetic peptide"
RVDTCAVVM

SEQ ID NO: 28706 - protein, 9 aa, Artificial Sequence
  source: /note="Description of Artificial Sequence: Synthetic peptide"
CAVVMFIDF

SEQ ID NO: 28707 - protein, 10 aa, Artificial Sequence
  source: /note="Description of Artificial Sequence: Synthetic peptide"
VLDRVDTCAV

SEQ ID NO: 28708 - protein, 10 aa, Artificial Sequence
  source: /note="Description of Artificial Sequence: Synthetic peptide"
RVDTCAVVMF

SEQ ID NO: 28709 - protein, 9 aa, Artificial Sequence
  source: /note="Description of Artificial Sequence: Synthetic peptide"
MLEKDILSL

SEQ ID NO: 28710 - protein, 9 aa, Artificial Sequence
  source: /note="Description of Artificial Sequence: Synthetic peptide"
SLYEVVHRI

SEQ ID NO: 28711 - protein, 9 aa, Artificial Sequence
  source: /note="Description of Artificial Sequence: Synthetic peptide"
LYEVVHRIL

SEQ ID NO: 28712 - protein, 9 aa, Artificial Sequence
  source: /note="Description of Artificial Sequence: Synthetic peptide"
LEKDILSLY

SEQ ID NO: 28713 - protein, 9 aa, Artificial Sequence
  source: /note="Description of Artificial Sequence: Synthetic peptide"
DILSLYEVV

SEQ ID NO: 28714 - protein, 9 aa, Artificial Sequence
  source: /note="Description of Artificial Sequence: Synthetic peptide"
KDILSLYEV

SEQ ID NO: 28715 - protein, 10 aa, Artificial Sequence
  source: /note="Description of Artificial Sequence: Synthetic peptide"
MLEKDILSLY

SEQ ID NO: 28716 - protein, 10 aa, Artificial Sequence
  source: /note="Description of Artificial Sequence: Synthetic peptide"
FMLEKDILSL

SEQ ID NO: 28717 - protein, 10 aa, Artificial Sequence
  source: /note="Description of Artificial Sequence: Synthetic peptide"
SLYEVVHRIL

SEQ ID NO: 28718 - protein, 10 aa, Artificial Sequence
  source: /note="Description of Artificial Sequence: Synthetic peptide"
ILSLYEVVHR

SEQ ID NO: 28719 - protein, 10 aa, Artificial Sequence
  source: /note="Description of Artificial Sequence: Synthetic peptide"
KDILSLYEVV

SEQ ID NO: 28720 - protein, 9 aa, Artificial Sequence
  source: /note="Description of Artificial Sequence: Synthetic peptide"
GQVLGGPEL

SEQ ID NO: 28721 - protein, 10 aa, Artificial Sequence
  source: /note="Description of Artificial Sequence: Synthetic peptide"
VLGGPELGPK

SEQ ID NO: 28722 - protein, 10 aa, Artificial Sequence
  source: /note="Description of Artificial Sequence: Synthetic peptide"
RELYDRGPPP

SEQ ID NO: 28723 - protein, 9 aa, Artificial Sequence
  source: /note="Description of Artificial Sequence: Synthetic peptide"
VIIVFCYPK

SEQ ID NO: 28724 - protein, 9 aa, Artificial Sequence
  source: /note="Description of Artificial Sequence: Synthetic peptide"
APNKADVII

SEQ ID NO: 28725 - protein, 9 aa, Artificial Sequence
  source: /note="Description of Artificial Sequence: Synthetic peptide"
NKADVIIVF

SEQ ID NO: 28726 - protein, 9 aa, Artificial Sequence
  source: /note="Description of Artificial Sequence: Synthetic peptide"
IVFCYPKTI

SEQ ID NO: 28727 - protein, 10 aa, Artificial Sequence
  source: /note="Description of Artificial Sequence: Synthetic peptide"
KADVIIVFCY

SEQ ID NO: 28728 - protein, 10 aa, Artificial Sequence
  source: /note="Description of Artificial Sequence: Synthetic peptide"
DVIIVFCYPK

SEQ ID NO: 28729 - protein, 10 aa, Artificial Sequence
  source: /note="Description of Artificial Sequence: Synthetic peptide"
APNKADVIIV

SEQ ID NO: 28730 - protein, 10 aa, Artificial Sequence
  source: /note="Description of Artificial Sequence: Synthetic peptide"
IVFCYPKTII

SEQ ID NO: 28731 - protein, 9 aa, Artificial Sequence
  source: /note="Description of Artificial Sequence: Synthetic peptide"
LMETFLILI

SEQ ID NO: 28732 - protein, 9 aa, Artificial Sequence
  source: /note="Description of Artificial Sequence: Synthetic peptide"
ILIMGSWLM

SEQ ID NO: 28733 - protein, 9 aa, Artificial Sequence
  source: /note="Description of Artificial Sequence: Synthetic peptide"
IMGSWLMQA

SEQ ID NO: 28734 - protein, 9 aa, Artificial Sequence
  source: /note="Description of Artificial Sequence: Synthetic peptide"
METFLILIM

SEQ ID NO: 28735 - protein, 9 aa, Artificial Sequence
  source: /note="Description of Artificial Sequence: Synthetic peptide"
FLILIMGSW

SEQ ID NO: 28736 - protein, 10 aa, Artificial Sequence
  source: /note="Description of Artificial Sequence: Synthetic peptide"
QLMETFLILI

SEQ ID NO: 28737 - protein, 10 aa, Artificial Sequence
  source: /note="Description of Artificial Sequence: Synthetic peptide"
FLILIMGSWL

SEQ ID NO: 28738 - protein, 10 aa, Artificial Sequence
  source: /note="Description of Artificial Sequence: Synthetic peptide"
LIMGSWLMQA

SEQ ID NO: 28739 - protein, 10 aa, Artificial Sequence
  source: /note="Description of Artificial Sequence: Synthetic peptide"
TFLILIMGSW

SEQ ID NO: 28740 - protein, 10 aa, Artificial Sequence
  source: /note="Description of Artificial Sequence: Synthetic peptide"
ETFLILIMGS

SEQ ID NO: 28741 - protein, 10 aa, Artificial Sequence
  source: /note="Description of Artificial Sequence: Synthetic peptide"
LMETFLILIM

SEQ ID NO: 28742 - protein, 10 aa, Artificial Sequence
  source: /note="Description of Artificial Sequence: Synthetic peptide"
LILIMGSWLM

SEQ ID NO: 28743 - protein, 9 aa, Artificial Sequence
  source: /note="Description of Artificial Sequence: Synthetic peptide"
RTRHPNMEL

SEQ ID NO: 28744 - protein, 10 aa, Artificial Sequence
  source: /note="Description of Artificial Sequence: Synthetic peptide"
RTRHPNMELC

SEQ ID NO: 28745 - protein, 10 aa, Artificial Sequence
  source: /note="Description of Artificial Sequence: Synthetic peptide"
LECRTRHPNM

SEQ ID NO: 28746 - protein, 10 aa, Artificial Sequence
  source: /note="Description of Artificial Sequence: Synthetic peptide"
HPNMELCRDI

SEQ ID NO: 28747 - protein, 9 aa, Artificial Sequence
  source: /note="Description of Artificial Sequence: Synthetic peptide"
VVYSGKEGK

SEQ ID NO: 28748 - protein, 10 aa, Artificial Sequence
  source: /note="Description of Artificial Sequence: Synthetic peptide"
RIEIVVYSGK

SEQ ID NO: 28749 - protein, 10 aa, Artificial Sequence
  source: /note="Description of Artificial Sequence: Synthetic peptide"
IVVYSGKEGK

SEQ ID NO: 28750 - protein, 9 aa, Artificial Sequence
  source: /note="Description of Artificial Sequence: Synthetic peptide"
FQRKQECSV

SEQ ID NO: 28751 - protein, 9 aa, Artificial Sequence
  source: /note="Description of Artificial Sequence: Synthetic peptide"
ALFSVPCCL

SEQ ID NO: 28752 - protein, 9 aa, Artificial Sequence
  source: /note="Description of Artificial Sequence: Synthetic peptide"
ALRCPSGPA

SEQ ID NO: 28753 - protein, 9 aa, Artificial Sequence
  source: /note="Description of Artificial Sequence: Synthetic peptide"
RMRPRLFPH

SEQ ID NO: 28754 - protein, 9 aa, Artificial Sequence
  source: /note="Description of Artificial Sequence: Synthetic peptide"
RLFPHPPMR

SEQ ID NO: 28755 - protein, 9 aa, Artificial Sequence
  source: /note="Description of Artificial Sequence: Synthetic peptide"
SAAPCTALR

SEQ ID NO: 28756 - protein, 9 aa, Artificial Sequence
  source: /note="Description of Artificial Sequence: Synthetic peptide"
LFPHPPMRL

SEQ ID NO: 28757 - protein, 9 aa, Artificial Sequence
  source: /note="Description of Artificial Sequence: Synthetic peptide"
LIRPHPSPG

SEQ ID NO: 28758 - protein, 9 aa, Artificial Sequence
  source: /note="Description of Artificial Sequence: Synthetic peptide"
PPGGPGRPL

SEQ ID NO: 28759 - protein, 9 aa, Artificial Sequence
  source: /note="Description of Artificial Sequence: Synthetic peptide"
CPVPTAGCL

SEQ ID NO: 28760 - protein, 9 aa, Artificial Sequence
  source: /note="Description of Artificial Sequence: Synthetic peptide"
SPALFSVPC

SEQ ID NO: 28761 - protein, 9 aa, Artificial Sequence
  source: /note="Description of Artificial Sequence: Synthetic peptide"
RPHPSPGTF

SEQ ID NO: 28762 - protein, 9 aa, Artificial Sequence
  source: /note="Description of Artificial Sequence: Synthetic peptide"
FPPRKGGPV

SEQ ID NO: 28763 - protein, 9 aa, Artificial Sequence
  source: /note="Description of Artificial Sequence: Synthetic peptide"
GPVRMRPRL

SEQ ID NO: 28764 - protein, 9 aa, Artificial Sequence
  source: /note="Description of Artificial Sequence: Synthetic peptide"
RPRLFPHPP

SEQ ID NO: 28765 - protein, 9 aa, Artificial Sequence
  source: /note="Description of Artificial Sequence: Synthetic peptide"
LRCPSGPAL

SEQ ID NO: 28766 - protein, 9 aa, Artificial Sequence
  source: /note="Description of Artificial Sequence: Synthetic peptide"
SQRPPGGPG

SEQ ID NO: 28767 - protein, 9 aa, Artificial Sequence
  source: /note="Description of Artificial Sequence: Synthetic peptide"
GCLRSPALF

SEQ ID NO: 28768 - protein, 9 aa, Artificial Sequence
  source: /note="Description of Artificial Sequence: Synthetic peptide"
LRSPALFSV

SEQ ID NO: 28769 - protein, 9 aa, Artificial Sequence
  source: /note="Description of Artificial Sequence: Synthetic peptide"
QQLQHGRGV

SEQ ID NO: 28770 - protein, 9 aa, Artificial Sequence
  source: /note="Description of Artificial Sequence: Synthetic peptide"
LQHGRGVLI

SEQ ID NO: 28771 - protein, 9 aa, Artificial Sequence
  source: /note="Description of Artificial Sequence: Synthetic peptide"
MRLPCPGIL

SEQ ID NO: 28772 - protein, 9 aa, Artificial Sequence
  source: /note="Description of Artificial Sequence: Synthetic peptide"
HPSPGTFPP

SEQ ID NO: 28773 - protein, 10 aa, Artificial Sequence
  source: /note="Description of Artificial Sequence: Synthetic peptide"
CLRSPALFSV

SEQ ID NO: 28774 - protein, 10 aa, Artificial Sequence
  source: /note="Description of Artificial Sequence: Synthetic peptide"
RLFPHPPMRL

SEQ ID NO: 28775 - protein, 10 aa, Artificial Sequence
  source: /note="Description of Artificial Sequence: Synthetic peptide"
ALRCPSGPAL

SEQ ID NO: 28776 - protein, 10 aa, Artificial Sequence
  source: /note="Description of Artificial Sequence: Synthetic peptide"
SQRPPGGPGR

SEQ ID NO: 28777 - protein, 10 aa, Artificial Sequence
  source: /note="Description of Artificial Sequence: Synthetic peptide"
KGGPVRMRPR

SEQ ID NO: 28778 - protein, 10 aa, Artificial Sequence
  source: /note="Description of Artificial Sequence: Synthetic peptide"
RMRPRLFPHP

SEQ ID NO: 28779 - protein, 10 aa, Artificial Sequence
  source: /note="Description of Artificial Sequence: Synthetic peptide"
RPRLFPHPPM

SEQ ID NO: 28780 - protein, 10 aa, Artificial Sequence
  source: /note="Description of Artificial Sequence: Synthetic peptide"
HPSPGTFPPR

SEQ ID NO: 28781 - protein, 10 aa, Artificial Sequence
  source: /note="Description of Artificial Sequence: Synthetic peptide"
SPSAAPCTAL

SEQ ID NO: 28782 - protein, 10 aa, Artificial Sequence
  source: /note="Description of Artificial Sequence: Synthetic peptide"
RPPGGPGRPL

SEQ ID NO: 28783 - protein, 10 aa, Artificial Sequence
  source: /note="Description of Artificial Sequence: Synthetic peptide"
PPRKGGPVRM

SEQ ID NO: 28784 - protein, 10 aa, Artificial Sequence
  source: /note="Description of Artificial Sequence: Synthetic peptide"
GPVRMRPRLF

SEQ ID NO: 28785 - protein, 10 aa, Artificial Sequence
  source: /note="Description of Artificial Sequence: Synthetic peptide"
FPHPPMRLPC

SEQ ID NO: 28786 - protein, 10 aa, Artificial Sequence
  source: /note="Description of Artificial Sequence: Synthetic peptide"
AGCLRSPALF

SEQ ID NO: 28787 - protein, 10 aa, Artificial Sequence
  source: /note="Description of Artificial Sequence: Synthetic peptide"
LQGQQPPQQL

SEQ ID NO: 28788 - protein, 10 aa, Artificial Sequence
  source: /note="Description of Artificial Sequence: Synthetic peptide"
GQQPPQQLQH

SEQ ID NO: 28789 - protein, 10 aa, Artificial Sequence
  source: /note="Description of Artificial Sequence: Synthetic peptide"
QQLQHGRGVL

SEQ ID NO: 28790 - protein, 10 aa, Artificial Sequence
  source: /note="Description of Artificial Sequence: Synthetic peptide"
IRPHPSPGTF

SEQ ID NO: 28791 - protein, 10 aa, Artificial Sequence
  source: /note="Description of Artificial Sequence: Synthetic peptide"
CPGILGEEEM

SEQ ID NO: 28792 - protein, 9 aa, Artificial Sequence
  source: /note="Description of Artificial Sequence: Synthetic peptide"
PYVRNRPPF

SEQ ID NO: 28793 - protein, 9 aa, Artificial Sequence
  source: /note="Description of Artificial Sequence: Synthetic peptide"
YVRNRPPFG

SEQ ID NO: 28794 - protein, 10 aa, Artificial Sequence
  source: /note="Description of Artificial Sequence: Synthetic peptide"
NPYVRNRPPF

SEQ ID NO: 28795 - protein, 9 aa, Artificial Sequence
  source: /note="Description of Artificial Sequence: Synthetic peptide"
CACAKALKK

SEQ ID NO: 28796 - protein, 9 aa, Artificial Sequence
  source: /note="Description of Artificial Sequence: Synthetic peptide"
KCACAKALK

SEQ ID NO: 28797 - protein, 9 aa, Artificial Sequence
  source: /note="Description of Artificial Sequence: Synthetic peptide"
CKCACAKAL

SEQ ID NO: 28798 - protein, 9 aa, Artificial Sequence
  source: /note="Description of Artificial Sequence: Synthetic peptide"
REDCKCACA

SEQ ID NO: 28799 - protein, 10 aa, Artificial Sequence
  source: /note="Description of Artificial Sequence: Synthetic peptide"
CACAKALKKK

SEQ ID NO: 28800 - protein, 10 aa, Artificial Sequence
  source: /note="Description of Artificial Sequence: Synthetic peptide"
KCACAKALKK

SEQ ID NO: 28801 - protein, 9 aa, Artificial Sequence
  source: /note="Description of Artificial Sequence: Synthetic peptide"
LCFASRIRK

SEQ ID NO: 28802 - protein, 9 aa, Artificial Sequence
  source: /note="Description of Artificial Sequence: Synthetic peptide"
CFASRIRKI

SEQ ID NO: 28803 - protein, 9 aa, Artificial Sequence
  source: /note="Description of Artificial Sequence: Synthetic peptide"
MPKLCFASR

SEQ ID NO: 28804 - protein, 9 aa, Artificial Sequence
  source: /note="Description of Artificial Sequence: Synthetic peptide"
KLCFASRIR

SEQ ID NO: 28805 - protein, 9 aa, Artificial Sequence
  source: /note="Description of Artificial Sequence: Synthetic peptide"
KKKMPKLCF

SEQ ID NO: 28806 - protein, 9 aa, Artificial Sequence
  source: /note="Description of Artificial Sequence: Synthetic peptide"
KKMPKLCFA

SEQ ID NO: 28807 - protein, 10 aa, Artificial Sequence
  source: /note="Description of Artificial Sequence: Synthetic peptide"
KLCFASRIRK

SEQ ID NO: 28808 - protein, 10 aa, Artificial Sequence
  source: /note="Description of Artificial Sequence: Synthetic peptide"
KKKMPKLCFA

SEQ ID NO: 28809 - protein, 10 aa, Artificial Sequence
  source: /note="Description of Artificial Sequence: Synthetic peptide"
KMPKLCFASR

SEQ ID NO: 28810 - protein, 10 aa, Artificial Sequence
  source: /note="Description of Artificial Sequence: Synthetic peptide"
CFASRIRKIR

SEQ ID NO: 28811 - protein, 10 aa, Artificial Sequence
  source: /note="Description of Artificial Sequence: Synthetic peptide"
MPKLCFASRI

SEQ ID NO: 28812 - protein, 10 aa, Artificial Sequence
  source: /note="Description of Artificial Sequence: Synthetic peptide"
KKKKMPKLCF

SEQ ID NO: 28813 - protein, 10 aa, Artificial Sequence
  source: /note="Description of Artificial Sequence: Synthetic peptide"
KKMPKLCFAS

SEQ ID NO: 28814 - protein, 9 aa, Artificial Sequence
  source: /note="Description of Artificial Sequence: Synthetic peptide"
YPTLASPAC

SEQ ID NO: 28815 - protein, 9 aa, Artificial Sequence
  source: /note="Description of Artificial Sequence: Synthetic peptide"
RLWFREAEI

SEQ ID NO: 28816 - protein, 9 aa, Artificial Sequence
  source: /note="Description of Artificial Sequence: Synthetic peptide"
LWFREAEIY

SEQ ID NO: 28817 - protein, 9 aa, Artificial Sequence
  source: /note="Description of Artificial Sequence: Synthetic peptide"
SSREERLWF

SEQ ID NO: 28818 - protein, 9 aa, Artificial Sequence
  source: /note="Description of Artificial Sequence: Synthetic peptide"
EERLWFREA

SEQ ID NO: 28819 - protein, 9 aa, Artificial Sequence
  source: /note="Description of Artificial Sequence: Synthetic peptide"
FSSREERLW

SEQ ID NO: 28820 - protein, 10 aa, Artificial Sequence
  source: /note="Description of Artificial Sequence: Synthetic peptide"
SSREERLWFR

SEQ ID NO: 28821 - protein, 10 aa, Artificial Sequence
  source: /note="Description of Artificial Sequence: Synthetic peptide"
IFSSREERLW

SEQ ID NO: 28822 - protein, 10 aa, Artificial Sequence
  source: /note="Description of Artificial Sequence: Synthetic peptide"
KIFSSREERL

SEQ ID NO: 28823 - protein, 10 aa, Artificial Sequence
  source: /note="Description of Artificial Sequence: Synthetic peptide"
RLWFREAEIY

SEQ ID NO: 28824 - protein, 10 aa, Artificial Sequence
  source: /note="Description of Artificial Sequence: Synthetic peptide"
FSSREERLWF

SEQ ID NO: 28825 - protein, 10 aa, Artificial Sequence
  source: /note="Description of Artificial Sequence: Synthetic peptide"
REERLWFREA

SEQ ID NO: 28826 - protein, 9 aa, Artificial Sequence
  source: /note="Description of Artificial Sequence: Synthetic peptide"
RVMCTWLTM

SEQ ID NO: 28827 - protein, 9 aa, Artificial Sequence
  source: /note="Description of Artificial Sequence: Synthetic peptide"
VMCTWLTMA

SEQ ID NO: 28828 - protein, 9 aa, Artificial Sequence
  source: /note="Description of Artificial Sequence: Synthetic peptide"
WLTMAPSCL

SEQ ID NO: 28829 - protein, 9 aa, Artificial Sequence
  source: /note="Description of Artificial Sequence: Synthetic peptide"
LTMAPSCLR

SEQ ID NO: 28830 - protein, 9 aa, Artificial Sequence
  source: /note="Description of Artificial Sequence: Synthetic peptide"
TMAPSCLRR

SEQ ID NO: 28831 - protein, 9 aa, Artificial Sequence
  source: /note="Description of Artificial Sequence: Synthetic peptide"
SVYTQTRRR

SEQ ID NO: 28832 - protein, 9 aa, Artificial Sequence
  source: /note="Description of Artificial Sequence: Synthetic peptide"
SLTSTSIRK

SEQ ID NO: 28833 - protein, 9 aa, Artificial Sequence
  source: /note="Description of Artificial Sequence: Synthetic peptide"
RLGDASAPR

SEQ ID NO: 28834 - protein, 9 aa, Artificial Sequence
  source: /note="Description of Artificial Sequence: Synthetic peptide"
TSLTSTSIR

SEQ ID NO: 28835 - protein, 9 aa, Artificial Sequence
  source: /note="Description of Artificial Sequence: Synthetic peptide"
TSIRKGPGK

SEQ ID NO: 28836 - protein, 9 aa, Artificial Sequence
  source: /note="Description of Artificial Sequence: Synthetic peptide"
RVKVCSGAA

SEQ ID NO: 28837 - protein, 9 aa, Artificial Sequence
  source: /note="Description of Artificial Sequence: Synthetic peptide"
SARVMCTWL

SEQ ID NO: 28838 - protein, 9 aa, Artificial Sequence
  source: /note="Description of Artificial Sequence: Synthetic peptide"
GTRMRAGSV

SEQ ID NO: 28839 - protein, 9 aa, Artificial Sequence
  source: /note="Description of Artificial Sequence: Synthetic peptide"
RMRAGSVYT

SEQ ID NO: 28840 - protein, 9 aa, Artificial Sequence
  source: /note="Description of Artificial Sequence: Synthetic peptide"
QTRRRLGDA

SEQ ID NO: 28841 - protein, 9 aa, Artificial Sequence
  source: /note="Description of Artificial Sequence: Synthetic peptide"
ASAPRRWAV

SEQ ID NO: 28842 - protein, 9 aa, Artificial Sequence
  source: /note="Description of Artificial Sequence: Synthetic peptide"
SIRKGPGKR

SEQ ID NO: 28843 - protein, 9 aa, Artificial Sequence
  source: /note="Description of Artificial Sequence: Synthetic peptide"
QVLDATPRR

SEQ ID NO: 28844 - protein, 9 aa, Artificial Sequence
  source: /note="Description of Artificial Sequence: Synthetic peptide"
TTSPGCGTR

SEQ ID NO: 28845 - protein, 9 aa, Artificial Sequence
  source: /note="Description of Artificial Sequence: Synthetic peptide"
WTSLTSTSI

SEQ ID NO: 28846 - protein, 9 aa, Artificial Sequence
  source: /note="Description of Artificial Sequence: Synthetic peptide"
APSCLRRST

SEQ ID NO: 28847 - protein, 9 aa, Artificial Sequence
  source: /note="Description of Artificial Sequence: Synthetic peptide"
AVTPAWTSL

SEQ ID NO: 28848 - protein, 9 aa, Artificial Sequence
  source: /note="Description of Artificial Sequence: Synthetic peptide"
TPRRRVKVC

SEQ ID NO: 28849 - protein, 9 aa, Artificial Sequence
  source: /note="Description of Artificial Sequence: Synthetic peptide"
AQPQSPPSA

SEQ ID NO: 28850 - protein, 9 aa, Artificial Sequence
  source: /note="Description of Artificial Sequence: Synthetic peptide"
TRMRAGSVY

SEQ ID NO: 28851 - protein, 9 aa, Artificial Sequence
  source: /note="Description of Artificial Sequence: Synthetic peptide"
RRWAVTPAW

SEQ ID NO: 28852 - protein, 9 aa, Artificial Sequence
  source: /note="Description of Artificial Sequence: Synthetic peptide"
TPAWTSLTS

SEQ ID NO: 28853 - protein, 10 aa, Artificial Sequence
  source: /note="Description of Artificial Sequence: Synthetic peptide"
RVMCTWLTMA

SEQ ID NO: 28854 - protein, 10 aa, Artificial Sequence
  source: /note="Description of Artificial Sequence: Synthetic peptide"
LTMAPSCLRR

SEQ ID NO: 28855 - protein, 10 aa, Artificial Sequence
  source: /note="Description of Artificial Sequence: Synthetic peptide"
TSLTSTSIRK

SEQ ID NO: 28856 - protein, 10 aa, Artificial Sequence
  source: /note="Description of Artificial Sequence: Synthetic peptide"
STSIRKGPGK

SEQ ID NO: 28857 - protein, 10 aa, Artificial Sequence
  source: /note="Description of Artificial Sequence: Synthetic peptide"
TWLTMAPSCL

SEQ ID NO: 28858 - protein, 10 aa, Artificial Sequence
  source: /note="Description of Artificial Sequence: Synthetic peptide"
RVKVCSGAAQ

SEQ ID NO: 28859 - protein, 10 aa, Artificial Sequence
  source: /note="Description of Artificial Sequence: Synthetic peptide"
SARVMCTWLT

SEQ ID NO: 28860 - protein, 10 aa, Artificial Sequence
  source: /note="Description of Artificial Sequence: Synthetic peptide"
GTRMRAGSVY

SEQ ID NO: 28861 - protein, 10 aa, Artificial Sequence
  source: /note="Description of Artificial Sequence: Synthetic peptide"
RMRAGSVYTQ

SEQ ID NO: 28862 - protein, 10 aa, Artificial Sequence
  source: /note="Description of Artificial Sequence: Synthetic peptide"
RAGSVYTQTR

SEQ ID NO: 28863 - protein, 10 aa, Artificial Sequence
  source: /note="Description of Artificial Sequence: Synthetic peptide"
SVYTQTRRRL

SEQ ID NO: 28864 - protein, 10 aa, Artificial Sequence
  source: /note="Description of Artificial Sequence: Synthetic peptide"
QVLDATPRRR

SEQ ID NO: 28865 - protein, 10 aa, Artificial Sequence
  source: /note="Description of Artificial Sequence: Synthetic peptide"
WLTMAPSCLR

SEQ ID NO: 28866 - protein, 10 aa, Artificial Sequence
  source: /note="Description of Artificial Sequence: Synthetic peptide"
WTSLTSTSIR

SEQ ID NO: 28867 - protein, 10 aa, Artificial Sequence
  source: /note="Description of Artificial Sequence: Synthetic peptide"
TSIRKGPGKR

SEQ ID NO: 28868 - protein, 10 aa, Artificial Sequence
  source: /note="Description of Artificial Sequence: Synthetic peptide"
DASAPRRWAV

SEQ ID NO: 28869 - protein, 10 aa, Artificial Sequence
  source: /note="Description of Artificial Sequence: Synthetic peptide"
WAVTPAWTSL

SEQ ID NO: 28870 - protein, 10 aa, Artificial Sequence
  source: /note="Description of Artificial Sequence: Synthetic peptide"
RLGDASAPRR

SEQ ID NO: 28871 - protein, 10 aa, Artificial Sequence
  source: /note="Description of Artificial Sequence: Synthetic peptide"
QPQSPPSARV

SEQ ID NO: 28872 - protein, 10 aa, Artificial Sequence
  source: /note="Description of Artificial Sequence: Synthetic peptide"
APRRWAVTPA

SEQ ID NO: 28873 - protein, 10 aa, Artificial Sequence
  source: /note="Description of Artificial Sequence: Synthetic peptide"
TPAWTSLTST

SEQ ID NO: 28874 - protein, 10 aa, Artificial Sequence
  source: /note="Description of Artificial Sequence: Synthetic peptide"
RRVKVCSGAA

SEQ ID NO: 28875 - protein, 10 aa, Artificial Sequence
  source: /note="Description of Artificial Sequence: Synthetic peptide"
PQSPPSARVM

SEQ ID NO: 28876 - protein, 10 aa, Artificial Sequence
  source: /note="Description of Artificial Sequence: Synthetic peptide"
ARVMCTWLTM

SEQ ID NO: 28877 - protein, 10 aa, Artificial Sequence
  source: /note="Description of Artificial Sequence: Synthetic peptide"
AWTSLTSTSI

SEQ ID NO: 28878 - protein, 10 aa, Artificial Sequence
  source: /note="Description of Artificial Sequence: Synthetic peptide"
PPSARVMCTW

SEQ ID NO: 28879 - protein, 9 aa, Artificial Sequence
  source: /note="Description of Artificial Sequence: Synthetic peptide"
SVWDSYAEL

SEQ ID NO: 28880 - protein, 9 aa, Artificial Sequence
  source: /note="Description of Artificial Sequence: Synthetic peptide"
ELRQLTLPR

SEQ ID NO: 28881 - protein, 9 aa, Artificial Sequence
  source: /note="Description of Artificial Sequence: Synthetic peptide"
YAELRQLTL

SEQ ID NO: 28882 - protein, 10 aa, Artificial Sequence
  source: /note="Description of Artificial Sequence: Synthetic peptide"
SVWDSYAELR

SEQ ID NO: 28883 - protein, 10 aa, Artificial Sequence
  source: /note="Description of Artificial Sequence: Synthetic peptide"
SYAELRQLTL

SEQ ID NO: 28884 - protein, 10 aa, Artificial Sequence
  source: /note="Description of Artificial Sequence: Synthetic peptide"
LSVWDSYAEL

SEQ ID NO: 28885 - protein, 9 aa, Artificial Sequence
  source: /note="Description of Artificial Sequence: Synthetic peptide"
VNYFISAQK

SEQ ID NO: 28886 - protein, 9 aa, Artificial Sequence
  source: /note="Description of Artificial Sequence: Synthetic peptide"
NSKPSVNYF

SEQ ID NO: 28887 - protein, 10 aa, Artificial Sequence
  source: /note="Description of Artificial Sequence: Synthetic peptide"
SVNYFISAQK

SEQ ID NO: 28888 - protein, 10 aa, Artificial Sequence
  source: /note="Description of Artificial Sequence: Synthetic peptide"
NSKPSVNYFI

SEQ ID NO: 28889 - protein, 10 aa, Artificial Sequence
  source: /note="Description of Artificial Sequence: Synthetic peptide"
KPSVNYFISA

SEQ ID NO: 28890 - protein, 10 aa, Artificial Sequence
  source: /note="Description of Artificial Sequence: Synthetic peptide"
AENSKPSVNY

SEQ ID NO: 28891 - protein, 9 aa, Artificial Sequence
  source: /note="Description of Artificial Sequence: Synthetic peptide"
ALCRPPVGR

SEQ ID NO: 28892 - protein, 10 aa, Artificial Sequence
  source: /note="Description of Artificial Sequence: Synthetic peptide"
TLGALCRPPV

SEQ ID NO: 28893 - protein, 10 aa, Artificial Sequence
  source: /note="Description of Artificial Sequence: Synthetic peptide"
RLRTLGALCR

SEQ ID NO: 28894 - protein, 10 aa, Artificial Sequence
  source: /note="Description of Artificial Sequence: Synthetic peptide"
RPPVGRRLPG

SEQ ID NO: 28895 - protein, 9 aa, Artificial Sequence
  source: /note="Description of Artificial Sequence: Synthetic peptide"
ESRDKLGAR

SEQ ID NO: 28896 - protein, 10 aa, Artificial Sequence
  source: /note="Description of Artificial Sequence: Synthetic peptide"
GARGDFPTGK

SEQ ID NO: 28897 - protein, 9 aa, Artificial Sequence
  source: /note="Description of Artificial Sequence: Synthetic peptide"
LVPYACGEV

SEQ ID NO: 28898 - protein, 10 aa, Artificial Sequence
  source: /note="Description of Artificial Sequence: Synthetic peptide"
VLVPYACGEV

SEQ ID NO: 28899 - protein, 9 aa, Artificial Sequence
  source: /note="Description of Artificial Sequence: Synthetic peptide"
LVPYAHGEV

SEQ ID NO: 28900 - protein, 9 aa, Artificial Sequence
  source: /note="Description of Artificial Sequence: Synthetic peptide"
YAHGEVKPR

SEQ ID NO: 28901 - protein, 10 aa, Artificial Sequence
  source: /note="Description of Artificial Sequence: Synthetic peptide"
VLVPYAHGEV

SEQ ID NO: 28902 - protein, 9 aa, Artificial Sequence
  source: /note="Description of Artificial Sequence: Synthetic peptide"
LNRTVVANK

SEQ ID NO: 28903 - protein, 9 aa, Artificial Sequence
  source: /note="Description of Artificial Sequence: Synthetic peptide"
VANKICEHF

SEQ ID NO: 28904 - protein, 9 aa, Artificial Sequence
  source: /note="Description of Artificial Sequence: Synthetic peptide"
NKICEHFAL

SEQ ID NO: 28905 - protein, 10 aa, Artificial Sequence
  source: /note="Description of Artificial Sequence: Synthetic peptide"
KLNRTVVANK

SEQ ID NO: 28906 - protein, 10 aa, Artificial Sequence
  source: /note="Description of Artificial Sequence: Synthetic peptide"
VVANKICEHF

SEQ ID NO: 28907 - protein, 9 aa, Artificial Sequence
  source: /note="Description of Artificial Sequence: Synthetic peptide"
TANMGPGSK

SEQ ID NO: 28908 - protein, 9 aa, Artificial Sequence
  source: /note="Description of Artificial Sequence: Synthetic peptide"
KNSGVTANM

SEQ ID NO: 28909 - protein, 9 aa, Artificial Sequence
  source: /note="Description of Artificial Sequence: Synthetic peptide"
ANMGPGSKF

SEQ ID NO: 28910 - protein, 10 aa, Artificial Sequence
  source: /note="Description of Artificial Sequence: Synthetic peptide"
VTANMGPGSK

SEQ ID NO: 28911 - protein, 10 aa, Artificial Sequence
  source: /note="Description of Artificial Sequence: Synthetic peptide"
MGPGSKFAGY

SEQ ID NO: 28912 - protein, 10 aa, Artificial Sequence
  source: /note="Description of Artificial Sequence: Synthetic peptide"
QKNSGVTANM

SEQ ID NO: 28913 - protein, 10 aa, Artificial Sequence
  source: /note="Description of Artificial Sequence: Synthetic peptide"
TANMGPGSKF

SEQ ID NO: 28914 - protein, 9 aa, Artificial Sequence
  source: /note="Description of Artificial Sequence: Synthetic peptide"
LLLGRGQEA

SEQ ID NO: 28915 - protein, 9 aa, Artificial Sequence
  source: /note="Description of Artificial Sequence: Synthetic peptide"
RGQEAHLQL

SEQ ID NO: 28916 - protein, 9 aa, Artificial Sequence
  source: /note="Description of Artificial Sequence: Synthetic peptide"
QEAHLQLQL

SEQ ID NO: 28917 - protein, 10 aa, Artificial Sequence
  source: /note="Description of Artificial Sequence: Synthetic peptide"
LLGRGQEAHL

SEQ ID NO: 28918 - protein, 10 aa, Artificial Sequence
  source: /note="Description of Artificial Sequence: Synthetic peptide"
EAHLQLQLPR

SEQ ID NO: 28919 - protein, 10 aa, Artificial Sequence
  source: /note="Description of Artificial Sequence: Synthetic peptide"
GQEAHLQLQL

SEQ ID NO: 28920 - protein, 9 aa, Artificial Sequence
  source: /note="Description of Artificial Sequence: Synthetic peptide"
CLFSKCIAM

SEQ ID NO: 28921 - protein, 9 aa, Artificial Sequence
  source: /note="Description of Artificial Sequence: Synthetic peptide"
LFSKCIAMK

SEQ ID NO: 28922 - protein, 9 aa, Artificial Sequence
  source: /note="Description of Artificial Sequence: Synthetic peptide"
LAFFPSCLF

SEQ ID NO: 28923 - protein, 9 aa, Artificial Sequence
  source: /note="Description of Artificial Sequence: Synthetic peptide"
FPSCLFSKC

SEQ ID NO: 28924 - protein, 10 aa, Artificial Sequence
  source: /note="Description of Artificial Sequence: Synthetic peptide"
AFFPSCLFSK

SEQ ID NO: 28925 - protein, 10 aa, Artificial Sequence
  source: /note="Description of Artificial Sequence: Synthetic peptide"
CLFSKCIAMK

SEQ ID NO: 28926 - protein, 10 aa, Artificial Sequence
  source: /note="Description of Artificial Sequence: Synthetic peptide"
ELAFFPSCLF

SEQ ID NO: 28927 - protein, 10 aa, Artificial Sequence
  source: /note="Description of Artificial Sequence: Synthetic peptide"
SCLFSKCIAM

SEQ ID NO: 28928 - protein, 10 aa, Artificial Sequence
  source: /note="Description of Artificial Sequence: Synthetic peptide"
FPSCLFSKCI

SEQ ID NO: 28929 - protein, 10 aa, Artificial Sequence
  source: /note="Description of Artificial Sequence: Synthetic peptide"
RTTTSPTTTR

SEQ ID NO: 28930 - protein, 10 aa, Artificial Sequence
  source: /note="Description of Artificial Sequence: Synthetic peptide"
TTRRTTTSPT

SEQ ID NO: 28931 - protein, 9 aa, Artificial Sequence
  source: /note="Description of Artificial Sequence: Synthetic peptide"
ESIKNSVTR

SEQ ID NO: 28932 - protein, 9 aa, Artificial Sequence
  source: /note="Description of Artificial Sequence: Synthetic peptide"
KESIKNSVT

SEQ ID NO: 28933 - protein, 10 aa, Artificial Sequence
  source: /note="Description of Artificial Sequence: Synthetic peptide"
EMKESIKNSV

SEQ ID NO: 28934 - protein, 10 aa, Artificial Sequence
  source: /note="Description of Artificial Sequence: Synthetic peptide"
KEMKESIKNS

SEQ ID NO: 28935 - protein, 10 aa, Artificial Sequence
  source: /note="Description of Artificial Sequence: Synthetic peptide"
SWYRGWAPPG

SEQ ID NO: 28936 - protein, 9 aa, Artificial Sequence
  source: /note="Description of Artificial Sequence: Synthetic peptide"
VTSTNKESK

SEQ ID NO: 28937 - protein, 9 aa, Artificial Sequence
  source: /note="Description of Artificial Sequence: Synthetic peptide"
STNKESKKY

SEQ ID NO: 28938 - protein, 9 aa, Artificial Sequence
  source: /note="Description of Artificial Sequence: Synthetic peptide"
KKYRKLQTH

SEQ ID NO: 28939 - protein, 10 aa, Artificial Sequence
  source: /note="Description of Artificial Sequence: Synthetic peptide"
VTSTNKESKK

SEQ ID NO: 28940 - protein, 10 aa, Artificial Sequence
  source: /note="Description of Artificial Sequence: Synthetic peptide"
STNKESKKYR

SEQ ID NO: 28941 - protein, 10 aa, Artificial Sequence
  source: /note="Description of Artificial Sequence: Synthetic peptide"
HVTSTNKESK

SEQ ID NO: 28942 - protein, 10 aa, Artificial Sequence
  source: /note="Description of Artificial Sequence: Synthetic peptide"
KKYRKLQTHA

SEQ ID NO: 28943 - protein, 9 aa, Artificial Sequence
  source: /note="Description of Artificial Sequence: Synthetic peptide"
KDQCKAAVF

SEQ ID NO: 28944 - protein, 10 aa, Artificial Sequence
  source: /note="Description of Artificial Sequence: Synthetic peptide"
YKDQCKAAVF

SEQ ID NO: 28945 - protein, 9 aa, Artificial Sequence
  source: /note="Description of Artificial Sequence: Synthetic peptide"
RAATSRMER

SEQ ID NO: 28946 - protein, 9 aa, Artificial Sequence
  source: /note="Description of Artificial Sequence: Synthetic peptide"
VPRAATSRM

SEQ ID NO: 28947 - protein, 9 aa, Artificial Sequence
  source: /note="Description of Artificial Sequence: Synthetic peptide"
MERIWPGGV

SEQ ID NO: 28948 - protein, 10 aa, Artificial Sequence
  source: /note="Description of Artificial Sequence: Synthetic peptide"
RMERIWPGGV

SEQ ID NO: 28949 - protein, 10 aa, Artificial Sequence
  source: /note="Description of Artificial Sequence: Synthetic peptide"
RVPRAATSRM

SEQ ID NO: 28950 - protein, 10 aa, Artificial Sequence
  source: /note="Description of Artificial Sequence: Synthetic peptide"
RAATSRMERI

SEQ ID NO: 28951 - protein, 10 aa, Artificial Sequence
  source: /note="Description of Artificial Sequence: Synthetic peptide"
MERIWPGGVI

SEQ ID NO: 28952 - protein, 9 aa, Artificial Sequence
  source: /note="Description of Artificial Sequence: Synthetic peptide"
FLRFYLDAS

SEQ ID NO: 28953 - protein, 9 aa, Artificial Sequence
  source: /note="Description of Artificial Sequence: Synthetic peptide"
SSMFLRFYL

SEQ ID NO: 28954 - protein, 9 aa, Artificial Sequence
  source: /note="Description of Artificial Sequence: Synthetic peptide"
FYLDASVQR

SEQ ID NO: 28955 - protein, 9 aa, Artificial Sequence
  source: /note="Description of Artificial Sequence: Synthetic peptide"
LRFYLDASV

SEQ ID NO: 28956 - protein, 10 aa, Artificial Sequence
  source: /note="Description of Artificial Sequence: Synthetic peptide"
SMFLRFYLDA

SEQ ID NO: 28957 - protein, 10 aa, Artificial Sequence
  source: /note="Description of Artificial Sequence: Synthetic peptide"
FLRFYLDASV

SEQ ID NO: 28958 - protein, 10 aa, Artificial Sequence
  source: /note="Description of Artificial Sequence: Synthetic peptide"
RFYLDASVQR

SEQ ID NO: 28959 - protein, 10 aa, Artificial Sequence
  source: /note="Description of Artificial Sequence: Synthetic peptide"
FFYSDQNVDL

SEQ ID NO: 28960 - protein, 9 aa, Artificial Sequence
  source: /note="Description of Artificial Sequence: Synthetic peptide"
YLFYVLSTL

SEQ ID NO: 28961 - protein, 9 aa, Artificial Sequence
  source: /note="Description of Artificial Sequence: Synthetic peptide"
YVLSTLYSL

SEQ ID NO: 28962 - protein, 9 aa, Artificial Sequence
  source: /note="Description of Artificial Sequence: Synthetic peptide"
VLSTLYSLT

SEQ ID NO: 28963 - protein, 9 aa, Artificial Sequence
  source: /note="Description of Artificial Sequence: Synthetic peptide"
FYLFYVLST

SEQ ID NO: 28964 - protein, 9 aa, Artificial Sequence
  source: /note="Description of Artificial Sequence: Synthetic peptide"
LFYVLSTLY

SEQ ID NO: 28965 - protein, 9 aa, Artificial Sequence
  source: /note="Description of Artificial Sequence: Synthetic peptide"
IPRFYLFYV

SEQ ID NO: 28966 - protein, 10 aa, Artificial Sequence
  source: /note="Description of Artificial Sequence: Synthetic peptide"
HIPRFYLFYV

SEQ ID NO: 28967 - protein, 10 aa, Artificial Sequence
  source: /note="Description of Artificial Sequence: Synthetic peptide"
YLFYVLSTLY

SEQ ID NO: 28968 - protein, 10 aa, Artificial Sequence
  source: /note="Description of Artificial Sequence: Synthetic peptide"
FYLFYVLSTL

SEQ ID NO: 28969 - protein, 10 aa, Artificial Sequence
  source: /note="Description of Artificial Sequence: Synthetic peptide"
FYVLSTLYSL

SEQ ID NO: 28970 - protein, 10 aa, Artificial Sequence
  source: /note="Description of Artificial Sequence: Synthetic peptide"
RFYLFYVLST

SEQ ID NO: 28971 - protein, 10 aa, Artificial Sequence
  source: /note="Description of Artificial Sequence: Synthetic peptide"
IPRFYLFYVL

SEQ ID NO: 28972 - protein, 9 aa, Artificial Sequence
  source: /note="Description of Artificial Sequence: Synthetic peptide"
DIFTELRNV

SEQ ID NO: 28973 - protein, 9 aa, Artificial Sequence
  source: /note="Description of Artificial Sequence: Synthetic peptide"
FTELRNVTF

SEQ ID NO: 28974 - protein, 9 aa, Artificial Sequence
  source: /note="Description of Artificial Sequence: Synthetic peptide"
TELRNVTFL

SEQ ID NO: 28975 - protein, 9 aa, Artificial Sequence
  source: /note="Description of Artificial Sequence: Synthetic peptide"
LRNVTFLDL

SEQ ID NO: 28976 - protein, 10 aa, Artificial Sequence
  source: /note="Description of Artificial Sequence: Synthetic peptide"
IFTELRNVTF

SEQ ID NO: 28977 - protein, 10 aa, Artificial Sequence
  source: /note="Description of Artificial Sequence: Synthetic peptide"
ELRNVTFLDL

SEQ ID NO: 28978 - protein, 9 aa, Artificial Sequence
  source: /note="Description of Artificial Sequence: Synthetic peptide"
VLSLWAIPV

SEQ ID NO: 28979 - protein, 9 aa, Artificial Sequence
  source: /note="Description of Artificial Sequence: Synthetic peptide"
VFVLSLWAI

SEQ ID NO: 28980 - protein, 9 aa, Artificial Sequence
  source: /note="Description of Artificial Sequence: Synthetic peptide"
WAIPVTYVF

SEQ ID NO: 28981 - protein, 9 aa, Artificial Sequence
  source: /note="Description of Artificial Sequence: Synthetic peptide"
SLWAIPVTY

SEQ ID NO: 28982 - protein, 10 aa, Artificial Sequence
  source: /note="Description of Artificial Sequence: Synthetic peptide"
GVFVLSLWAI

SEQ ID NO: 28983 - protein, 10 aa, Artificial Sequence
  source: /note="Description of Artificial Sequence: Synthetic peptide"
FVLSLWAIPV

SEQ ID NO: 28984 - protein, 10 aa, Artificial Sequence
  source: /note="Description of Artificial Sequence: Synthetic peptide"
VLSLWAIPVT

SEQ ID NO: 28985 - protein, 10 aa, Artificial Sequence
  source: /note="Description of Artificial Sequence: Synthetic peptide"
SLWAIPVTYV

SEQ ID NO: 28986 - protein, 10 aa, Artificial Sequence
  source: /note="Description of Artificial Sequence: Synthetic peptide"
LWAIPVTYVF

SEQ ID NO: 28987 - protein, 10 aa, Artificial Sequence
  source: /note="Description of Artificial Sequence: Synthetic peptide"
LSLWAIPVTY

SEQ ID NO: 28988 - protein, 9 aa, Artificial Sequence
  source: /note="Description of Artificial Sequence: Synthetic peptide"
HPSENLGQV

SEQ ID NO: 28989 - protein, 10 aa, Artificial Sequence
  source: /note="Description of Artificial Sequence: Synthetic peptide"
HPSENLGQVL

SEQ ID NO: 28990 - protein, 10 aa, Artificial Sequence
  source: /note="Description of Artificial Sequence: Synthetic peptide"
SEGKHPSENL

SEQ ID NO: 28991 - protein, 9 aa, Artificial Sequence
  source: /note="Description of Artificial Sequence: Synthetic peptide"
SIQPSFCHR

SEQ ID NO: 28992 - protein, 10 aa, Artificial Sequence
  source: /note="Description of Artificial Sequence: Synthetic peptide"
SSIQPSFCHR

SEQ ID NO: 28993 - protein, 10 aa, Artificial Sequence
  source: /note="Description of Artificial Sequence: Synthetic peptide"
RTSSIQPSFC

SEQ ID NO: 28994 - protein, 9 aa, Artificial Sequence
  source: /note="Description of Artificial Sequence: Synthetic peptide"
QQAGHIKQV

SEQ ID NO: 28995 - protein, 9 aa, Artificial Sequence
  source: /note="Description of Artificial Sequence: Synthetic peptide"
HIKQVFEKK

SEQ ID NO: 28996 - protein, 9 aa, Artificial Sequence
  source: /note="Description of Artificial Sequence: Synthetic peptide"
QAGHIKQVF

SEQ ID NO: 28997 - protein, 10 aa, Artificial Sequence
  source: /note="Description of Artificial Sequence: Synthetic peptide"
AGHIKQVFEK

SEQ ID NO: 28998 - protein, 10 aa, Artificial Sequence
  source: /note="Description of Artificial Sequence: Synthetic peptide"
QQAGHIKQVF

SEQ ID NO: 28999 - protein, 10 aa, Artificial Sequence
  source: /note="Description of Artificial Sequence: Synthetic peptide"
KQQAGHIKQV

SEQ ID NO: 29000 - protein, 9 aa, Artificial Sequence
  source: /note="Description of Artificial Sequence: Synthetic peptide"
SLSQHSMEL

SEQ ID NO: 29001 - protein, 9 aa, Artificial Sequence
  source: /note="Description of Artificial Sequence: Synthetic peptide"
HSMELDTSK

SEQ ID NO: 29002 - protein, 9 aa, Artificial Sequence
  source: /note="Description of Artificial Sequence: Synthetic peptide"
MELDTSKFF

SEQ ID NO: 29003 - protein, 9 aa, Artificial Sequence
  source: /note="Description of Artificial Sequence: Synthetic peptide"
LESLSQHSM

SEQ ID NO: 29004 - protein, 9 aa, Artificial Sequence
  source: /note="Description of Artificial Sequence: Synthetic peptide"
SQHSMELDT

SEQ ID NO: 29005 - protein, 9 aa, Artificial Sequence
  source: /note="Description of Artificial Sequence: Synthetic peptide"
SMELDTSKF

SEQ ID NO: 29006 - protein, 10 aa, Artificial Sequence
  source: /note="Description of Artificial Sequence: Synthetic peptide"
ELDTSKFFGR

SEQ ID NO: 29007 - protein, 10 aa, Artificial Sequence
  source: /note="Description of Artificial Sequence: Synthetic peptide"
ESLSQHSMEL

SEQ ID NO: 29008 - protein, 10 aa, Artificial Sequence
  source: /note="Description of Artificial Sequence: Synthetic peptide"
HSMELDTSKF

SEQ ID NO: 29009 - protein, 10 aa, Artificial Sequence
  source: /note="Description of Artificial Sequence: Synthetic peptide"
LLESLSQHSM

SEQ ID NO: 29010 - protein, 10 aa, Artificial Sequence
  source: /note="Description of Artificial Sequence: Synthetic peptide"
SQHSMELDTS

SEQ ID NO: 29011 - protein, 10 aa, Artificial Sequence
  source: /note="Description of Artificial Sequence: Synthetic peptide"
SMELDTSKFF

SEQ ID NO: 29012 - protein, 10 aa, Artificial Sequence
  source: /note="Description of Artificial Sequence: Synthetic peptide"
MELDTSKFFG

SEQ ID NO: 29013 - protein, 9 aa, Artificial Sequence
  source: /note="Description of Artificial Sequence: Synthetic peptide"
HAPLGPYPR

SEQ ID NO: 29014 - protein, 9 aa, Artificial Sequence
  source: /note="Description of Artificial Sequence: Synthetic peptide"
YPRGPHYDA

SEQ ID NO: 29015 - protein, 9 aa, Artificial Sequence
  source: /note="Description of Artificial Sequence: Synthetic peptide"
GPYPRGPHY

SEQ ID NO: 29016 - protein, 10 aa, Artificial Sequence
  source: /note="Description of Artificial Sequence: Synthetic peptide"
LGPYPRGPHY

SEQ ID NO: 29017 - protein, 10 aa, Artificial Sequence
  source: /note="Description of Artificial Sequence: Synthetic peptide"
YPRGPHYDAG

SEQ ID NO: 29018 - protein, 9 aa, Artificial Sequence
  source: /note="Description of Artificial Sequence: Synthetic peptide"
NSVPPPPPL

SEQ ID NO: 29019 - protein, 10 aa, Artificial Sequence
  source: /note="Description of Artificial Sequence: Synthetic peptide"
RNSVPPPPPL

SEQ ID NO: 29020 - protein, 9 aa, Artificial Sequence
  source: /note="Description of Artificial Sequence: Synthetic peptide"
PQRLSPAPL

SEQ ID NO: 29021 - protein, 10 aa, Artificial Sequence
  source: /note="Description of Artificial Sequence: Synthetic peptide"
QPQEPQPQRL

SEQ ID NO: 29022 - protein, 10 aa, Artificial Sequence
  source: /note="Description of Artificial Sequence: Synthetic peptide"
EPQPQRLSPA

SEQ ID NO: 29023 - protein, 10 aa, Artificial Sequence
  source: /note="Description of Artificial Sequence: Synthetic peptide"
QPQRLSPAPL

SEQ ID NO: 29024 - protein, 10 aa, Artificial Sequence
  source: /note="Description of Artificial Sequence: Synthetic peptide"
RVDFWWCRLR

SEQ ID NO: 29025 - protein, 10 aa, Artificial Sequence
  source: /note="Description of Artificial Sequence: Synthetic peptide"
FWWCRLRASL

SEQ ID NO: 29026 - protein, 10 aa, Artificial Sequence
  source: /note="Description of Artificial Sequence: Synthetic peptide"
GVRVDFWWCR

SEQ ID NO: 29027 - protein, 10 aa, Artificial Sequence
  source: /note="Description of Artificial Sequence: Synthetic peptide"
WWCRLRASLR

SEQ ID NO: 29028 - protein, 10 aa, Artificial Sequence
  source: /note="Description of Artificial Sequence: Synthetic peptide"
WCRLRASLRL

SEQ ID NO: 29029 - protein, 10 aa, Artificial Sequence
  source: /note="Description of Artificial Sequence: Synthetic peptide"
VRVDFWWCRL

SEQ ID NO: 29030 - protein, 9 aa, Artificial Sequence
  source: /note="Description of Artificial Sequence: Synthetic peptide"
YQHAMVWVL

SEQ ID NO: 29031 - protein, 9 aa, Artificial Sequence
  source: /note="Description of Artificial Sequence: Synthetic peptide"
MVWVLTQFV

SEQ ID NO: 29032 - protein, 9 aa, Artificial Sequence
  source: /note="Description of Artificial Sequence: Synthetic peptide"
AMVWVLTQF

SEQ ID NO: 29033 - protein, 9 aa, Artificial Sequence
  source: /note="Description of Artificial Sequence: Synthetic peptide"
LQYQHAMVW

SEQ ID NO: 29034 - protein, 9 aa, Artificial Sequence
  source: /note="Description of Artificial Sequence: Synthetic peptide"
QYQHAMVWV

SEQ ID NO: 29035 - protein, 10 aa, Artificial Sequence
  source: /note="Description of Artificial Sequence: Synthetic peptide"
LQYQHAMVWV

SEQ ID NO: 29036 - protein, 10 aa, Artificial Sequence
  source: /note="Description of Artificial Sequence: Synthetic peptide"
YQHAMVWVLT

SEQ ID NO: 29037 - protein, 10 aa, Artificial Sequence
  source: /note="Description of Artificial Sequence: Synthetic peptide"
AMVWVLTQFV

SEQ ID NO: 29038 - protein, 10 aa, Artificial Sequence
  source: /note="Description of Artificial Sequence: Synthetic peptide"
MVWVLTQFVA

SEQ ID NO: 29039 - protein, 10 aa, Artificial Sequence
  source: /note="Description of Artificial Sequence: Synthetic peptide"
WVLTQFVAEA

SEQ ID NO: 29040 - protein, 10 aa, Artificial Sequence
  source: /note="Description of Artificial Sequence: Synthetic peptide"
QYQHAMVWVL

SEQ ID NO: 29041 - protein, 10 aa, Artificial Sequence
  source: /note="Description of Artificial Sequence: Synthetic peptide"
HAMVWVLTQF

SEQ ID NO: 29042 - protein, 10 aa, Artificial Sequence
  source: /note="Description of Artificial Sequence: Synthetic peptide"
TLQYQHAMVW

SEQ ID NO: 29043 - protein, 9 aa, Artificial Sequence
  source: /note="Description of Artificial Sequence: Synthetic peptide"
AMGSGQATV

SEQ ID NO: 29044 - protein, 9 aa, Artificial Sequence
  source: /note="Description of Artificial Sequence: Synthetic peptide"
STTPCTQGV

SEQ ID NO: 29045 - protein, 9 aa, Artificial Sequence
  source: /note="Description of Artificial Sequence: Synthetic peptide"
LSSWFSPPR

SEQ ID NO: 29046 - protein, 9 aa, Artificial Sequence
  source: /note="Description of Artificial Sequence: Synthetic peptide"
SMSPGPPCR

SEQ ID NO: 29047 - protein, 9 aa, Artificial Sequence
  source: /note="Description of Artificial Sequence: Synthetic peptide"
GSGASSFIR

SEQ ID NO: 29048 - protein, 9 aa, Artificial Sequence
  source: /note="Description of Artificial Sequence: Synthetic peptide"
SWFSPPRWL

SEQ ID NO: 29049 - protein, 9 aa, Artificial Sequence
  source: /note="Description of Artificial Sequence: Synthetic peptide"
TSRRGPPWS

SEQ ID NO: 29050 - protein, 9 aa, Artificial Sequence
  source: /note="Description of Artificial Sequence: Synthetic peptide"
GVREGTASG

SEQ ID NO: 29051 - protein, 9 aa, Artificial Sequence
  source: /note="Description of Artificial Sequence: Synthetic peptide"
KTRGEAMGS

SEQ ID NO: 29052 - protein, 9 aa, Artificial Sequence
  source: /note="Description of Artificial Sequence: Synthetic peptide"
RGSGASSFI

SEQ ID NO: 29053 - protein, 9 aa, Artificial Sequence
  source: /note="Description of Artificial Sequence: Synthetic peptide"
SGKTRGEAM

SEQ ID NO: 29054 - protein, 9 aa, Artificial Sequence
  source: /note="Description of Artificial Sequence: Synthetic peptide"
SSWFSPPRW

SEQ ID NO: 29055 - protein, 9 aa, Artificial Sequence
  source: /note="Description of Artificial Sequence: Synthetic peptide"
WLPGGGSPW

SEQ ID NO: 29056 - protein, 9 aa, Artificial Sequence
  source: /note="Description of Artificial Sequence: Synthetic peptide"
WTSRRGPPW

SEQ ID NO: 29057 - protein, 9 aa, Artificial Sequence
  source: /note="Description of Artificial Sequence: Synthetic peptide"
SGQATVTSM

SEQ ID NO: 29058 - protein, 9 aa, Artificial Sequence
  source: /note="Description of Artificial Sequence: Synthetic peptide"
CRGSGASSF

SEQ ID NO: 29059 - protein, 9 aa, Artificial Sequence
  source: /note="Description of Artificial Sequence: Synthetic peptide"
GEAMGSGQA

SEQ ID NO: 29060 - protein, 10 aa, Artificial Sequence
  source: /note="Description of Artificial Sequence: Synthetic peptide"
WLPGGGSPWT

SEQ ID NO: 29061 - protein, 10 aa, Artificial Sequence
  source: /note="Description of Artificial Sequence: Synthetic peptide"
LLSSWFSPPR

SEQ ID NO: 29062 - protein, 10 aa, Artificial Sequence
  source: /note="Description of Artificial Sequence: Synthetic peptide"
GVREGTASGK

SEQ ID NO: 29063 - protein, 10 aa, Artificial Sequence
  source: /note="Description of Artificial Sequence: Synthetic peptide"
TSMSPGPPCR

SEQ ID NO: 29064 - protein, 10 aa, Artificial Sequence
  source: /note="Description of Artificial Sequence: Synthetic peptide"
RWLPGGGSPW

SEQ ID NO: 29065 - protein, 10 aa, Artificial Sequence
  source: /note="Description of Artificial Sequence: Synthetic peptide"
KTRGEAMGSG

SEQ ID NO: 29066 - protein, 10 aa, Artificial Sequence
  source: /note="Description of Artificial Sequence: Synthetic peptide"
RGSGASSFIR

SEQ ID NO: 29067 - protein, 10 aa, Artificial Sequence
  source: /note="Description of Artificial Sequence: Synthetic peptide"
STTPCTQGVR

SEQ ID NO: 29068 - protein, 10 aa, Artificial Sequence
  source: /note="Description of Artificial Sequence: Synthetic peptide"
SSTTPCTQGV

SEQ ID NO: 29069 - protein, 10 aa, Artificial Sequence
  source: /note="Description of Artificial Sequence: Synthetic peptide"
EAMGSGQATV

SEQ ID NO: 29070 - protein, 10 aa, Artificial Sequence
  source: /note="Description of Artificial Sequence: Synthetic peptide"
SPWTSRRGPP

SEQ ID NO: 29071 - protein, 10 aa, Artificial Sequence
  source: /note="Description of Artificial Sequence: Synthetic peptide"
LSSWFSPPRW

SEQ ID NO: 29072 - protein, 10 aa, Artificial Sequence
  source: /note="Description of Artificial Sequence: Synthetic peptide"
SSWFSPPRWL

SEQ ID NO: 29073 - protein, 10 aa, Artificial Sequence
  source: /note="Description of Artificial Sequence: Synthetic peptide"
ASGKTRGEAM

SEQ ID NO: 29074 - protein, 10 aa, Artificial Sequence
  source: /note="Description of Artificial Sequence: Synthetic peptide"
GEAMGSGQAT

SEQ ID NO: 29075 - protein, 10 aa, Artificial Sequence
  source: /note="Description of Artificial Sequence: Synthetic peptide"
GSGQATVTSM

SEQ ID NO: 29076 - protein, 9 aa, Artificial Sequence
  source: /note="Description of Artificial Sequence: Synthetic peptide"
LVMSRNVGK

SEQ ID NO: 29077 - protein, 9 aa, Artificial Sequence
  source: /note="Description of Artificial Sequence: Synthetic peptide"
SRNVGKGEY

SEQ ID NO: 29078 - protein, 10 aa, Artificial Sequence
  source: /note="Description of Artificial Sequence: Synthetic peptide"
GLNLVMSRNV

SEQ ID NO: 29079 - protein, 10 aa, Artificial Sequence
  source: /note="Description of Artificial Sequence: Synthetic peptide"
MSRNVGKGEY

SEQ ID NO: 29080 - protein, 9 aa, Artificial Sequence
  source: /note="Description of Artificial Sequence: Synthetic peptide"
PSNFCNFTR

SEQ ID NO: 29081 - protein, 10 aa, Artificial Sequence
  source: /note="Description of Artificial Sequence: Synthetic peptide"
FLNPSNFCNF

SEQ ID NO: 29082 - protein, 10 aa, Artificial Sequence
  source: /note="Description of Artificial Sequence: Synthetic peptide"
NPSNFCNFTR

SEQ ID NO: 29083 - protein, 9 aa, Artificial Sequence
  source: /note="Description of Artificial Sequence: Synthetic peptide"
ISLVWCPLV

SEQ ID NO: 29084 - protein, 9 aa, Artificial Sequence
  source: /note="Description of Artificial Sequence: Synthetic peptide"
SLVWCPLVL

SEQ ID NO: 29085 - protein, 9 aa, Artificial Sequence
  source: /note="Description of Artificial Sequence: Synthetic peptide"
VWCPLVLSF

SEQ ID NO: 29086 - protein, 9 aa, Artificial Sequence
  source: /note="Description of Artificial Sequence: Synthetic peptide"
NISLVWCPL

SEQ ID NO: 29087 - protein, 9 aa, Artificial Sequence
  source: /note="Description of Artificial Sequence: Synthetic peptide"
CPLVLSFAI

SEQ ID NO: 29088 - protein, 10 aa, Artificial Sequence
  source: /note="Description of Artificial Sequence: Synthetic peptide"
NISLVWCPLV

SEQ ID NO: 29089 - protein, 10 aa, Artificial Sequence
  source: /note="Description of Artificial Sequence: Synthetic peptide"
ISLVWCPLVL

SEQ ID NO: 29090 - protein, 10 aa, Artificial Sequence
  source: /note="Description of Artificial Sequence: Synthetic peptide"
LVWCPLVLSF

SEQ ID NO: 29091 - protein, 10 aa, Artificial Sequence
  source: /note="Description of Artificial Sequence: Synthetic peptide"
MNISLVWCPL

SEQ ID NO: 29092 - protein, 9 aa, Artificial Sequence
  source: /note="Description of Artificial Sequence: Synthetic peptide"
TLQLWLIIL

SEQ ID NO: 29093 - protein, 9 aa, Artificial Sequence
  source: /note="Description of Artificial Sequence: Synthetic peptide"
LQLWLIILL

SEQ ID NO: 29094 - protein, 9 aa, Artificial Sequence
  source: /note="Description of Artificial Sequence: Synthetic peptide"
EATFDTLQL

SEQ ID NO: 29095 - protein, 9 aa, Artificial Sequence
  source: /note="Description of Artificial Sequence: Synthetic peptide"
ATFDTLQLW

SEQ ID NO: 29096 - protein, 10 aa, Artificial Sequence
  source: /note="Description of Artificial Sequence: Synthetic peptide"
TLQLWLIILL

SEQ ID NO: 29097 - protein, 10 aa, Artificial Sequence
  source: /note="Description of Artificial Sequence: Synthetic peptide"
QLWLIILLCA

SEQ ID NO: 29098 - protein, 10 aa, Artificial Sequence
  source: /note="Description of Artificial Sequence: Synthetic peptide"
ATFDTLQLWL

SEQ ID NO: 29099 - protein, 10 aa, Artificial Sequence
  source: /note="Description of Artificial Sequence: Synthetic peptide"
TFDTLQLWLI

SEQ ID NO: 29100 - protein, 10 aa, Artificial Sequence
  source: /note="Description of Artificial Sequence: Synthetic peptide"
TEATFDTLQL

SEQ ID NO: 29101 - protein, 10 aa, Artificial Sequence
  source: /note="Description of Artificial Sequence: Synthetic peptide"
EATFDTLQLW

SEQ ID NO: 29102 - protein, 9 aa, Artificial Sequence
  source: /note="Description of Artificial Sequence: Synthetic peptide"
GFGPGGELY

SEQ ID NO: 29103 - protein, 9 aa, Artificial Sequence
  source: /note="Description of Artificial Sequence: Synthetic peptide"
WGFGPGGEL

SEQ ID NO: 29104 - protein, 9 aa, Artificial Sequence
  source: /note="Description of Artificial Sequence: Synthetic peptide"
GELYFISTG

SEQ ID NO: 29105 - protein, 10 aa, Artificial Sequence
  source: /note="Description of Artificial Sequence: Synthetic peptide"
GFGPGGELYF

SEQ ID NO: 29106 - protein, 10 aa, Artificial Sequence
  source: /note="Description of Artificial Sequence: Synthetic peptide"
WGFGPGGELY

SEQ ID NO: 29107 - protein, 9 aa, Artificial Sequence
  source: /note="Description of Artificial Sequence: Synthetic peptide"
ISKGGAGRA

SEQ ID NO: 29108 - protein, 9 aa, Artificial Sequence
  source: /note="Description of Artificial Sequence: Synthetic peptide"
AGRAVPVLI

SEQ ID NO: 29109 - protein, 9 aa, Artificial Sequence
  source: /note="Description of Artificial Sequence: Synthetic peptide"
YISKGGAGR

SEQ ID NO: 29110 - protein, 9 aa, Artificial Sequence
  source: /note="Description of Artificial Sequence: Synthetic peptide"
SKGGAGRAV

SEQ ID NO: 29111 - protein, 10 aa, Artificial Sequence
  source: /note="Description of Artificial Sequence: Synthetic peptide"
YISKGGAGRA

SEQ ID NO: 29112 - protein, 10 aa, Artificial Sequence
  source: /note="Description of Artificial Sequence: Synthetic peptide"
AGRAVPVLII

SEQ ID NO: 29113 - protein, 9 aa, Artificial Sequence
  source: /note="Description of Artificial Sequence: Synthetic peptide"
NQRERQHEV

SEQ ID NO: 29114 - protein, 10 aa, Artificial Sequence
  source: /note="Description of Artificial Sequence: Synthetic peptide"
YLHEKNQRER

SEQ ID NO: 29115 - protein, 10 aa, Artificial Sequence
  source: /note="Description of Artificial Sequence: Synthetic peptide"
NQRERQHEVV

SEQ ID NO: 29116 - protein, 9 aa, Artificial Sequence
  source: /note="Description of Artificial Sequence: Synthetic peptide"
NSLFFSYCF

SEQ ID NO: 29117 - protein, 9 aa, Artificial Sequence
  source: /note="Description of Artificial Sequence: Synthetic peptide"
NRNSLFFSY

SEQ ID NO: 29118 - protein, 10 aa, Artificial Sequence
  source: /note="Description of Artificial Sequence: Synthetic peptide"
RNSLFFSYCF

SEQ ID NO: 29119 - protein, 10 aa, Artificial Sequence
  source: /note="Description of Artificial Sequence: Synthetic peptide"
ENRNSLFFSY

SEQ ID NO: 29120 - protein, 9 aa, Artificial Sequence
  source: /note="Description of Artificial Sequence: Synthetic peptide"
NVPLKVFLL

SEQ ID NO: 29121 - protein, 9 aa, Artificial Sequence
  source: /note="Description of Artificial Sequence: Synthetic peptide"
LKVFLLVLF

SEQ ID NO: 29122 - protein, 9 aa, Artificial Sequence
  source: /note="Description of Artificial Sequence: Synthetic peptide"
VPLKVFLLV

SEQ ID NO: 29123 - protein, 10 aa, Artificial Sequence
  source: /note="Description of Artificial Sequence: Synthetic peptide"
NVPLKVFLLV

SEQ ID NO: 29124 - protein, 10 aa, Artificial Sequence
  source: /note="Description of Artificial Sequence: Synthetic peptide"
VPLKVFLLVL

SEQ ID NO: 29125 - protein, 9 aa, Artificial Sequence
  source: /note="Description of Artificial Sequence: Synthetic peptide"
TLALLLSGA

SEQ ID NO: 29126 - protein, 9 aa, Artificial Sequence
  source: /note="Description of Artificial Sequence: Synthetic peptide"
ALLLSGAAI

SEQ ID NO: 29127 - protein, 9 aa, Artificial Sequence
  source: /note="Description of Artificial Sequence: Synthetic peptide"
LLLSGAAII

SEQ ID NO: 29128 - protein, 9 aa, Artificial Sequence
  source: /note="Description of Artificial Sequence: Synthetic peptide"
LLSGAAIIL

SEQ ID NO: 29129 - protein, 10 aa, Artificial Sequence
  source: /note="Description of Artificial Sequence: Synthetic peptide"
ALLLSGAAII

SEQ ID NO: 29130 - protein, 10 aa, Artificial Sequence
  source: /note="Description of Artificial Sequence: Synthetic peptide"
LLLSGAAIIL

SEQ ID NO: 29131 - protein, 10 aa, Artificial Sequence
  source: /note="Description of Artificial Sequence: Synthetic peptide"
LLSGAAIILI

SEQ ID NO: 29132 - protein, 10 aa, Artificial Sequence
  source: /note="Description of Artificial Sequence: Synthetic peptide"
TLALLLSGAA

SEQ ID NO: 29133 - protein, 10 aa, Artificial Sequence
  source: /note="Description of Artificial Sequence: Synthetic peptide"
SGAAIILIAF

SEQ ID NO: 29134 - protein, 10 aa, Artificial Sequence
  source: /note="Description of Artificial Sequence: Synthetic peptide"
LALLLSGAAI

SEQ ID NO: 29135 - protein, 9 aa, Artificial Sequence
  source: /note="Description of Artificial Sequence: Synthetic peptide"
SVGSALPQR

SEQ ID NO: 29136 - protein, 9 aa, Artificial Sequence
  source: /note="Description of Artificial Sequence: Synthetic peptide"
LPQRRCCAY

SEQ ID NO: 29137 - protein, 10 aa, Artificial Sequence
  source: /note="Description of Artificial Sequence: Synthetic peptide"
SSVGSALPQR

SEQ ID NO: 29138 - protein, 10 aa, Artificial Sequence
  source: /note="Description of Artificial Sequence: Synthetic peptide"
ALPQRRCCAY

SEQ ID NO: 29139 - protein, 10 aa, Artificial Sequence
  source: /note="Description of Artificial Sequence: Synthetic peptide"
LPQRRCCAYI

SEQ ID NO: 29140 - protein, 9 aa, Artificial Sequence
  source: /note="Description of Artificial Sequence: Synthetic peptide"
IKKKPGTSL

SEQ ID NO: 29141 - protein, 10 aa, Artificial Sequence
  source: /note="Description of Artificial Sequence: Synthetic peptide"
NIKKKPGTSL

SEQ ID NO: 29142 - protein, 10 aa, Artificial Sequence
  source: /note="Description of Artificial Sequence: Synthetic peptide"
KKPGTSLQCY

SEQ ID NO: 29143 - protein, 9 aa, Artificial Sequence
  source: /note="Description of Artificial Sequence: Synthetic peptide"
HYTCRQSPR

SEQ ID NO: 29144 - protein, 9 aa, Artificial Sequence
  source: /note="Description of Artificial Sequence: Synthetic peptide"
RQSPRLLTN

SEQ ID NO: 29145 - protein, 10 aa, Artificial Sequence
  source: /note="Description of Artificial Sequence: Synthetic peptide"
SHYTCRQSPR

SEQ ID NO: 29146 - protein, 10 aa, Artificial Sequence
  source: /note="Description of Artificial Sequence: Synthetic peptide"
QSPRLLTNGY

SEQ ID NO: 29147 - protein, 10 aa, Artificial Sequence
  source: /note="Description of Artificial Sequence: Synthetic peptide"
RQSPRLLTNG

SEQ ID NO: 29148 - protein, 9 aa, Artificial Sequence
  source: /note="Description of Artificial Sequence: Synthetic peptide"
RNQSSPSAK

SEQ ID NO: 29149 - protein, 10 aa, Artificial Sequence
  source: /note="Description of Artificial Sequence: Synthetic peptide"
EQRNQSSPSA

SEQ ID NO: 29150 - protein, 9 aa, Artificial Sequence
  source: /note="Description of Artificial Sequence: Synthetic peptide"
RTFMPPPGH

SEQ ID NO: 29151 - protein, 9 aa, Artificial Sequence
  source: /note="Description of Artificial Sequence: Synthetic peptide"
MPPPGHPPR

SEQ ID NO: 29152 - protein, 10 aa, Artificial Sequence
  source: /note="Description of Artificial Sequence: Synthetic peptide"
RTFMPPPGHP

SEQ ID NO: 29153 - protein, 10 aa, Artificial Sequence
  source: /note="Description of Artificial Sequence: Synthetic peptide"
FMPPPGHPPR

SEQ ID NO: 29154 - protein, 10 aa, Artificial Sequence
  source: /note="Description of Artificial Sequence: Synthetic peptide"
GECRTFMPPP

SEQ ID NO: 29155 - protein, 9 aa, Artificial Sequence
  source: /note="Description of Artificial Sequence: Synthetic peptide"
QVSSRVTFL

SEQ ID NO: 29156 - protein, 10 aa, Artificial Sequence
  source: /note="Description of Artificial Sequence: Synthetic peptide"
FLDDIRQICL

SEQ ID NO: 29157 - protein, 10 aa, Artificial Sequence
  source: /note="Description of Artificial Sequence: Synthetic peptide"
VQVSSRVTFL

SEQ ID NO: 29158 - protein, 10 aa, Artificial Sequence
  source: /note="Description of Artificial Sequence: Synthetic peptide"
SSRVTFLDDI

SEQ ID NO: 29159 - protein, 9 aa, Artificial Sequence
  source: /note="Description of Artificial Sequence: Synthetic peptide"
KMKRCLRRI

SEQ ID NO: 29160 - protein, 9 aa, Artificial Sequence
  source: /note="Description of Artificial Sequence: Synthetic peptide"
PSKMKRCLR

SEQ ID NO: 29161 - protein, 9 aa, Artificial Sequence
  source: /note="Description of Artificial Sequence: Synthetic peptide"
KPSKMKRCL

SEQ ID NO: 29162 - protein, 9 aa, Artificial Sequence
  source: /note="Description of Artificial Sequence: Synthetic peptide"
MKRCLRRII

SEQ ID NO: 29163 - protein, 10 aa, Artificial Sequence
  source: /note="Description of Artificial Sequence: Synthetic peptide"
CLRRIIVHEK

SEQ ID NO: 29164 - protein, 10 aa, Artificial Sequence
  source: /note="Description of Artificial Sequence: Synthetic peptide"
KMKRCLRRII

SEQ ID NO: 29165 - protein, 10 aa, Artificial Sequence
  source: /note="Description of Artificial Sequence: Synthetic peptide"
SKMKRCLRRI

SEQ ID NO: 29166 - protein, 10 aa, Artificial Sequence
  source: /note="Description of Artificial Sequence: Synthetic peptide"
MKRCLRRIIV

SEQ ID NO: 29167 - protein, 9 aa, Artificial Sequence
  source: /note="Description of Artificial Sequence: Synthetic peptide"
KQNVRKIIL

SEQ ID NO: 29168 - protein, 9 aa, Artificial Sequence
  source: /note="Description of Artificial Sequence: Synthetic peptide"
TPPAVKQNV

SEQ ID NO: 29169 - protein, 10 aa, Artificial Sequence
  source: /note="Description of Artificial Sequence: Synthetic peptide"
KQNVRKIILH

SEQ ID NO: 29170 - protein, 10 aa, Artificial Sequence
  source: /note="Description of Artificial Sequence: Synthetic peptide"
ITPPAVKQNV

SEQ ID NO: 29171 - protein, 10 aa, Artificial Sequence
  source: /note="Description of Artificial Sequence: Synthetic peptide"
VKQNVRKIIL

SEQ ID NO: 29172 - protein, 9 aa, Artificial Sequence
  source: /note="Description of Artificial Sequence: Synthetic peptide"
FSFQSLFGL

SEQ ID NO: 29173 - protein, 9 aa, Artificial Sequence
  source: /note="Description of Artificial Sequence: Synthetic peptide"
EAPFSFQSL

SEQ ID NO: 29174 - protein, 9 aa, Artificial Sequence
  source: /note="Description of Artificial Sequence: Synthetic peptide"
APFSFQSLF

SEQ ID NO: 29175 - protein, 9 aa, Artificial Sequence
  source: /note="Description of Artificial Sequence: Synthetic peptide"
VEAPFSFQS

SEQ ID NO: 29176 - protein, 10 aa, Artificial Sequence
  source: /note="Description of Artificial Sequence: Synthetic peptide"
QSLFGLDDLK

SEQ ID NO: 29177 - protein, 10 aa, Artificial Sequence
  source: /note="Description of Artificial Sequence: Synthetic peptide"
VEAPFSFQSL

SEQ ID NO: 29178 - protein, 10 aa, Artificial Sequence
  source: /note="Description of Artificial Sequence: Synthetic peptide"
FQSLFGLDDL

SEQ ID NO: 29179 - protein, 9 aa, Artificial Sequence
  source: /note="Description of Artificial Sequence: Synthetic peptide"
AIMAVIWKK

SEQ ID NO: 29180 - protein, 9 aa, Artificial Sequence
  source: /note="Description of Artificial Sequence: Synthetic peptide"
GAIMAVIWK

SEQ ID NO: 29181 - protein, 9 aa, Artificial Sequence
  source: /note="Description of Artificial Sequence: Synthetic peptide"
IWKKGLHSY

SEQ ID NO: 29182 - protein, 9 aa, Artificial Sequence
  source: /note="Description of Artificial Sequence: Synthetic peptide"
SGAIMAVIW

SEQ ID NO: 29183 - protein, 10 aa, Artificial Sequence
  source: /note="Description of Artificial Sequence: Synthetic peptide"
IMAVIWKKGL

SEQ ID NO: 29184 - protein, 10 aa, Artificial Sequence
  source: /note="Description of Artificial Sequence: Synthetic peptide"
SGAIMAVIWK

SEQ ID NO: 29185 - protein, 10 aa, Artificial Sequence
  source: /note="Description of Artificial Sequence: Synthetic peptide"
GAIMAVIWKK

SEQ ID NO: 29186 - protein, 10 aa, Artificial Sequence
  source: /note="Description of Artificial Sequence: Synthetic peptide"
VIWKKGLHSY

SEQ ID NO: 29187 - protein, 10 aa, Artificial Sequence
  source: /note="Description of Artificial Sequence: Synthetic peptide"
IWKKGLHSYY

SEQ ID NO: 29188 - protein, 10 aa, Artificial Sequence
  source: /note="Description of Artificial Sequence: Synthetic peptide"
LASGAIMAVI

SEQ ID NO: 29189 - protein, 10 aa, Artificial Sequence
  source: /note="Description of Artificial Sequence: Synthetic peptide"
ASGAIMAVIW

SEQ ID NO: 29190 - protein, 9 aa, Artificial Sequence
  source: /note="Description of Artificial Sequence: Synthetic peptide"
LIIPFVPAR

SEQ ID NO: 29191 - protein, 9 aa, Artificial Sequence
  source: /note="Description of Artificial Sequence: Synthetic peptide"
PFVPARNLF

SEQ ID NO: 29192 - protein, 9 aa, Artificial Sequence
  source: /note="Description of Artificial Sequence: Synthetic peptide"
FVPARNLFF

SEQ ID NO: 29193 - protein, 9 aa, Artificial Sequence
  source: /note="Description of Artificial Sequence: Synthetic peptide"
RNLFFYVGF

SEQ ID NO: 29194 - protein, 9 aa, Artificial Sequence
  source: /note="Description of Artificial Sequence: Synthetic peptide"
PARNLFFYV

SEQ ID NO: 29195 - protein, 9 aa, Artificial Sequence
  source: /note="Description of Artificial Sequence: Synthetic peptide"
VPARNLFFY

SEQ ID NO: 29196 - protein, 9 aa, Artificial Sequence
  source: /note="Description of Artificial Sequence: Synthetic peptide"
IPFVPARNL

SEQ ID NO: 29197 - protein, 10 aa, Artificial Sequence
  source: /note="Description of Artificial Sequence: Synthetic peptide"
FVPARNLFFY

SEQ ID NO: 29198 - protein, 10 aa, Artificial Sequence
  source: /note="Description of Artificial Sequence: Synthetic peptide"
PFVPARNLFF

SEQ ID NO: 29199 - protein, 10 aa, Artificial Sequence
  source: /note="Description of Artificial Sequence: Synthetic peptide"
RNLFFYVGFV

SEQ ID NO: 29200 - protein, 10 aa, Artificial Sequence
  source: /note="Description of Artificial Sequence: Synthetic peptide"
LLIIPFVPAR

SEQ ID NO: 29201 - protein, 10 aa, Artificial Sequence
  source: /note="Description of Artificial Sequence: Synthetic peptide"
VPARNLFFYV

SEQ ID NO: 29202 - protein, 10 aa, Artificial Sequence
  source: /note="Description of Artificial Sequence: Synthetic peptide"
IPFVPARNLF

SEQ ID NO: 29203 - protein, 10 aa, Artificial Sequence
  source: /note="Description of Artificial Sequence: Synthetic peptide"
ARNLFFYVGF

SEQ ID NO: 29204 - protein, 9 aa, Artificial Sequence
  source: /note="Description of Artificial Sequence: Synthetic peptide"
CYYNLGCLY

SEQ ID NO: 29205 - protein, 10 aa, Artificial Sequence
  source: /note="Description of Artificial Sequence: Synthetic peptide"
CLYADLNRHV

SEQ ID NO: 29206 - protein, 9 aa, Artificial Sequence
  source: /note="Description of Artificial Sequence: Synthetic peptide"
HMQKRHCVF

SEQ ID NO: 29207 - protein, 9 aa, Artificial Sequence
  source: /note="Description of Artificial Sequence: Synthetic peptide"
MQKRHCVFF

SEQ ID NO: 29208 - protein, 9 aa, Artificial Sequence
  source: /note="Description of Artificial Sequence: Synthetic peptide"
KRHCVFFVY

SEQ ID NO: 29209 - protein, 9 aa, Artificial Sequence
  source: /note="Description of Artificial Sequence: Synthetic peptide"
EHMQKRHCV

SEQ ID NO: 29210 - protein, 10 aa, Artificial Sequence
  source: /note="Description of Artificial Sequence: Synthetic peptide"
MQKRHCVFFV

SEQ ID NO: 29211 - protein, 10 aa, Artificial Sequence
  source: /note="Description of Artificial Sequence: Synthetic peptide"
HMQKRHCVFF

SEQ ID NO: 29212 - protein, 10 aa, Artificial Sequence
  source: /note="Description of Artificial Sequence: Synthetic peptide"
KRHCVFFVYV

SEQ ID NO: 29213 - protein, 10 aa, Artificial Sequence
  source: /note="Description of Artificial Sequence: Synthetic peptide"
QKRHCVFFVY

SEQ ID NO: 29214 - protein, 10 aa, Artificial Sequence
  source: /note="Description of Artificial Sequence: Synthetic peptide"
EHMQKRHCVF

SEQ ID NO: 29215 - protein, 10 aa, Artificial Sequence
  source: /note="Description of Artificial Sequence: Synthetic peptide"
FEHMQKRHCV

SEQ ID NO: 29216 - protein, 9 aa, Artificial Sequence
  source: /note="Description of Artificial Sequence: Synthetic peptide"
ATTFFCLLH

SEQ ID NO: 29217 - protein, 9 aa, Artificial Sequence
  source: /note="Description of Artificial Sequence: Synthetic peptide"
IVAGATTFF

SEQ ID NO: 29218 - protein, 9 aa, Artificial Sequence
  source: /note="Description of Artificial Sequence: Synthetic peptide"
TTFFCLLHF

SEQ ID NO: 29219 - protein, 9 aa, Artificial Sequence
  source: /note="Description of Artificial Sequence: Synthetic peptide"
LIVAGATTF

SEQ ID NO: 29220 - protein, 10 aa, Artificial Sequence
  source: /note="Description of Artificial Sequence: Synthetic peptide"
TFFCLLHFGV

SEQ ID NO: 29221 - protein, 10 aa, Artificial Sequence
  source: /note="Description of Artificial Sequence: Synthetic peptide"
FLIVAGATTF

SEQ ID NO: 29222 - protein, 10 aa, Artificial Sequence
  source: /note="Description of Artificial Sequence: Synthetic peptide"
ATTFFCLLHF

SEQ ID NO: 29223 - protein, 10 aa, Artificial Sequence
  source: /note="Description of Artificial Sequence: Synthetic peptide"
FFCLLHFGVI

SEQ ID NO: 29224 - protein, 10 aa, Artificial Sequence
  source: /note="Description of Artificial Sequence: Synthetic peptide"
LIVAGATTFF

SEQ ID NO: 29225 - protein, 9 aa, Artificial Sequence
  source: /note="Description of Artificial Sequence: Synthetic peptide"
WQLTQGTTV

SEQ ID NO: 29226 - protein, 9 aa, Artificial Sequence
  source: /note="Description of Artificial Sequence: Synthetic peptide"
QLTQGTTVL

SEQ ID NO: 29227 - protein, 9 aa, Artificial Sequence
  source: /note="Description of Artificial Sequence: Synthetic peptide"
GTTVLGLFR

SEQ ID NO: 29228 - protein, 9 aa, Artificial Sequence
  source: /note="Description of Artificial Sequence: Synthetic peptide"
TTVLGLFRV

SEQ ID NO: 29229 - protein, 9 aa, Artificial Sequence
  source: /note="Description of Artificial Sequence: Synthetic peptide"
TQGTTVLGL

SEQ ID NO: 29230 - protein, 10 aa, Artificial Sequence
  source: /note="Description of Artificial Sequence: Synthetic peptide"
TQGTTVLGLF

SEQ ID NO: 29231 - protein, 10 aa, Artificial Sequence
  source: /note="Description of Artificial Sequence: Synthetic peptide"
WQLTQGTTVL

SEQ ID NO: 29232 - protein, 9 aa, Artificial Sequence
  source: /note="Description of Artificial Sequence: Synthetic peptide"
ALLEQVAGF

SEQ ID NO: 29233 - protein, 9 aa, Artificial Sequence
  source: /note="Description of Artificial Sequence: Synthetic peptide"
QVAGFREQL

SEQ ID NO: 29234 - protein, 10 aa, Artificial Sequence
  source: /note="Description of Artificial Sequence: Synthetic peptide"
ALLEQVAGFR

SEQ ID NO: 29235 - protein, 10 aa, Artificial Sequence
  source: /note="Description of Artificial Sequence: Synthetic peptide"
QVAGFREQLR

SEQ ID NO: 29236 - protein, 10 aa, Artificial Sequence
  source: /note="Description of Artificial Sequence: Synthetic peptide"
EQVAGFREQL

SEQ ID NO: 29237 - protein, 10 aa, Artificial Sequence
  source: /note="Description of Artificial Sequence: Synthetic peptide"
DALLEQVAGF

SEQ ID NO: 29238 - protein, 9 aa, Artificial Sequence
  source: /note="Description of Artificial Sequence: Synthetic peptide"
RARATSDVL

SEQ ID NO: 29239 - protein, 9 aa, Artificial Sequence
  source: /note="Description of Artificial Sequence: Synthetic peptide"
AEGERARAT

SEQ ID NO: 29240 - protein, 10 aa, Artificial Sequence
  source: /note="Description of Artificial Sequence: Synthetic peptide"
RARATSDVLC

SEQ ID NO: 29241 - protein, 10 aa, Artificial Sequence
  source: /note="Description of Artificial Sequence: Synthetic peptide"
GERARATSDV

SEQ ID NO: 29242 - protein, 9 aa, Artificial Sequence
  source: /note="Description of Artificial Sequence: Synthetic peptide"
RPLPPPARL

SEQ ID NO: 29243 - protein, 10 aa, Artificial Sequence
  source: /note="Description of Artificial Sequence: Synthetic peptide"
DARPLPPPAR

SEQ ID NO: 29244 - protein, 9 aa, Artificial Sequence
  source: /note="Description of Artificial Sequence: Synthetic peptide"
PTKKKQGWK

SEQ ID NO: 29245 - protein, 9 aa, Artificial Sequence
  source: /note="Description of Artificial Sequence: Synthetic peptide"
KKQGWKYSF

SEQ ID NO: 29246 - protein, 10 aa, Artificial Sequence
  source: /note="Description of Artificial Sequence: Synthetic peptide"
PTKKKQGWKY

SEQ ID NO: 29247 - protein, 10 aa, Artificial Sequence
  source: /note="Description of Artificial Sequence: Synthetic peptide"
KKKQGWKYSF

SEQ ID NO: 29248 - protein, 9 aa, Artificial Sequence
  source: /note="Description of Artificial Sequence: Synthetic peptide"
IMVTASSET

SEQ ID NO: 29249 - protein, 9 aa, Artificial Sequence
  source: /note="Description of Artificial Sequence: Synthetic peptide"
SPRDIMVTA

SEQ ID NO: 29250 - protein, 9 aa, Artificial Sequence
  source: /note="Description of Artificial Sequence: Synthetic peptide"
TELDSPRDI

SEQ ID NO: 29251 - protein, 10 aa, Artificial Sequence
  source: /note="Description of Artificial Sequence: Synthetic peptide"
DSPRDIMVTA

SEQ ID NO: 29252 - protein, 10 aa, Artificial Sequence
  source: /note="Description of Artificial Sequence: Synthetic peptide"
SPRDIMVTAS

SEQ ID NO: 29253 - protein, 10 aa, Artificial Sequence
  source: /note="Description of Artificial Sequence: Synthetic peptide"
TELDSPRDIM

SEQ ID NO: 29254 - protein, 10 aa, Artificial Sequence
  source: /note="Description of Artificial Sequence: Synthetic peptide"
IMVTASSETS

SEQ ID NO: 29255 - protein, 9 aa, Artificial Sequence
  source: /note="Description of Artificial Sequence: Synthetic peptide"
KMNNKSLFL

SEQ ID NO: 29256 - protein, 9 aa, Artificial Sequence
  source: /note="Description of Artificial Sequence: Synthetic peptide"
KSLFLHHVI

SEQ ID NO: 29257 - protein, 9 aa, Artificial Sequence
  source: /note="Description of Artificial Sequence: Synthetic peptide"
SIKMNNKSL

SEQ ID NO: 29258 - protein, 9 aa, Artificial Sequence
  source: /note="Description of Artificial Sequence: Synthetic peptide"
SLFLHHVIM

SEQ ID NO: 29259 - protein, 9 aa, Artificial Sequence
  source: /note="Description of Artificial Sequence: Synthetic peptide"
IKMNNKSLF

SEQ ID NO: 29260 - protein, 10 aa, Artificial Sequence
  source: /note="Description of Artificial Sequence: Synthetic peptide"
KMNNKSLFLH

SEQ ID NO: 29261 - protein, 10 aa, Artificial Sequence
  source: /note="Description of Artificial Sequence: Synthetic peptide"
SIKMNNKSLF

SEQ ID NO: 29262 - protein, 10 aa, Artificial Sequence
  source: /note="Description of Artificial Sequence: Synthetic peptide"
KSLFLHHVIM

SEQ ID NO: 29263 - protein, 10 aa, Artificial Sequence
  source: /note="Description of Artificial Sequence: Synthetic peptide"
IKMNNKSLFL

SEQ ID NO: 29264 - protein, 10 aa, Artificial Sequence
  source: /note="Description of Artificial Sequence: Synthetic peptide"
NKSLFLHHVI

SEQ ID NO: 29265 - protein, 10 aa, Artificial Sequence
  source: /note="Description of Artificial Sequence: Synthetic peptide"
SLFLHHVIMH

SEQ ID NO: 29266 - protein, 10 aa, Artificial Sequence
  source: /note="Description of Artificial Sequence: Synthetic peptide"
RAGQCVCRGL

SEQ ID NO: 29267 - protein, 9 aa, Artificial Sequence
  source: /note="Description of Artificial Sequence: Synthetic peptide"
KVLFTCFKL

SEQ ID NO: 29268 - protein, 9 aa, Artificial Sequence
  source: /note="Description of Artificial Sequence: Synthetic peptide"
KLNDKREVK

SEQ ID NO: 29269 - protein, 9 aa, Artificial Sequence
  source: /note="Description of Artificial Sequence: Synthetic peptide"
FTCFKLNDK

SEQ ID NO: 29270 - protein, 10 aa, Artificial Sequence
  source: /note="Description of Artificial Sequence: Synthetic peptide"
KLNDKREVKV

SEQ ID NO: 29271 - protein, 10 aa, Artificial Sequence
  source: /note="Description of Artificial Sequence: Synthetic peptide"
FTCFKLNDKR

SEQ ID NO: 29272 - protein, 10 aa, Artificial Sequence
  source: /note="Description of Artificial Sequence: Synthetic peptide"
RKVLFTCFKL

SEQ ID NO: 29273 - protein, 9 aa, Artificial Sequence
  source: /note="Description of Artificial Sequence: Synthetic peptide"
KGGEAKGKK

SEQ ID NO: 29274 - protein, 10 aa, Artificial Sequence
  source: /note="Description of Artificial Sequence: Synthetic peptide"
GEAKGKKTQM

SEQ ID NO: 29275 - protein, 9 aa, Artificial Sequence
  source: /note="Description of Artificial Sequence: Synthetic peptide"
DMERHHILF

SEQ ID NO: 29276 - protein, 9 aa, Artificial Sequence
  source: /note="Description of Artificial Sequence: Synthetic peptide"
MERHHILFR

SEQ ID NO: 29277 - protein, 9 aa, Artificial Sequence
  source: /note="Description of Artificial Sequence: Synthetic peptide"
RHHILFRYA

SEQ ID NO: 29278 - protein, 9 aa, Artificial Sequence
  source: /note="Description of Artificial Sequence: Synthetic peptide"
ADMERHHIL

SEQ ID NO: 29279 - protein, 9 aa, Artificial Sequence
  source: /note="Description of Artificial Sequence: Synthetic peptide"
FADMERHHI

SEQ ID NO: 29280 - protein, 10 aa, Artificial Sequence
  source: /note="Description of Artificial Sequence: Synthetic peptide"
YFADMERHHI

SEQ ID NO: 29281 - protein, 10 aa, Artificial Sequence
  source: /note="Description of Artificial Sequence: Synthetic peptide"
MERHHILFRY

SEQ ID NO: 29282 - protein, 10 aa, Artificial Sequence
  source: /note="Description of Artificial Sequence: Synthetic peptide"
DMERHHILFR

SEQ ID NO: 29283 - protein, 10 aa, Artificial Sequence
  source: /note="Description of Artificial Sequence: Synthetic peptide"
FADMERHHIL

SEQ ID NO: 29284 - protein, 10 aa, Artificial Sequence
  source: /note="Description of Artificial Sequence: Synthetic peptide"
ADMERHHILF

SEQ ID NO: 29285 - protein, 9 aa, Artificial Sequence
  source: /note="Description of Artificial Sequence: Synthetic peptide"
FSQEEQRCY

SEQ ID NO: 29286 - protein, 9 aa, Artificial Sequence
  source: /note="Description of Artificial Sequence: Synthetic peptide"
LVGGRLFYM

SEQ ID NO: 29287 - protein, 9 aa, Artificial Sequence
  source: /note="Description of Artificial Sequence: Synthetic peptide"
RLFYMWISL

SEQ ID NO: 29288 - protein, 9 aa, Artificial Sequence
  source: /note="Description of Artificial Sequence: Synthetic peptide"
YLVILYLYL

SEQ ID NO: 29289 - protein, 9 aa, Artificial Sequence
  source: /note="Description of Artificial Sequence: Synthetic peptide"
YLYLKRPHI

SEQ ID NO: 29290 - protein, 9 aa, Artificial Sequence
  source: /note="Description of Artificial Sequence: Synthetic peptide"
NLALLREHL

SEQ ID NO: 29291 - protein, 9 aa, Artificial Sequence
  source: /note="Description of Artificial Sequence: Synthetic peptide"
HLVGGRLFY

SEQ ID NO: 29292 - protein, 9 aa, Artificial Sequence
  source: /note="Description of Artificial Sequence: Synthetic peptide"
LVILYLYLK

SEQ ID NO: 29293 - protein, 9 aa, Artificial Sequence
  source: /note="Description of Artificial Sequence: Synthetic peptide"
FYMWISLEK

SEQ ID NO: 29294 - protein, 9 aa, Artificial Sequence
  source: /note="Description of Artificial Sequence: Synthetic peptide"
VILYLYLKR

SEQ ID NO: 29295 - protein, 9 aa, Artificial Sequence
  source: /note="Description of Artificial Sequence: Synthetic peptide"
VGGRLFYMW

SEQ ID NO: 29296 - protein, 9 aa, Artificial Sequence
  source: /note="Description of Artificial Sequence: Synthetic peptide"
CYLVILYLY

SEQ ID NO: 29297 - protein, 9 aa, Artificial Sequence
  source: /note="Description of Artificial Sequence: Synthetic peptide"
LYLKRPHIF

SEQ ID NO: 29298 - protein, 9 aa, Artificial Sequence
  source: /note="Description of Artificial Sequence: Synthetic peptide"
YLKRPHIFF

SEQ ID NO: 29299 - protein, 9 aa, Artificial Sequence
  source: /note="Description of Artificial Sequence: Synthetic peptide"
KSSKDKNLA

SEQ ID NO: 29300 - protein, 9 aa, Artificial Sequence
  source: /note="Description of Artificial Sequence: Synthetic peptide"
SSKDKNLAL

SEQ ID NO: 29301 - protein, 9 aa, Artificial Sequence
  source: /note="Description of Artificial Sequence: Synthetic peptide"
GGRLFYMWI

SEQ ID NO: 29302 - protein, 9 aa, Artificial Sequence
  source: /note="Description of Artificial Sequence: Synthetic peptide"
AFFSQEEQR

SEQ ID NO: 29303 - protein, 9 aa, Artificial Sequence
  source: /note="Description of Artificial Sequence: Synthetic peptide"
AMRWRKKSS

SEQ ID NO: 29304 - protein, 9 aa, Artificial Sequence
  source: /note="Description of Artificial Sequence: Synthetic peptide"
EQRCYLVIL

SEQ ID NO: 29305 - protein, 9 aa, Artificial Sequence
  source: /note="Description of Artificial Sequence: Synthetic peptide"
LKRPHIFFL

SEQ ID NO: 29306 - protein, 9 aa, Artificial Sequence
  source: /note="Description of Artificial Sequence: Synthetic peptide"
LEKQASNAF

SEQ ID NO: 29307 - protein, 9 aa, Artificial Sequence
  source: /note="Description of Artificial Sequence: Synthetic peptide"
REHLVGGRL

SEQ ID NO: 29308 - protein, 9 aa, Artificial Sequence
  source: /note="Description of Artificial Sequence: Synthetic peptide"
EKQASNAFF

SEQ ID NO: 29309 - protein, 9 aa, Artificial Sequence
  source: /note="Description of Artificial Sequence: Synthetic peptide"
KQASNAFFS

SEQ ID NO: 29310 - protein, 9 aa, Artificial Sequence
  source: /note="Description of Artificial Sequence: Synthetic peptide"
SQEEQRCYL

SEQ ID NO: 29311 - protein, 9 aa, Artificial Sequence
  source: /note="Description of Artificial Sequence: Synthetic peptide"
RCYLVILYL

SEQ ID NO: 29312 - protein, 9 aa, Artificial Sequence
  source: /note="Description of Artificial Sequence: Synthetic peptide"
EEQRCYLVI

SEQ ID NO: 29313 - protein, 9 aa, Artificial Sequence
  source: /note="Description of Artificial Sequence: Synthetic peptide"
QEEQRCYLV

SEQ ID NO: 29314 - protein, 10 aa, Artificial Sequence
  source: /note="Description of Artificial Sequence: Synthetic peptide"
NLALLREHLV

SEQ ID NO: 29315 - protein, 10 aa, Artificial Sequence
  source: /note="Description of Artificial Sequence: Synthetic peptide"
HLVGGRLFYM

SEQ ID NO: 29316 - protein, 10 aa, Artificial Sequence
  source: /note="Description of Artificial Sequence: Synthetic peptide"
YMWISLEKQA

SEQ ID NO: 29317 - protein, 10 aa, Artificial Sequence
  source: /note="Description of Artificial Sequence: Synthetic peptide"
YLKRPHIFFL

SEQ ID NO: 29318 - protein, 10 aa, Artificial Sequence
  source: /note="Description of Artificial Sequence: Synthetic peptide"
AMRWRKKSSK

SEQ ID NO: 29319 - protein, 10 aa, Artificial Sequence
  source: /note="Description of Artificial Sequence: Synthetic peptide"
LFYMWISLEK

SEQ ID NO: 29320 - protein, 10 aa, Artificial Sequence
  source: /note="Description of Artificial Sequence: Synthetic peptide"
YLVILYLYLK

SEQ ID NO: 29321 - protein, 10 aa, Artificial Sequence
  source: /note="Description of Artificial Sequence: Synthetic peptide"
LVGGRLFYMW

SEQ ID NO: 29322 - protein, 10 aa, Artificial Sequence
  source: /note="Description of Artificial Sequence: Synthetic peptide"
CYLVILYLYL

SEQ ID NO: 29323 - protein, 10 aa, Artificial Sequence
  source: /note="Description of Artificial Sequence: Synthetic peptide"
LYLYLKRPHI

SEQ ID NO: 29324 - protein, 10 aa, Artificial Sequence
  source: /note="Description of Artificial Sequence: Synthetic peptide"
YLYLKRPHIF

SEQ ID NO: 29325 - protein, 10 aa, Artificial Sequence
  source: /note="Description of Artificial Sequence: Synthetic peptide"
LYLKRPHIFF

SEQ ID NO: 29326 - protein, 10 aa, Artificial Sequence
  source: /note="Description of Artificial Sequence: Synthetic peptide"
RWRKKSSKDK

SEQ ID NO: 29327 - protein, 10 aa, Artificial Sequence
  source: /note="Description of Artificial Sequence: Synthetic peptide"
SSKDKNLALL

SEQ ID NO: 29328 - protein, 10 aa, Artificial Sequence
  source: /note="Description of Artificial Sequence: Synthetic peptide"
EQRCYLVILY

SEQ ID NO: 29329 - protein, 10 aa, Artificial Sequence
  source: /note="Description of Artificial Sequence: Synthetic peptide"
RCYLVILYLY

SEQ ID NO: 29330 - protein, 10 aa, Artificial Sequence
  source: /note="Description of Artificial Sequence: Synthetic peptide"
LLREHLVGGR

SEQ ID NO: 29331 - protein, 10 aa, Artificial Sequence
  source: /note="Description of Artificial Sequence: Synthetic peptide"
NAFFSQEEQR

SEQ ID NO: 29332 - protein, 10 aa, Artificial Sequence
  source: /note="Description of Artificial Sequence: Synthetic peptide"
LVILYLYLKR

SEQ ID NO: 29333 - protein, 10 aa, Artificial Sequence
  source: /note="Description of Artificial Sequence: Synthetic peptide"
SLEKQASNAF

SEQ ID NO: 29334 - protein, 10 aa, Artificial Sequence
  source: /note="Description of Artificial Sequence: Synthetic peptide"
LEKQASNAFF

SEQ ID NO: 29335 - protein, 10 aa, Artificial Sequence
  source: /note="Description of Artificial Sequence: Synthetic peptide"
KSSKDKNLAL

SEQ ID NO: 29336 - protein, 10 aa, Artificial Sequence
  source: /note="Description of Artificial Sequence: Synthetic peptide"
KNLALLREHL

SEQ ID NO: 29337 - protein, 10 aa, Artificial Sequence
  source: /note="Description of Artificial Sequence: Synthetic peptide"
REHLVGGRLF

SEQ ID NO: 29338 - protein, 10 aa, Artificial Sequence
  source: /note="Description of Artificial Sequence: Synthetic peptide"
GRLFYMWISL

SEQ ID NO: 29339 - protein, 10 aa, Artificial Sequence
  source: /note="Description of Artificial Sequence: Synthetic peptide"
KQASNAFFSQ

SEQ ID NO: 29340 - protein, 10 aa, Artificial Sequence
  source: /note="Description of Artificial Sequence: Synthetic peptide"
ILYLYLKRPH

SEQ ID NO: 29341 - protein, 10 aa, Artificial Sequence
  source: /note="Description of Artificial Sequence: Synthetic peptide"
EEQRCYLVIL

SEQ ID NO: 29342 - protein, 10 aa, Artificial Sequence
  source: /note="Description of Artificial Sequence: Synthetic peptide"
QEEQRCYLVI

SEQ ID NO: 29343 - protein, 9 aa, Artificial Sequence
  source: /note="Description of Artificial Sequence: Synthetic peptide"
KEASDRTGA

SEQ ID NO: 29344 - protein, 9 aa, Artificial Sequence
  source: /note="Description of Artificial Sequence: Synthetic peptide"
RQLWLFLLL

SEQ ID NO: 29345 - protein, 9 aa, Artificial Sequence
  source: /note="Description of Artificial Sequence: Synthetic peptide"
QLWLFLLLL

SEQ ID NO: 29346 - protein, 9 aa, Artificial Sequence
  source: /note="Description of Artificial Sequence: Synthetic peptide"
FLLLLLPGA

SEQ ID NO: 29347 - protein, 9 aa, Artificial Sequence
  source: /note="Description of Artificial Sequence: Synthetic peptide"
PWRQLWLFL

SEQ ID NO: 29348 - protein, 9 aa, Artificial Sequence
  source: /note="Description of Artificial Sequence: Synthetic peptide"
LWLFLLLLL

SEQ ID NO: 29349 - protein, 10 aa, Artificial Sequence
  source: /note="Description of Artificial Sequence: Synthetic peptide"
RQLWLFLLLL

SEQ ID NO: 29350 - protein, 10 aa, Artificial Sequence
  source: /note="Description of Artificial Sequence: Synthetic peptide"
QLWLFLLLLL

SEQ ID NO: 29351 - protein, 10 aa, Artificial Sequence
  source: /note="Description of Artificial Sequence: Synthetic peptide"
PWRQLWLFLL

SEQ ID NO: 29352 - protein, 10 aa, Artificial Sequence
  source: /note="Description of Artificial Sequence: Synthetic peptide"
GPWRQLWLFL

SEQ ID NO: 29353 - protein, 9 aa, Artificial Sequence
  source: /note="Description of Artificial Sequence: Synthetic peptide"
QLINLKPSV

SEQ ID NO: 29354 - protein, 9 aa, Artificial Sequence
  source: /note="Description of Artificial Sequence: Synthetic peptide"
LINLKPSVF

SEQ ID NO: 29355 - protein, 9 aa, Artificial Sequence
  source: /note="Description of Artificial Sequence: Synthetic peptide"
SQPPQLINL

SEQ ID NO: 29356 - protein, 10 aa, Artificial Sequence
  source: /note="Description of Artificial Sequence: Synthetic peptide"
SQPPQLINLK

SEQ ID NO: 29357 - protein, 10 aa, Artificial Sequence
  source: /note="Description of Artificial Sequence: Synthetic peptide"
QLINLKPSVF

SEQ ID NO: 29358 - protein, 9 aa, Artificial Sequence
  source: /note="Description of Artificial Sequence: Synthetic peptide"
ELFEMFREL

SEQ ID NO: 29359 - protein, 9 aa, Artificial Sequence
  source: /note="Description of Artificial Sequence: Synthetic peptide"
LQIRGRELF

SEQ ID NO: 29360 - protein, 9 aa, Artificial Sequence
  source: /note="Description of Artificial Sequence: Synthetic peptide"
RGRELFEMF

SEQ ID NO: 29361 - protein, 9 aa, Artificial Sequence
  source: /note="Description of Artificial Sequence: Synthetic peptide"
TLQIRGREL

SEQ ID NO: 29362 - protein, 9 aa, Artificial Sequence
  source: /note="Description of Artificial Sequence: Synthetic peptide"
IRGRELFEM

SEQ ID NO: 29363 - protein, 10 aa, Artificial Sequence
  source: /note="Description of Artificial Sequence: Synthetic peptide"
RGRELFEMFR

SEQ ID NO: 29364 - protein, 10 aa, Artificial Sequence
  source: /note="Description of Artificial Sequence: Synthetic peptide"
TLQIRGRELF

SEQ ID NO: 29365 - protein, 10 aa, Artificial Sequence
  source: /note="Description of Artificial Sequence: Synthetic peptide"
IRGRELFEMF

SEQ ID NO: 29366 - protein, 10 aa, Artificial Sequence
  source: /note="Description of Artificial Sequence: Synthetic peptide"
RELFEMFREL

SEQ ID NO: 29367 - protein, 9 aa, Artificial Sequence
  source: /note="Description of Artificial Sequence: Synthetic peptide"
KLPECQRLL

SEQ ID NO: 29368 - protein, 9 aa, Artificial Sequence
  source: /note="Description of Artificial Sequence: Synthetic peptide"
SLPRKPTRA

SEQ ID NO: 29369 - protein, 9 aa, Artificial Sequence
  source: /note="Description of Artificial Sequence: Synthetic peptide"
RLLPPWPLH

SEQ ID NO: 29370 - protein, 9 aa, Artificial Sequence
  source: /note="Description of Artificial Sequence: Synthetic peptide"
LSLPRKPTR

SEQ ID NO: 29371 - protein, 9 aa, Artificial Sequence
  source: /note="Description of Artificial Sequence: Synthetic peptide"
PTRAATVSV

SEQ ID NO: 29372 - protein, 9 aa, Artificial Sequence
  source: /note="Description of Artificial Sequence: Synthetic peptide"
RAATVSVWA

SEQ ID NO: 29373 - protein, 9 aa, Artificial Sequence
  source: /note="Description of Artificial Sequence: Synthetic peptide"
QMKLPECQR

SEQ ID NO: 29374 - protein, 9 aa, Artificial Sequence
  source: /note="Description of Artificial Sequence: Synthetic peptide"
TVSVWASCI

SEQ ID NO: 29375 - protein, 9 aa, Artificial Sequence
  source: /note="Description of Artificial Sequence: Synthetic peptide"
LPRKPTRAA

SEQ ID NO: 29376 - protein, 9 aa, Artificial Sequence
  source: /note="Description of Artificial Sequence: Synthetic peptide"
QQLLHRRPL

SEQ ID NO: 29377 - protein, 9 aa, Artificial Sequence
  source: /note="Description of Artificial Sequence: Synthetic peptide"
MKLPECQRL

SEQ ID NO: 29378 - protein, 9 aa, Artificial Sequence
  source: /note="Description of Artificial Sequence: Synthetic peptide"
QRLLPPWPL

SEQ ID NO: 29379 - protein, 9 aa, Artificial Sequence
  source: /note="Description of Artificial Sequence: Synthetic peptide"
TRAATVSVW

SEQ ID NO: 29380 - protein, 9 aa, Artificial Sequence
  source: /note="Description of Artificial Sequence: Synthetic peptide"
VSVWASCIL

SEQ ID NO: 29381 - protein, 9 aa, Artificial Sequence
  source: /note="Description of Artificial Sequence: Synthetic peptide"
WPLHQQLLH

SEQ ID NO: 29382 - protein, 9 aa, Artificial Sequence
  source: /note="Description of Artificial Sequence: Synthetic peptide"
TEDQVQMKL

SEQ ID NO: 29383 - protein, 10 aa, Artificial Sequence
  source: /note="Description of Artificial Sequence: Synthetic peptide"
SLPRKPTRAA

SEQ ID NO: 29384 - protein, 10 aa, Artificial Sequence
  source: /note="Description of Artificial Sequence: Synthetic peptide"
CQRLLPPWPL

SEQ ID NO: 29385 - protein, 10 aa, Artificial Sequence
  source: /note="Description of Artificial Sequence: Synthetic peptide"
LLSLPRKPTR

SEQ ID NO: 29386 - protein, 10 aa, Artificial Sequence
  source: /note="Description of Artificial Sequence: Synthetic peptide"
ATVSVWASCI

SEQ ID NO: 29387 - protein, 10 aa, Artificial Sequence
  source: /note="Description of Artificial Sequence: Synthetic peptide"
TVSVWASCIL

SEQ ID NO: 29388 - protein, 10 aa, Artificial Sequence
  source: /note="Description of Artificial Sequence: Synthetic peptide"
LPPWPLHQQL

SEQ ID NO: 29389 - protein, 10 aa, Artificial Sequence
  source: /note="Description of Artificial Sequence: Synthetic peptide"
LPRKPTRAAT

SEQ ID NO: 29390 - protein, 10 aa, Artificial Sequence
  source: /note="Description of Artificial Sequence: Synthetic peptide"
KPTRAATVSV

SEQ ID NO: 29391 - protein, 10 aa, Artificial Sequence
  source: /note="Description of Artificial Sequence: Synthetic peptide"
HQQLLHRRPL

SEQ ID NO: 29392 - protein, 10 aa, Artificial Sequence
  source: /note="Description of Artificial Sequence: Synthetic peptide"
QWFTEDQVQM

SEQ ID NO: 29393 - protein, 10 aa, Artificial Sequence
  source: /note="Description of Artificial Sequence: Synthetic peptide"
MKLPECQRLL

SEQ ID NO: 29394 - protein, 10 aa, Artificial Sequence
  source: /note="Description of Artificial Sequence: Synthetic peptide"
QQLLHRRPLH

SEQ ID NO: 29395 - protein, 10 aa, Artificial Sequence
  source: /note="Description of Artificial Sequence: Synthetic peptide"
HQPPPGPCHL

SEQ ID NO: 29396 - protein, 10 aa, Artificial Sequence
  source: /note="Description of Artificial Sequence: Synthetic peptide"
ASCILGQPSL

SEQ ID NO: 29397 - protein, 10 aa, Artificial Sequence
  source: /note="Description of Artificial Sequence: Synthetic peptide"
IEQWFTEDQV

SEQ ID NO: 29398 - protein, 9 aa, Artificial Sequence
  source: /note="Description of Artificial Sequence: Synthetic peptide"
SLPRKPTRA

SEQ ID NO: 29399 - protein, 9 aa, Artificial Sequence
  source: /note="Description of Artificial Sequence: Synthetic peptide"
RMPEAAPPW

SEQ ID NO: 29400 - protein, 9 aa, Artificial Sequence
  source: /note="Description of Artificial Sequence: Synthetic peptide"
LSLPRKPTR

SEQ ID NO: 29401 - protein, 9 aa, Artificial Sequence
  source: /note="Description of Artificial Sequence: Synthetic peptide"
PTRAATVSV

SEQ ID NO: 29402 - protein, 9 aa, Artificial Sequence
  source: /note="Description of Artificial Sequence: Synthetic peptide"
RAATVSVWA

SEQ ID NO: 29403 - protein, 9 aa, Artificial Sequence
  source: /note="Description of Artificial Sequence: Synthetic peptide"
TVSVWASCI

SEQ ID NO: 29404 - protein, 9 aa, Artificial Sequence
  source: /note="Description of Artificial Sequence: Synthetic peptide"
LPRKPTRAA

SEQ ID NO: 29405 - protein, 9 aa, Artificial Sequence
  source: /note="Description of Artificial Sequence: Synthetic peptide"
QQLLHRRPL

SEQ ID NO: 29406 - protein, 9 aa, Artificial Sequence
  source: /note="Description of Artificial Sequence: Synthetic peptide"
TRAATVSVW

SEQ ID NO: 29407 - protein, 9 aa, Artificial Sequence
  source: /note="Description of Artificial Sequence: Synthetic peptide"
VSVWASCIL

SEQ ID NO: 29408 - protein, 9 aa, Artificial Sequence
  source: /note="Description of Artificial Sequence: Synthetic peptide"
WPLHQQLLH

SEQ ID NO: 29409 - protein, 9 aa, Artificial Sequence
  source: /note="Description of Artificial Sequence: Synthetic peptide"
PEAAPPWPL

SEQ ID NO: 29410 - protein, 10 aa, Artificial Sequence
  source: /note="Description of Artificial Sequence: Synthetic peptide"
SLPRKPTRAA

SEQ ID NO: 29411 - protein, 10 aa, Artificial Sequence
  source: /note="Description of Artificial Sequence: Synthetic peptide"
LLSLPRKPTR

SEQ ID NO: 29412 - protein, 10 aa, Artificial Sequence
  source: /note="Description of Artificial Sequence: Synthetic peptide"
ATVSVWASCI

SEQ ID NO: 29413 - protein, 10 aa, Artificial Sequence
  source: /note="Description of Artificial Sequence: Synthetic peptide"
TVSVWASCIL

SEQ ID NO: 29414 - protein, 10 aa, Artificial Sequence
  source: /note="Description of Artificial Sequence: Synthetic peptide"
MPEAAPPWPL

SEQ ID NO: 29415 - protein, 10 aa, Artificial Sequence
  source: /note="Description of Artificial Sequence: Synthetic peptide"
APPWPLHQQL

SEQ ID NO: 29416 - protein, 10 aa, Artificial Sequence
  source: /note="Description of Artificial Sequence: Synthetic peptide"
LPRKPTRAAT

SEQ ID NO: 29417 - protein, 10 aa, Artificial Sequence
  source: /note="Description of Artificial Sequence: Synthetic peptide"
KPTRAATVSV

SEQ ID NO: 29418 - protein, 10 aa, Artificial Sequence
  source: /note="Description of Artificial Sequence: Synthetic peptide"
HQQLLHRRPL

SEQ ID NO: 29419 - protein, 10 aa, Artificial Sequence
  source: /note="Description of Artificial Sequence: Synthetic peptide"
QQLLHRRPLH

SEQ ID NO: 29420 - protein, 10 aa, Artificial Sequence
  source: /note="Description of Artificial Sequence: Synthetic peptide"
HQPPPGPCHL

SEQ ID NO: 29421 - protein, 10 aa, Artificial Sequence
  source: /note="Description of Artificial Sequence: Synthetic peptide"
ASCILGQPSL

SEQ ID NO: 29422 - protein, 9 aa, Artificial Sequence
  source: /note="Description of Artificial Sequence: Synthetic peptide"
YQCSYGFRL

SEQ ID NO: 29423 - protein, 9 aa, Artificial Sequence
  source: /note="Description of Artificial Sequence: Synthetic peptide"
KTYQCSYGF

SEQ ID NO: 29424 - protein, 9 aa, Artificial Sequence
  source: /note="Description of Artificial Sequence: Synthetic peptide"
CSYGFRLGF

SEQ ID NO: 29425 - protein, 9 aa, Artificial Sequence
  source: /note="Description of Artificial Sequence: Synthetic peptide"
SQKTYQCSY

SEQ ID NO: 29426 - protein, 9 aa, Artificial Sequence
  source: /note="Description of Artificial Sequence: Synthetic peptide"
TYQCSYGFR

SEQ ID NO: 29427 - protein, 10 aa, Artificial Sequence
  source: /note="Description of Artificial Sequence: Synthetic peptide"
KTYQCSYGFR

SEQ ID NO: 29428 - protein, 10 aa, Artificial Sequence
  source: /note="Description of Artificial Sequence: Synthetic peptide"
TYQCSYGFRL

SEQ ID NO: 29429 - protein, 10 aa, Artificial Sequence
  source: /note="Description of Artificial Sequence: Synthetic peptide"
PSQKTYQCSY

SEQ ID NO: 29430 - protein, 10 aa, Artificial Sequence
  source: /note="Description of Artificial Sequence: Synthetic peptide"
QKTYQCSYGF

SEQ ID NO: 29431 - protein, 10 aa, Artificial Sequence
  source: /note="Description of Artificial Sequence: Synthetic peptide"
YQCSYGFRLG

SEQ ID NO: 29432 - protein, 10 aa, Artificial Sequence
  source: /note="Description of Artificial Sequence: Synthetic peptide"
CSYGFRLGFL

SEQ ID NO: 29433 - protein, 9 aa, Artificial Sequence
  source: /note="Description of Artificial Sequence: Synthetic peptide"
YVSVWASCI

SEQ ID NO: 29434 - protein, 9 aa, Artificial Sequence
  source: /note="Description of Artificial Sequence: Synthetic peptide"
TYQGSYVSV

SEQ ID NO: 29435 - protein, 9 aa, Artificial Sequence
  source: /note="Description of Artificial Sequence: Synthetic peptide"
YQGSYVSVW

SEQ ID NO: 29436 - protein, 9 aa, Artificial Sequence
  source: /note="Description of Artificial Sequence: Synthetic peptide"
SYVSVWASC

SEQ ID NO: 29437 - protein, 9 aa, Artificial Sequence
  source: /note="Description of Artificial Sequence: Synthetic peptide"
KTYQGSYVS

SEQ ID NO: 29438 - protein, 9 aa, Artificial Sequence
  source: /note="Description of Artificial Sequence: Synthetic peptide"
VSVWASCIL

SEQ ID NO: 29439 - protein, 10 aa, Artificial Sequence
  source: /note="Description of Artificial Sequence: Synthetic peptide"
KTYQGSYVSV

SEQ ID NO: 29440 - protein, 10 aa, Artificial Sequence
  source: /note="Description of Artificial Sequence: Synthetic peptide"
YQGSYVSVWA

SEQ ID NO: 29441 - protein, 10 aa, Artificial Sequence
  source: /note="Description of Artificial Sequence: Synthetic peptide"
SQKTYQGSYV

SEQ ID NO: 29442 - protein, 10 aa, Artificial Sequence
  source: /note="Description of Artificial Sequence: Synthetic peptide"
YVSVWASCIL

SEQ ID NO: 29443 - protein, 10 aa, Artificial Sequence
  source: /note="Description of Artificial Sequence: Synthetic peptide"
TYQGSYVSVW

SEQ ID NO: 29444 - protein, 10 aa, Artificial Sequence
  source: /note="Description of Artificial Sequence: Synthetic peptide"
SYVSVWASCI

SEQ ID NO: 29445 - protein, 10 aa, Artificial Sequence
  source: /note="Description of Artificial Sequence: Synthetic peptide"
ASCILGQPSL

SEQ ID NO: 29446 - protein, 9 aa, Artificial Sequence
  source: /note="Description of Artificial Sequence: Synthetic peptide"
TYQGSYGFV

SEQ ID NO: 29447 - protein, 9 aa, Artificial Sequence
  source: /note="Description of Artificial Sequence: Synthetic peptide"
YQGSYGFVW

SEQ ID NO: 29448 - protein, 9 aa, Artificial Sequence
  source: /note="Description of Artificial Sequence: Synthetic peptide"
SYGFVWASC

SEQ ID NO: 29449 - protein, 9 aa, Artificial Sequence
  source: /note="Description of Artificial Sequence: Synthetic peptide"
YGFVWASCI

SEQ ID NO: 29450 - protein, 10 aa, Artificial Sequence
  source: /note="Description of Artificial Sequence: Synthetic peptide"
KTYQGSYGFV

SEQ ID NO: 29451 - protein, 10 aa, Artificial Sequence
  source: /note="Description of Artificial Sequence: Synthetic peptide"
YQGSYGFVWA

SEQ ID NO: 29452 - protein, 10 aa, Artificial Sequence
  source: /note="Description of Artificial Sequence: Synthetic peptide"
TYQGSYGFVW

SEQ ID NO: 29453 - protein, 10 aa, Artificial Sequence
  source: /note="Description of Artificial Sequence: Synthetic peptide"
SYGFVWASCI

SEQ ID NO: 29454 - protein, 10 aa, Artificial Sequence
  source: /note="Description of Artificial Sequence: Synthetic peptide"
YGFVWASCIL

SEQ ID NO: 29455 - protein, 10 aa, Artificial Sequence
  source: /note="Description of Artificial Sequence: Synthetic peptide"
ASCILGQPSL

SEQ ID NO: 29456 - protein, 9 aa, Artificial Sequence
  source: /note="Description of Artificial Sequence: Synthetic peptide"
YQGSYGFLL

SEQ ID NO: 29457 - protein, 9 aa, Artificial Sequence
  source: /note="Description of Artificial Sequence: Synthetic peptide"
FLLGFLHSG

SEQ ID NO: 29458 - protein, 9 aa, Artificial Sequence
  source: /note="Description of Artificial Sequence: Synthetic peptide"
TYQGSYGFL

SEQ ID NO: 29459 - protein, 9 aa, Artificial Sequence
  source: /note="Description of Artificial Sequence: Synthetic peptide"
SYGFLLGFL

SEQ ID NO: 29460 - protein, 9 aa, Artificial Sequence
  source: /note="Description of Artificial Sequence: Synthetic peptide"
GSYGFLLGF

SEQ ID NO: 29461 - protein, 10 aa, Artificial Sequence
  source: /note="Description of Artificial Sequence: Synthetic peptide"
FLLGFLHSGT

SEQ ID NO: 29462 - protein, 10 aa, Artificial Sequence
  source: /note="Description of Artificial Sequence: Synthetic peptide"
KTYQGSYGFL

SEQ ID NO: 29463 - protein, 10 aa, Artificial Sequence
  source: /note="Description of Artificial Sequence: Synthetic peptide"
LLGFLHSGTA

SEQ ID NO: 29464 - protein, 10 aa, Artificial Sequence
  source: /note="Description of Artificial Sequence: Synthetic peptide"
TYQGSYGFLL

SEQ ID NO: 29465 - protein, 10 aa, Artificial Sequence
  source: /note="Description of Artificial Sequence: Synthetic peptide"
YQGSYGFLLG

SEQ ID NO: 29466 - protein, 10 aa, Artificial Sequence
  source: /note="Description of Artificial Sequence: Synthetic peptide"
QGSYGFLLGF

SEQ ID NO: 29467 - protein, 9 aa, Artificial Sequence
  source: /note="Description of Artificial Sequence: Synthetic peptide"
ALNNMFCQL

SEQ ID NO: 29468 - protein, 9 aa, Artificial Sequence
  source: /note="Description of Artificial Sequence: Synthetic peptide"
NMFCQLAKT

SEQ ID NO: 29469 - protein, 9 aa, Artificial Sequence
  source: /note="Description of Artificial Sequence: Synthetic peptide"
TYSPALNNM

SEQ ID NO: 29470 - protein, 9 aa, Artificial Sequence
  source: /note="Description of Artificial Sequence: Synthetic peptide"
YSPALNNMF

SEQ ID NO: 29471 - protein, 10 aa, Artificial Sequence
  source: /note="Description of Artificial Sequence: Synthetic peptide"
ALNNMFCQLA

SEQ ID NO: 29472 - protein, 10 aa, Artificial Sequence
  source: /note="Description of Artificial Sequence: Synthetic peptide"
TYSPALNNMF

SEQ ID NO: 29473 - protein, 10 aa, Artificial Sequence
  source: /note="Description of Artificial Sequence: Synthetic peptide"
CTYSPALNNM

SEQ ID NO: 29474 - protein, 9 aa, Artificial Sequence
  source: /note="Description of Artificial Sequence: Synthetic peptide"
ALNNMFCQL

SEQ ID NO: 29475 - protein, 9 aa, Artificial Sequence
  source: /note="Description of Artificial Sequence: Synthetic peptide"
NMFCQLAKT

SEQ ID NO: 29476 - protein, 9 aa, Artificial Sequence
  source: /note="Description of Artificial Sequence: Synthetic peptide"
TYSPALNNM

SEQ ID NO: 29477 - protein, 9 aa, Artificial Sequence
  source: /note="Description of Artificial Sequence: Synthetic peptide"
YSPALNNMF

SEQ ID NO: 29478 - protein, 10 aa, Artificial Sequence
  source: /note="Description of Artificial Sequence: Synthetic peptide"
ALNNMFCQLA

SEQ ID NO: 29479 - protein, 10 aa, Artificial Sequence
  source: /note="Description of Artificial Sequence: Synthetic peptide"
TYSPALNNMF

SEQ ID NO: 29480 - protein, 10 aa, Artificial Sequence
  source: /note="Description of Artificial Sequence: Synthetic peptide"
CTYSPALNNM

SEQ ID NO: 29481 - protein, 9 aa, Artificial Sequence
  source: /note="Description of Artificial Sequence: Synthetic peptide"
CQLAKTGPV

SEQ ID NO: 29482 - protein, 9 aa, Artificial Sequence
  source: /note="Description of Artificial Sequence: Synthetic peptide"
KTGPVQLWV

SEQ ID NO: 29483 - protein, 9 aa, Artificial Sequence
  source: /note="Description of Artificial Sequence: Synthetic peptide"
AKTGPVQLW

SEQ ID NO: 29484 - protein, 10 aa, Artificial Sequence
  source: /note="Description of Artificial Sequence: Synthetic peptide"
QLAKTGPVQL

SEQ ID NO: 29485 - protein, 10 aa, Artificial Sequence
  source: /note="Description of Artificial Sequence: Synthetic peptide"
KMFCQLAKTG

SEQ ID NO: 29486 - protein, 10 aa, Artificial Sequence
  source: /note="Description of Artificial Sequence: Synthetic peptide"
LAKTGPVQLW

SEQ ID NO: 29487 - protein, 9 aa, Artificial Sequence
  source: /note="Description of Artificial Sequence: Synthetic peptide"
CQLAKTYPV

SEQ ID NO: 29488 - protein, 9 aa, Artificial Sequence
  source: /note="Description of Artificial Sequence: Synthetic peptide"
KTYPVQLWV

SEQ ID NO: 29489 - protein, 9 aa, Artificial Sequence
  source: /note="Description of Artificial Sequence: Synthetic peptide"
MFCQLAKTY

SEQ ID NO: 29490 - protein, 9 aa, Artificial Sequence
  source: /note="Description of Artificial Sequence: Synthetic peptide"
LAKTYPVQL

SEQ ID NO: 29491 - protein, 9 aa, Artificial Sequence
  source: /note="Description of Artificial Sequence: Synthetic peptide"
AKTYPVQLW

SEQ ID NO: 29492 - protein, 10 aa, Artificial Sequence
  source: /note="Description of Artificial Sequence: Synthetic peptide"
QLAKTYPVQL

SEQ ID NO: 29493 - protein, 10 aa, Artificial Sequence
  source: /note="Description of Artificial Sequence: Synthetic peptide"
KMFCQLAKTY

SEQ ID NO: 29494 - protein, 10 aa, Artificial Sequence
  source: /note="Description of Artificial Sequence: Synthetic peptide"
LAKTYPVQLW

SEQ ID NO: 29495 - protein, 10 aa, Artificial Sequence
  source: /note="Description of Artificial Sequence: Synthetic peptide"
YPVQLWVDST

SEQ ID NO: 29496 - protein, 9 aa, Artificial Sequence
  source: /note="Description of Artificial Sequence: Synthetic peptide"
KTCPMQLWV

SEQ ID NO: 29497 - protein, 9 aa, Artificial Sequence
  source: /note="Description of Artificial Sequence: Synthetic peptide"
CQLAKTCPM

SEQ ID NO: 29498 - protein, 9 aa, Artificial Sequence
  source: /note="Description of Artificial Sequence: Synthetic peptide"
AKTCPMQLW

SEQ ID NO: 29499 - protein, 9 aa, Artificial Sequence
  source: /note="Description of Artificial Sequence: Synthetic peptide"
MQLWVDSTP

SEQ ID NO: 29500 - protein, 10 aa, Artificial Sequence
  source: /note="Description of Artificial Sequence: Synthetic peptide"
QLAKTCPMQL

SEQ ID NO: 29501 - protein, 10 aa, Artificial Sequence
  source: /note="Description of Artificial Sequence: Synthetic peptide"
FCQLAKTCPM

SEQ ID NO: 29502 - protein, 10 aa, Artificial Sequence
  source: /note="Description of Artificial Sequence: Synthetic peptide"
LAKTCPMQLW

SEQ ID NO: 29503 - protein, 10 aa, Artificial Sequence
  source: /note="Description of Artificial Sequence: Synthetic peptide"
MQLWVDSTPP

SEQ ID NO: 29504 - protein, 10 aa, Artificial Sequence
  source: /note="Description of Artificial Sequence: Synthetic peptide"
CPMQLWVDST

SEQ ID NO: 29505 - protein, 9 aa, Artificial Sequence
  source: /note="Description of Artificial Sequence: Synthetic peptide"
STTPPGTRV

SEQ ID NO: 29506 - protein, 9 aa, Artificial Sequence
  source: /note="Description of Artificial Sequence: Synthetic peptide"
VQLWVDSTT

SEQ ID NO: 29507 - protein, 10 aa, Artificial Sequence
  source: /note="Description of Artificial Sequence: Synthetic peptide"
STTPPGTRVR

SEQ ID NO: 29508 - protein, 10 aa, Artificial Sequence
  source: /note="Description of Artificial Sequence: Synthetic peptide"
TPPGTRVRAM

SEQ ID NO: 29509 - protein, 10 aa, Artificial Sequence
  source: /note="Description of Artificial Sequence: Synthetic peptide"
VQLWVDSTTP

SEQ ID NO: 29510 - protein, 9 aa, Artificial Sequence
  source: /note="Description of Artificial Sequence: Synthetic peptide"
QLWVDSTPR

SEQ ID NO: 29511 - protein, 9 aa, Artificial Sequence
  source: /note="Description of Artificial Sequence: Synthetic peptide"
TPRPAPASA

SEQ ID NO: 29512 - protein, 9 aa, Artificial Sequence
  source: /note="Description of Artificial Sequence: Synthetic peptide"
RPAPASAPW

SEQ ID NO: 29513 - protein, 9 aa, Artificial Sequence
  source: /note="Description of Artificial Sequence: Synthetic peptide"
APWPSTSSH

SEQ ID NO: 29514 - protein, 9 aa, Artificial Sequence
  source: /note="Description of Artificial Sequence: Synthetic peptide"
WPSTSSHST

SEQ ID NO: 29515 - protein, 10 aa, Artificial Sequence
  source: /note="Description of Artificial Sequence: Synthetic peptide"
STPRPAPASA

SEQ ID NO: 29516 - protein, 10 aa, Artificial Sequence
  source: /note="Description of Artificial Sequence: Synthetic peptide"
TPRPAPASAP

SEQ ID NO: 29517 - protein, 10 aa, Artificial Sequence
  source: /note="Description of Artificial Sequence: Synthetic peptide"
APASAPWPST

SEQ ID NO: 29518 - protein, 9 aa, Artificial Sequence
  source: /note="Description of Artificial Sequence: Synthetic peptide"
WVDSTPPPV

SEQ ID NO: 29519 - protein, 9 aa, Artificial Sequence
  source: /note="Description of Artificial Sequence: Synthetic peptide"
VTRVRAMAI

SEQ ID NO: 29520 - protein, 9 aa, Artificial Sequence
  source: /note="Description of Artificial Sequence: Synthetic peptide"
DSTPPPVTR

SEQ ID NO: 29521 - protein, 9 aa, Artificial Sequence
  source: /note="Description of Artificial Sequence: Synthetic peptide"
STPPPVTRV

SEQ ID NO: 29522 - protein, 9 aa, Artificial Sequence
  source: /note="Description of Artificial Sequence: Synthetic peptide"
PPVTRVRAM

SEQ ID NO: 29523 - protein, 10 aa, Artificial Sequence
  source: /note="Description of Artificial Sequence: Synthetic peptide"
VTRVRAMAIY

SEQ ID NO: 29524 - protein, 10 aa, Artificial Sequence
  source: /note="Description of Artificial Sequence: Synthetic peptide"
DSTPPPVTRV

SEQ ID NO: 29525 - protein, 10 aa, Artificial Sequence
  source: /note="Description of Artificial Sequence: Synthetic peptide"
LWVDSTPPPV

SEQ ID NO: 29526 - protein, 9 aa, Artificial Sequence
  source: /note="Description of Artificial Sequence: Synthetic peptide"
STPPPGNRV

SEQ ID NO: 29527 - protein, 9 aa, Artificial Sequence
  source: /note="Description of Artificial Sequence: Synthetic peptide"
PPGNRVRAM

SEQ ID NO: 29528 - protein, 9 aa, Artificial Sequence
  source: /note="Description of Artificial Sequence: Synthetic peptide"
GNRVRAMAI

SEQ ID NO: 29529 - protein, 9 aa, Artificial Sequence
  source: /note="Description of Artificial Sequence: Synthetic peptide"
NRVRAMAIY

SEQ ID NO: 29530 - protein, 10 aa, Artificial Sequence
  source: /note="Description of Artificial Sequence: Synthetic peptide"
GNRVRAMAIY

SEQ ID NO: 29531 - protein, 10 aa, Artificial Sequence
  source: /note="Description of Artificial Sequence: Synthetic peptide"
DSTPPPGNRV

SEQ ID NO: 29532 - protein, 9 aa, Artificial Sequence
  source: /note="Description of Artificial Sequence: Synthetic peptide"
RFRAMAIYK

SEQ ID NO: 29533 - protein, 9 aa, Artificial Sequence
  source: /note="Description of Artificial Sequence: Synthetic peptide"
GTRFRAMAI

SEQ ID NO: 29534 - protein, 9 aa, Artificial Sequence
  source: /note="Description of Artificial Sequence: Synthetic peptide"
TRFRAMAIY

SEQ ID NO: 29535 - protein, 9 aa, Artificial Sequence
  source: /note="Description of Artificial Sequence: Synthetic peptide"
PPGTRFRAM

SEQ ID NO: 29536 - protein, 10 aa, Artificial Sequence
  source: /note="Description of Artificial Sequence: Synthetic peptide"
TRFRAMAIYK

SEQ ID NO: 29537 - protein, 10 aa, Artificial Sequence
  source: /note="Description of Artificial Sequence: Synthetic peptide"
GTRFRAMAIY

SEQ ID NO: 29538 - protein, 10 aa, Artificial Sequence
  source: /note="Description of Artificial Sequence: Synthetic peptide"
RFRAMAIYKQ

SEQ ID NO: 29539 - protein, 10 aa, Artificial Sequence
  source: /note="Description of Artificial Sequence: Synthetic peptide"
STPPPGTRFR

SEQ ID NO: 29540 - protein, 9 aa, Artificial Sequence
  source: /note="Description of Artificial Sequence: Synthetic peptide"
RVHAMAIYK

SEQ ID NO: 29541 - protein, 9 aa, Artificial Sequence
  source: /note="Description of Artificial Sequence: Synthetic peptide"
GTRVHAMAI

SEQ ID NO: 29542 - protein, 9 aa, Artificial Sequence
  source: /note="Description of Artificial Sequence: Synthetic peptide"
PPGTRVHAM

SEQ ID NO: 29543 - protein, 9 aa, Artificial Sequence
  source: /note="Description of Artificial Sequence: Synthetic peptide"
TRVHAMAIY

SEQ ID NO: 29544 - protein, 10 aa, Artificial Sequence
  source: /note="Description of Artificial Sequence: Synthetic peptide"
GTRVHAMAIY

SEQ ID NO: 29545 - protein, 9 aa, Artificial Sequence
  source: /note="Description of Artificial Sequence: Synthetic peptide"
RVLAMAIYK

SEQ ID NO: 29546 - protein, 9 aa, Artificial Sequence
  source: /note="Description of Artificial Sequence: Synthetic peptide"
GTRVLAMAI

SEQ ID NO: 29547 - protein, 9 aa, Artificial Sequence
  source: /note="Description of Artificial Sequence: Synthetic peptide"
TPPPGTRVL

SEQ ID NO: 29548 - protein, 9 aa, Artificial Sequence
  source: /note="Description of Artificial Sequence: Synthetic peptide"
PPGTRVLAM

SEQ ID NO: 29549 - protein, 9 aa, Artificial Sequence
  source: /note="Description of Artificial Sequence: Synthetic peptide"
TRVLAMAIY

SEQ ID NO: 29550 - protein, 10 aa, Artificial Sequence
  source: /note="Description of Artificial Sequence: Synthetic peptide"
GTRVLAMAIY

SEQ ID NO: 29551 - protein, 9 aa, Artificial Sequence
  source: /note="Description of Artificial Sequence: Synthetic peptide"
RVRPMAIYK

SEQ ID NO: 29552 - protein, 9 aa, Artificial Sequence
  source: /note="Description of Artificial Sequence: Synthetic peptide"
GTRVRPMAI

SEQ ID NO: 29553 - protein, 9 aa, Artificial Sequence
  source: /note="Description of Artificial Sequence: Synthetic peptide"
PPGTRVRPM

SEQ ID NO: 29554 - protein, 9 aa, Artificial Sequence
  source: /note="Description of Artificial Sequence: Synthetic peptide"
TRVRPMAIY

SEQ ID NO: 29555 - protein, 10 aa, Artificial Sequence
  source: /note="Description of Artificial Sequence: Synthetic peptide"
GTRVRPMAIY

SEQ ID NO: 29556 - protein, 10 aa, Artificial Sequence
  source: /note="Description of Artificial Sequence: Synthetic peptide"
RVRPMAIYKQ

SEQ ID NO: 29557 - protein, 9 aa, Artificial Sequence
  source: /note="Description of Artificial Sequence: Synthetic peptide"
RVRVMAIYK

SEQ ID NO: 29558 - protein, 9 aa, Artificial Sequence
  source: /note="Description of Artificial Sequence: Synthetic peptide"
GTRVRVMAI

SEQ ID NO: 29559 - protein, 9 aa, Artificial Sequence
  source: /note="Description of Artificial Sequence: Synthetic peptide"
RVMAIYKQS

SEQ ID NO: 29560 - protein, 9 aa, Artificial Sequence
  source: /note="Description of Artificial Sequence: Synthetic peptide"
TRVRVMAIY

SEQ ID NO: 29561 - protein, 10 aa, Artificial Sequence
  source: /note="Description of Artificial Sequence: Synthetic peptide"
GTRVRVMAIY

SEQ ID NO: 29562 - protein, 10 aa, Artificial Sequence
  source: /note="Description of Artificial Sequence: Synthetic peptide"
RVRVMAIYKQ

SEQ ID NO: 29563 - protein, 10 aa, Artificial Sequence
  source: /note="Description of Artificial Sequence: Synthetic peptide"
VMAIYKQSQH

SEQ ID NO: 29564 - protein, 9 aa, Artificial Sequence
  source: /note="Description of Artificial Sequence: Synthetic peptide"
RVRAMAICK

SEQ ID NO: 29565 - protein, 9 aa, Artificial Sequence
  source: /note="Description of Artificial Sequence: Synthetic peptide"
AICKQSQHM

SEQ ID NO: 29566 - protein, 10 aa, Artificial Sequence
  source: /note="Description of Artificial Sequence: Synthetic peptide"
GTRVRAMAIC

SEQ ID NO: 29567 - protein, 10 aa, Artificial Sequence
  source: /note="Description of Artificial Sequence: Synthetic peptide"
RVRAMAICKQ

SEQ ID NO: 29568 - protein, 10 aa, Artificial Sequence
  source: /note="Description of Artificial Sequence: Synthetic peptide"
MAICKQSQHM

SEQ ID NO: 29569 - protein, 9 aa, Artificial Sequence
  source: /note="Description of Artificial Sequence: Synthetic peptide"
MRRCPHHER

SEQ ID NO: 29570 - protein, 9 aa, Artificial Sequence
  source: /note="Description of Artificial Sequence: Synthetic peptide"
QSQHMTEVM

SEQ ID NO: 29571 - protein, 10 aa, Artificial Sequence
  source: /note="Description of Artificial Sequence: Synthetic peptide"
VMRRCPHHER

SEQ ID NO: 29572 - protein, 10 aa, Artificial Sequence
  source: /note="Description of Artificial Sequence: Synthetic peptide"
KQSQHMTEVM

SEQ ID NO: 29573 - protein, 10 aa, Artificial Sequence
  source: /note="Description of Artificial Sequence: Synthetic peptide"
VLRRCPHHER

SEQ ID NO: 29574 - protein, 10 aa, Artificial Sequence
  source: /note="Description of Artificial Sequence: Synthetic peptide"
QSQHMTEVLR

SEQ ID NO: 29575 - protein, 10 aa, Artificial Sequence
  source: /note="Description of Artificial Sequence: Synthetic peptide"
KQSQHMTEVL

SEQ ID NO: 29576 - protein, 9 aa, Artificial Sequence
  source: /note="Description of Artificial Sequence: Synthetic peptide"
TEVVRGCPH

SEQ ID NO: 29577 - protein, 10 aa, Artificial Sequence
  source: /note="Description of Artificial Sequence: Synthetic peptide"
VVRGCPHHER

SEQ ID NO: 29578 - protein, 9 aa, Artificial Sequence
  source: /note="Description of Artificial Sequence: Synthetic peptide"
TEVVRCCPH

SEQ ID NO: 29579 - protein, 10 aa, Artificial Sequence
  source: /note="Description of Artificial Sequence: Synthetic peptide"
VVRCCPHHER

SEQ ID NO: 29580 - protein, 9 aa, Artificial Sequence
  source: /note="Description of Artificial Sequence: Synthetic peptide"
TEVVRHCPH

SEQ ID NO: 29581 - protein, 10 aa, Artificial Sequence
  source: /note="Description of Artificial Sequence: Synthetic peptide"
VVRHCPHHER

SEQ ID NO: 29582 - protein, 10 aa, Artificial Sequence
  source: /note="Description of Artificial Sequence: Synthetic peptide"
SQHMTEVVRH

SEQ ID NO: 29583 - protein, 9 aa, Artificial Sequence
  source: /note="Description of Artificial Sequence: Synthetic peptide"
HMTEVVRRY

SEQ ID NO: 29584 - protein, 9 aa, Artificial Sequence
  source: /note="Description of Artificial Sequence: Synthetic peptide"
TEVVRRYPH

SEQ ID NO: 29585 - protein, 10 aa, Artificial Sequence
  source: /note="Description of Artificial Sequence: Synthetic peptide"
VVRRYPHHER

SEQ ID NO: 29586 - protein, 10 aa, Artificial Sequence
  source: /note="Description of Artificial Sequence: Synthetic peptide"
QHMTEVVRRY

SEQ ID NO: 29587 - protein, 9 aa, Artificial Sequence
  source: /note="Description of Artificial Sequence: Synthetic peptide"
HMTEVVRRF

SEQ ID NO: 29588 - protein, 9 aa, Artificial Sequence
  source: /note="Description of Artificial Sequence: Synthetic peptide"
TEVVRRFPH

SEQ ID NO: 29589 - protein, 10 aa, Artificial Sequence
  source: /note="Description of Artificial Sequence: Synthetic peptide"
VVRRFPHHER

SEQ ID NO: 29590 - protein, 10 aa, Artificial Sequence
  source: /note="Description of Artificial Sequence: Synthetic peptide"
QHMTEVVRRF

SEQ ID NO: 29591 - protein, 9 aa, Artificial Sequence
  source: /note="Description of Artificial Sequence: Synthetic peptide"
VVRRCPHYE

SEQ ID NO: 29592 - protein, 9 aa, Artificial Sequence
  source: /note="Description of Artificial Sequence: Synthetic peptide"
EVVRRCPHY

SEQ ID NO: 29593 - protein, 10 aa, Artificial Sequence
  source: /note="Description of Artificial Sequence: Synthetic peptide"
VVRRCPHYER

SEQ ID NO: 29594 - protein, 10 aa, Artificial Sequence
  source: /note="Description of Artificial Sequence: Synthetic peptide"
TEVVRRCPHY

SEQ ID NO: 29595 - protein, 10 aa, Artificial Sequence
  source: /note="Description of Artificial Sequence: Synthetic peptide"
YERCSDSDGL

SEQ ID NO: 29596 - protein, 9 aa, Artificial Sequence
  source: /note="Description of Artificial Sequence: Synthetic peptide"
EVVRRCPHR

SEQ ID NO: 29597 - protein, 10 aa, Artificial Sequence
  source: /note="Description of Artificial Sequence: Synthetic peptide"
VVRRCPHRER

SEQ ID NO: 29598 - protein, 10 aa, Artificial Sequence
  source: /note="Description of Artificial Sequence: Synthetic peptide"
RERCSDSDGL

SEQ ID NO: 29599 - protein, 9 aa, Artificial Sequence
  source: /note="Description of Artificial Sequence: Synthetic peptide"
EVVRRCPHL

SEQ ID NO: 29600 - protein, 10 aa, Artificial Sequence
  source: /note="Description of Artificial Sequence: Synthetic peptide"
VVRRCPHLER

SEQ ID NO: 29601 - protein, 10 aa, Artificial Sequence
  source: /note="Description of Artificial Sequence: Synthetic peptide"
TEVVRRCPHL

SEQ ID NO: 29602 - protein, 10 aa, Artificial Sequence
  source: /note="Description of Artificial Sequence: Synthetic peptide"
LERCSDSDGL

SEQ ID NO: 29603 - protein, 9 aa, Artificial Sequence
  source: /note="Description of Artificial Sequence: Synthetic peptide"
GLAPQHLIR

SEQ ID NO: 29604 - protein, 10 aa, Artificial Sequence
  source: /note="Description of Artificial Sequence: Synthetic peptide"
GLAPQHLIRV

SEQ ID NO: 29605 - protein, 9 aa, Artificial Sequence
  source: /note="Description of Artificial Sequence: Synthetic peptide"
GLAPPQYLI

SEQ ID NO: 29606 - protein, 9 aa, Artificial Sequence
  source: /note="Description of Artificial Sequence: Synthetic peptide"
YLIRVEGNL

SEQ ID NO: 29607 - protein, 10 aa, Artificial Sequence
  source: /note="Description of Artificial Sequence: Synthetic peptide"
DSDGLAPPQY

SEQ ID NO: 29608 - protein, 10 aa, Artificial Sequence
  source: /note="Description of Artificial Sequence: Synthetic peptide"
GLAPPQYLIR

SEQ ID NO: 29609 - protein, 10 aa, Artificial Sequence
  source: /note="Description of Artificial Sequence: Synthetic peptide"
QYLIRVEGNL

SEQ ID NO: 29610 - protein, 10 aa, Artificial Sequence
  source: /note="Description of Artificial Sequence: Synthetic peptide"
YLIRVEGNLR

SEQ ID NO: 29611 - protein, 9 aa, Artificial Sequence
  source: /note="Description of Artificial Sequence: Synthetic peptide"
GLAPPQRLI

SEQ ID NO: 29612 - protein, 9 aa, Artificial Sequence
  source: /note="Description of Artificial Sequence: Synthetic peptide"
RLIRVEGNL

SEQ ID NO: 29613 - protein, 10 aa, Artificial Sequence
  source: /note="Description of Artificial Sequence: Synthetic peptide"
RLIRVEGNLR

SEQ ID NO: 29614 - protein, 9 aa, Artificial Sequence
  source: /note="Description of Artificial Sequence: Synthetic peptide"
GLAPPQLLI

SEQ ID NO: 29615 - protein, 9 aa, Artificial Sequence
  source: /note="Description of Artificial Sequence: Synthetic peptide"
LLIRVEGNL

SEQ ID NO: 29616 - protein, 10 aa, Artificial Sequence
  source: /note="Description of Artificial Sequence: Synthetic peptide"
GLAPPQLLIR

SEQ ID NO: 29617 - protein, 10 aa, Artificial Sequence
  source: /note="Description of Artificial Sequence: Synthetic peptide"
LLIRVEGNLR

SEQ ID NO: 29618 - protein, 9 aa, Artificial Sequence
  source: /note="Description of Artificial Sequence: Synthetic peptide"
GLAPPQHRI

SEQ ID NO: 29619 - protein, 9 aa, Artificial Sequence
  source: /note="Description of Artificial Sequence: Synthetic peptide"
RIRVEGNLR

SEQ ID NO: 29620 - protein, 9 aa, Artificial Sequence
  source: /note="Description of Artificial Sequence: Synthetic peptide"
APPQHRIRV

SEQ ID NO: 29621 - protein, 10 aa, Artificial Sequence
  source: /note="Description of Artificial Sequence: Synthetic peptide"
RIRVEGNLRV

SEQ ID NO: 29622 - protein, 9 aa, Artificial Sequence
  source: /note="Description of Artificial Sequence: Synthetic peptide"
GLAPPQHLT

SEQ ID NO: 29623 - protein, 9 aa, Artificial Sequence
  source: /note="Description of Artificial Sequence: Synthetic peptide"
LTRVEGNLR

SEQ ID NO: 29624 - protein, 10 aa, Artificial Sequence
  source: /note="Description of Artificial Sequence: Synthetic peptide"
GLAPPQHLTR

SEQ ID NO: 29625 - protein, 10 aa, Artificial Sequence
  source: /note="Description of Artificial Sequence: Synthetic peptide"
LTRVEGNLRV

SEQ ID NO: 29626 - protein, 10 aa, Artificial Sequence
  source: /note="Description of Artificial Sequence: Synthetic peptide"
HLTRVEGNLR

SEQ ID NO: 29627 - protein, 9 aa, Artificial Sequence
  source: /note="Description of Artificial Sequence: Synthetic peptide"
HLIPVEGNL

SEQ ID NO: 29628 - protein, 9 aa, Artificial Sequence
  source: /note="Description of Artificial Sequence: Synthetic peptide"
APPQHLIPV

SEQ ID NO: 29629 - protein, 9 aa, Artificial Sequence
  source: /note="Description of Artificial Sequence: Synthetic peptide"
IPVEGNLRV

SEQ ID NO: 29630 - protein, 10 aa, Artificial Sequence
  source: /note="Description of Artificial Sequence: Synthetic peptide"
HLIPVEGNLR

SEQ ID NO: 29631 - protein, 10 aa, Artificial Sequence
  source: /note="Description of Artificial Sequence: Synthetic peptide"
LAPPQHLIPV

SEQ ID NO: 29632 - protein, 9 aa, Artificial Sequence
  source: /note="Description of Artificial Sequence: Synthetic peptide"
HLIRVEVNL

SEQ ID NO: 29633 - protein, 9 aa, Artificial Sequence
  source: /note="Description of Artificial Sequence: Synthetic peptide"
LIRVEVNLR

SEQ ID NO: 29634 - protein, 9 aa, Artificial Sequence
  source: /note="Description of Artificial Sequence: Synthetic peptide"
EVNLRVEYL

SEQ ID NO: 29635 - protein, 9 aa, Artificial Sequence
  source: /note="Description of Artificial Sequence: Synthetic peptide"
VEVNLRVEY

SEQ ID NO: 29636 - protein, 10 aa, Artificial Sequence
  source: /note="Description of Artificial Sequence: Synthetic peptide"
LIRVEVNLRV

SEQ ID NO: 29637 - protein, 10 aa, Artificial Sequence
  source: /note="Description of Artificial Sequence: Synthetic peptide"
RVEVNLRVEY

SEQ ID NO: 29638 - protein, 10 aa, Artificial Sequence
  source: /note="Description of Artificial Sequence: Synthetic peptide"
HLIRVEVNLR

SEQ ID NO: 29639 - protein, 10 aa, Artificial Sequence
  source: /note="Description of Artificial Sequence: Synthetic peptide"
VEVNLRVEYL

SEQ ID NO: 29640 - protein, 9 aa, Artificial Sequence
  source: /note="Description of Artificial Sequence: Synthetic peptide"
CLDDRNTFR

SEQ ID NO: 29641 - protein, 10 aa, Artificial Sequence
  source: /note="Description of Artificial Sequence: Synthetic peptide"
ECLDDRNTFR

SEQ ID NO: 29642 - protein, 10 aa, Artificial Sequence
  source: /note="Description of Artificial Sequence: Synthetic peptide"
VECLDDRNTF

SEQ ID NO: 29643 - protein, 10 aa, Artificial Sequence
  source: /note="Description of Artificial Sequence: Synthetic peptide"
VEGNLRVECL

SEQ ID NO: 29644 - protein, 9 aa, Artificial Sequence
  source: /note="Description of Artificial Sequence: Synthetic peptide"
YLDDKHFST

SEQ ID NO: 29645 - protein, 9 aa, Artificial Sequence
  source: /note="Description of Artificial Sequence: Synthetic peptide"
VEYLDDKHF

SEQ ID NO: 29646 - protein, 10 aa, Artificial Sequence
  source: /note="Description of Artificial Sequence: Synthetic peptide"
RVEYLDDKHF

SEQ ID NO: 29647 - protein, 9 aa, Artificial Sequence
  source: /note="Description of Artificial Sequence: Synthetic peptide"
NTFRRSVVV

SEQ ID NO: 29648 - protein, 9 aa, Artificial Sequence
  source: /note="Description of Artificial Sequence: Synthetic peptide"
FRRSVVVPY

SEQ ID NO: 29649 - protein, 10 aa, Artificial Sequence
  source: /note="Description of Artificial Sequence: Synthetic peptide"
TFRRSVVVPY

SEQ ID NO: 29650 - protein, 10 aa, Artificial Sequence
  source: /note="Description of Artificial Sequence: Synthetic peptide"
YLDDRNTFRR

SEQ ID NO: 29651 - protein, 9 aa, Artificial Sequence
  source: /note="Description of Artificial Sequence: Synthetic peptide"
NTFRHIVVV

SEQ ID NO: 29652 - protein, 9 aa, Artificial Sequence
  source: /note="Description of Artificial Sequence: Synthetic peptide"
RNTFRHIVV

SEQ ID NO: 29653 - protein, 9 aa, Artificial Sequence
  source: /note="Description of Artificial Sequence: Synthetic peptide"
FRHIVVVPY

SEQ ID NO: 29654 - protein, 10 aa, Artificial Sequence
  source: /note="Description of Artificial Sequence: Synthetic peptide"
TFRHIVVVPY

SEQ ID NO: 29655 - protein, 9 aa, Artificial Sequence
  source: /note="Description of Artificial Sequence: Synthetic peptide"
NTFRHRVVV

SEQ ID NO: 29656 - protein, 9 aa, Artificial Sequence
  source: /note="Description of Artificial Sequence: Synthetic peptide"
RHRVVVPYE

SEQ ID NO: 29657 - protein, 9 aa, Artificial Sequence
  source: /note="Description of Artificial Sequence: Synthetic peptide"
FRHRVVVPY

SEQ ID NO: 29658 - protein, 10 aa, Artificial Sequence
  source: /note="Description of Artificial Sequence: Synthetic peptide"
TFRHRVVVPY

SEQ ID NO: 29659 - protein, 9 aa, Artificial Sequence
  source: /note="Description of Artificial Sequence: Synthetic peptide"
NTFRHSMVV

SEQ ID NO: 29660 - protein, 9 aa, Artificial Sequence
  source: /note="Description of Artificial Sequence: Synthetic peptide"
DRNTFRHSM

SEQ ID NO: 29661 - protein, 9 aa, Artificial Sequence
  source: /note="Description of Artificial Sequence: Synthetic peptide"
FRHSMVVPY

SEQ ID NO: 29662 - protein, 10 aa, Artificial Sequence
  source: /note="Description of Artificial Sequence: Synthetic peptide"
MVVPYEPPEV

SEQ ID NO: 29663 - protein, 10 aa, Artificial Sequence
  source: /note="Description of Artificial Sequence: Synthetic peptide"
TFRHSMVVPY

SEQ ID NO: 29664 - protein, 9 aa, Artificial Sequence
  source: /note="Description of Artificial Sequence: Synthetic peptide"
VVPSEPPEV

SEQ ID NO: 29665 - protein, 10 aa, Artificial Sequence
  source: /note="Description of Artificial Sequence: Synthetic peptide"
VVVPSEPPEV

SEQ ID NO: 29666 - protein, 9 aa, Artificial Sequence
  source: /note="Description of Artificial Sequence: Synthetic peptide"
VVPCEPPEV

SEQ ID NO: 29667 - protein, 10 aa, Artificial Sequence
  source: /note="Description of Artificial Sequence: Synthetic peptide"
VVVPCEPPEV

SEQ ID NO: 29668 - protein, 9 aa, Artificial Sequence
  source: /note="Description of Artificial Sequence: Synthetic peptide"
CTTIHCNYM

SEQ ID NO: 29669 - protein, 9 aa, Artificial Sequence
  source: /note="Description of Artificial Sequence: Synthetic peptide"
TTIHCNYMC

SEQ ID NO: 29670 - protein, 10 aa, Artificial Sequence
  source: /note="Description of Artificial Sequence: Synthetic peptide"
CNYMCNSSCM

SEQ ID NO: 29671 - protein, 9 aa, Artificial Sequence
  source: /note="Description of Artificial Sequence: Synthetic peptide"
NDMCNSSCM

SEQ ID NO: 29672 - protein, 10 aa, Artificial Sequence
  source: /note="Description of Artificial Sequence: Synthetic peptide"
YNCMCNSSCM

SEQ ID NO: 29673 - protein, 9 aa, Artificial Sequence
  source: /note="Description of Artificial Sequence: Synthetic peptide"
CTTIHYNYI

SEQ ID NO: 29674 - protein, 10 aa, Artificial Sequence
  source: /note="Description of Artificial Sequence: Synthetic peptide"
YNYICNSSCM

SEQ ID NO: 29675 - protein, 9 aa, Artificial Sequence
  source: /note="Description of Artificial Sequence: Synthetic peptide"
CTTIHYNYI

SEQ ID NO: 29676 - protein, 10 aa, Artificial Sequence
  source: /note="Description of Artificial Sequence: Synthetic peptide"
YNYICNSSCM

SEQ ID NO: 29677 - protein, 9 aa, Artificial Sequence
  source: /note="Description of Artificial Sequence: Synthetic peptide"
TTIHYNYMY

SEQ ID NO: 29678 - protein, 9 aa, Artificial Sequence
  source: /note="Description of Artificial Sequence: Synthetic peptide"
YMYNSSCMG

SEQ ID NO: 29679 - protein, 9 aa, Artificial Sequence
  source: /note="Description of Artificial Sequence: Synthetic peptide"
YNYMYNSSC

SEQ ID NO: 29680 - protein, 10 aa, Artificial Sequence
  source: /note="Description of Artificial Sequence: Synthetic peptide"
CTTIHYNYMY

SEQ ID NO: 29681 - protein, 10 aa, Artificial Sequence
  source: /note="Description of Artificial Sequence: Synthetic peptide"
YMYNSSCMGG

SEQ ID NO: 29682 - protein, 10 aa, Artificial Sequence
  source: /note="Description of Artificial Sequence: Synthetic peptide"
YNYMYNSSCM

SEQ ID NO: 29683 - protein, 10 aa, Artificial Sequence
  source: /note="Description of Artificial Sequence: Synthetic peptide"
IHYNYMYNSS

SEQ ID NO: 29684 - protein, 10 aa, Artificial Sequence
  source: /note="Description of Artificial Sequence: Synthetic peptide"
MYNSSCMGGM

SEQ ID NO: 29685 - protein, 9 aa, Artificial Sequence
  source: /note="Description of Artificial Sequence: Synthetic peptide"
YMFNSSCMG

SEQ ID NO: 29686 - protein, 9 aa, Artificial Sequence
  source: /note="Description of Artificial Sequence: Synthetic peptide"
TTIHYNYMF

SEQ ID NO: 29687 - protein, 9 aa, Artificial Sequence
  source: /note="Description of Artificial Sequence: Synthetic peptide"
NYMFNSSCM

SEQ ID NO: 29688 - protein, 9 aa, Artificial Sequence
  source: /note="Description of Artificial Sequence: Synthetic peptide"
YNYMFNSSC

SEQ ID NO: 29689 - protein, 10 aa, Artificial Sequence
  source: /note="Description of Artificial Sequence: Synthetic peptide"
YMFNSSCMGG

SEQ ID NO: 29690 - protein, 10 aa, Artificial Sequence
  source: /note="Description of Artificial Sequence: Synthetic peptide"
CTTIHYNYMF

SEQ ID NO: 29691 - protein, 10 aa, Artificial Sequence
  source: /note="Description of Artificial Sequence: Synthetic peptide"
YNYMFNSSCM

SEQ ID NO: 29692 - protein, 10 aa, Artificial Sequence
  source: /note="Description of Artificial Sequence: Synthetic peptide"
IHYNYMFNSS

SEQ ID NO: 29693 - protein, 10 aa, Artificial Sequence
  source: /note="Description of Artificial Sequence: Synthetic peptide"
MFNSSCMGGM

SEQ ID NO: 29694 - protein, 9 aa, Artificial Sequence
  source: /note="Description of Artificial Sequence: Synthetic peptide"
NYMCNSYCM

SEQ ID NO: 29695 - protein, 9 aa, Artificial Sequence
  source: /note="Description of Artificial Sequence: Synthetic peptide"
HYNYMCNSY

SEQ ID NO: 29696 - protein, 9 aa, Artificial Sequence
  source: /note="Description of Artificial Sequence: Synthetic peptide"
SYCMGGMNR

SEQ ID NO: 29697 - protein, 10 aa, Artificial Sequence
  source: /note="Description of Artificial Sequence: Synthetic peptide"
NSYCMGGMNR

SEQ ID NO: 29698 - protein, 10 aa, Artificial Sequence
  source: /note="Description of Artificial Sequence: Synthetic peptide"
IHYNYMCNSY

SEQ ID NO: 29699 - protein, 10 aa, Artificial Sequence
  source: /note="Description of Artificial Sequence: Synthetic peptide"
SYCMGGMNRR

SEQ ID NO: 29700 - protein, 10 aa, Artificial Sequence
  source: /note="Description of Artificial Sequence: Synthetic peptide"
YNYMCNSYCM

SEQ ID NO: 29701 - protein, 10 aa, Artificial Sequence
  source: /note="Description of Artificial Sequence: Synthetic peptide"
MCNSYCMGGM

SEQ ID NO: 29702 - protein, 9 aa, Artificial Sequence
  source: /note="Description of Artificial Sequence: Synthetic peptide"
HYNYMCNSF

SEQ ID NO: 29703 - protein, 9 aa, Artificial Sequence
  source: /note="Description of Artificial Sequence: Synthetic peptide"
NYMCNSFCM

SEQ ID NO: 29704 - protein, 9 aa, Artificial Sequence
  source: /note="Description of Artificial Sequence: Synthetic peptide"
SFCMGGMNR

SEQ ID NO: 29705 - protein, 9 aa, Artificial Sequence
  source: /note="Description of Artificial Sequence: Synthetic peptide"
YMCNSFCMG

SEQ ID NO: 29706 - protein, 10 aa, Artificial Sequence
  source: /note="Description of Artificial Sequence: Synthetic peptide"
NSFCMGGMNR

SEQ ID NO: 29707 - protein, 10 aa, Artificial Sequence
  source: /note="Description of Artificial Sequence: Synthetic peptide"
IHYNYMCNSF

SEQ ID NO: 29708 - protein, 10 aa, Artificial Sequence
  source: /note="Description of Artificial Sequence: Synthetic peptide"
SFCMGGMNRR

SEQ ID NO: 29709 - protein, 10 aa, Artificial Sequence
  source: /note="Description of Artificial Sequence: Synthetic peptide"
YNYMCNSFCM

SEQ ID NO: 29710 - protein, 9 aa, Artificial Sequence
  source: /note="Description of Artificial Sequence: Synthetic peptide"
YMCNSSAWA

SEQ ID NO: 29711 - protein, 9 aa, Artificial Sequence
  source: /note="Description of Artificial Sequence: Synthetic peptide"
NYMCNSSAW

SEQ ID NO: 29712 - protein, 9 aa, Artificial Sequence
  source: /note="Description of Artificial Sequence: Synthetic peptide"
YNYMCNSSA

SEQ ID NO: 29713 - protein, 10 aa, Artificial Sequence
  source: /note="Description of Artificial Sequence: Synthetic peptide"
YMCNSSAWAA

SEQ ID NO: 29714 - protein, 10 aa, Artificial Sequence
  source: /note="Description of Artificial Sequence: Synthetic peptide"
HYNYMCNSSA

SEQ ID NO: 29715 - protein, 10 aa, Artificial Sequence
  source: /note="Description of Artificial Sequence: Synthetic peptide"
YNYMCNSSAW

SEQ ID NO: 29716 - protein, 9 aa, Artificial Sequence
  source: /note="Description of Artificial Sequence: Synthetic peptide"
SSFMGGMNR

SEQ ID NO: 29717 - protein, 9 aa, Artificial Sequence
  source: /note="Description of Artificial Sequence: Synthetic peptide"
YNYMCNSSF

SEQ ID NO: 29718 - protein, 9 aa, Artificial Sequence
  source: /note="Description of Artificial Sequence: Synthetic peptide"
NYMCNSSFM

SEQ ID NO: 29719 - protein, 9 aa, Artificial Sequence
  source: /note="Description of Artificial Sequence: Synthetic peptide"
SFMGGMNRR

SEQ ID NO: 29720 - protein, 9 aa, Artificial Sequence
  source: /note="Description of Artificial Sequence: Synthetic peptide"
YMCNSSFMG

SEQ ID NO: 29721 - protein, 10 aa, Artificial Sequence
  source: /note="Description of Artificial Sequence: Synthetic peptide"
FMGGMNRRPI

SEQ ID NO: 29722 - protein, 10 aa, Artificial Sequence
  source: /note="Description of Artificial Sequence: Synthetic peptide"
SSFMGGMNRR

SEQ ID NO: 29723 - protein, 10 aa, Artificial Sequence
  source: /note="Description of Artificial Sequence: Synthetic peptide"
HYNYMCNSSF

SEQ ID NO: 29724 - protein, 10 aa, Artificial Sequence
  source: /note="Description of Artificial Sequence: Synthetic peptide"
NSSFMGGMNR

SEQ ID NO: 29725 - protein, 10 aa, Artificial Sequence
  source: /note="Description of Artificial Sequence: Synthetic peptide"
YNYMCNSSFM

SEQ ID NO: 29726 - protein, 10 aa, Artificial Sequence
  source: /note="Description of Artificial Sequence: Synthetic peptide"
YMCNSSFMGG

SEQ ID NO: 29727 - protein, 10 aa, Artificial Sequence
  source: /note="Description of Artificial Sequence: Synthetic peptide"
MCNSSFMGGM

SEQ ID NO: 29728 - protein, 9 aa, Artificial Sequence
  source: /note="Description of Artificial Sequence: Synthetic peptide"
YMCNSSCMC

SEQ ID NO: 29729 - protein, 9 aa, Artificial Sequence
  source: /note="Description of Artificial Sequence: Synthetic peptide"
SSCMCGMNR

SEQ ID NO: 29730 - protein, 9 aa, Artificial Sequence
  source: /note="Description of Artificial Sequence: Synthetic peptide"
CGMNRRPIL

SEQ ID NO: 29731 - protein, 10 aa, Artificial Sequence
  source: /note="Description of Artificial Sequence: Synthetic peptide"
SSCMCGMNRR

SEQ ID NO: 29732 - protein, 10 aa, Artificial Sequence
  source: /note="Description of Artificial Sequence: Synthetic peptide"
NSSCMCGMNR

SEQ ID NO: 29733 - protein, 10 aa, Artificial Sequence
  source: /note="Description of Artificial Sequence: Synthetic peptide"
MCNSSCMCGM

SEQ ID NO: 29734 - protein, 10 aa, Artificial Sequence
  source: /note="Description of Artificial Sequence: Synthetic peptide"
CMCGMNRRPI

SEQ ID NO: 29735 - protein, 9 aa, Artificial Sequence
  source: /note="Description of Artificial Sequence: Synthetic peptide"
SSCMDGMNR

SEQ ID NO: 29736 - protein, 9 aa, Artificial Sequence
  source: /note="Description of Artificial Sequence: Synthetic peptide"
DGMNRRPIL

SEQ ID NO: 29737 - protein, 10 aa, Artificial Sequence
  source: /note="Description of Artificial Sequence: Synthetic peptide"
NSSCMDGMNR

SEQ ID NO: 29738 - protein, 10 aa, Artificial Sequence
  source: /note="Description of Artificial Sequence: Synthetic peptide"
CMDGMNRRPI

SEQ ID NO: 29739 - protein, 9 aa, Artificial Sequence
  source: /note="Description of Artificial Sequence: Synthetic peptide"
SSCMGSMNR

SEQ ID NO: 29740 - protein, 9 aa, Artificial Sequence
  source: /note="Description of Artificial Sequence: Synthetic peptide"
GSMNRRPIL

SEQ ID NO: 29741 - protein, 9 aa, Artificial Sequence
  source: /note="Description of Artificial Sequence: Synthetic peptide"
MGSMNRRPI

SEQ ID NO: 29742 - protein, 9 aa, Artificial Sequence
  source: /note="Description of Artificial Sequence: Synthetic peptide"
CNSSCMGSM

SEQ ID NO: 29743 - protein, 10 aa, Artificial Sequence
  source: /note="Description of Artificial Sequence: Synthetic peptide"
SMNRRPILTI

SEQ ID NO: 29744 - protein, 10 aa, Artificial Sequence
  source: /note="Description of Artificial Sequence: Synthetic peptide"
SSCMGSMNRR

SEQ ID NO: 29745 - protein, 10 aa, Artificial Sequence
  source: /note="Description of Artificial Sequence: Synthetic peptide"
NSSCMGSMNR

SEQ ID NO: 29746 - protein, 10 aa, Artificial Sequence
  source: /note="Description of Artificial Sequence: Synthetic peptide"
MGSMNRRPIL

SEQ ID NO: 29747 - protein, 10 aa, Artificial Sequence
  source: /note="Description of Artificial Sequence: Synthetic peptide"
MCNSSCMGSM

SEQ ID NO: 29748 - protein, 10 aa, Artificial Sequence
  source: /note="Description of Artificial Sequence: Synthetic peptide"
CMGSMNRRPI

SEQ ID NO: 29749 - protein, 9 aa, Artificial Sequence
  source: /note="Description of Artificial Sequence: Synthetic peptide"
SSCMGDMNR

SEQ ID NO: 29750 - protein, 10 aa, Artificial Sequence
  source: /note="Description of Artificial Sequence: Synthetic peptide"
NSSCMGDMNR

SEQ ID NO: 29751 - protein, 10 aa, Artificial Sequence
  source: /note="Description of Artificial Sequence: Synthetic peptide"
CMGDMNRRPI

SEQ ID NO: 29752 - protein, 9 aa, Artificial Sequence
  source: /note="Description of Artificial Sequence: Synthetic peptide"
SSCMGVMNR

SEQ ID NO: 29753 - protein, 9 aa, Artificial Sequence
  source: /note="Description of Artificial Sequence: Synthetic peptide"
GVMNRRPIL

SEQ ID NO: 29754 - protein, 9 aa, Artificial Sequence
  source: /note="Description of Artificial Sequence: Synthetic peptide"
SCMGVMNRR

SEQ ID NO: 29755 - protein, 9 aa, Artificial Sequence
  source: /note="Description of Artificial Sequence: Synthetic peptide"
MGVMNRRPI

SEQ ID NO: 29756 - protein, 9 aa, Artificial Sequence
  source: /note="Description of Artificial Sequence: Synthetic peptide"
CNSSCMGVM

SEQ ID NO: 29757 - protein, 10 aa, Artificial Sequence
  source: /note="Description of Artificial Sequence: Synthetic peptide"
YMCNSSCMGV

SEQ ID NO: 29758 - protein, 10 aa, Artificial Sequence
  source: /note="Description of Artificial Sequence: Synthetic peptide"
VMNRRPILTI

SEQ ID NO: 29759 - protein, 10 aa, Artificial Sequence
  source: /note="Description of Artificial Sequence: Synthetic peptide"
SSCMGVMNRR

SEQ ID NO: 29760 - protein, 10 aa, Artificial Sequence
  source: /note="Description of Artificial Sequence: Synthetic peptide"
NSSCMGVMNR

SEQ ID NO: 29761 - protein, 10 aa, Artificial Sequence
  source: /note="Description of Artificial Sequence: Synthetic peptide"
MGVMNRRPIL

SEQ ID NO: 29762 - protein, 10 aa, Artificial Sequence
  source: /note="Description of Artificial Sequence: Synthetic peptide"
MCNSSCMGVM

SEQ ID NO: 29763 - protein, 10 aa, Artificial Sequence
  source: /note="Description of Artificial Sequence: Synthetic peptide"
CMGVMNRRPI

SEQ ID NO: 29764 - protein, 9 aa, Artificial Sequence
  source: /note="Description of Artificial Sequence: Synthetic peptide"
NWRPILTII

SEQ ID NO: 29765 - protein, 9 aa, Artificial Sequence
  source: /note="Description of Artificial Sequence: Synthetic peptide"
SSCMGGMNW

SEQ ID NO: 29766 - protein, 9 aa, Artificial Sequence
  source: /note="Description of Artificial Sequence: Synthetic peptide"
MGGMNWRPI

SEQ ID NO: 29767 - protein, 9 aa, Artificial Sequence
  source: /note="Description of Artificial Sequence: Synthetic peptide"
MNWRPILTI

SEQ ID NO: 29768 - protein, 10 aa, Artificial Sequence
  source: /note="Description of Artificial Sequence: Synthetic peptide"
CMGGMNWRPI

SEQ ID NO: 29769 - protein, 10 aa, Artificial Sequence
  source: /note="Description of Artificial Sequence: Synthetic peptide"
GMNWRPILTI

SEQ ID NO: 29770 - protein, 10 aa, Artificial Sequence
  source: /note="Description of Artificial Sequence: Synthetic peptide"
SSCMGGMNWR

SEQ ID NO: 29771 - protein, 10 aa, Artificial Sequence
  source: /note="Description of Artificial Sequence: Synthetic peptide"
MNWRPILTII

SEQ ID NO: 29772 - protein, 10 aa, Artificial Sequence
  source: /note="Description of Artificial Sequence: Synthetic peptide"
NSSCMGGMNW

SEQ ID NO: 29773 - protein, 9 aa, Artificial Sequence
  source: /note="Description of Artificial Sequence: Synthetic peptide"
MNQRPILTI

SEQ ID NO: 29774 - protein, 9 aa, Artificial Sequence
  source: /note="Description of Artificial Sequence: Synthetic peptide"
NQRPILTII

SEQ ID NO: 29775 - protein, 10 aa, Artificial Sequence
  source: /note="Description of Artificial Sequence: Synthetic peptide"
CMGGMNQRPI

SEQ ID NO: 29776 - protein, 10 aa, Artificial Sequence
  source: /note="Description of Artificial Sequence: Synthetic peptide"
GMNQRPILTI

SEQ ID NO: 29777 - protein, 10 aa, Artificial Sequence
  source: /note="Description of Artificial Sequence: Synthetic peptide"
SSCMGGMNQR

SEQ ID NO: 29778 - protein, 10 aa, Artificial Sequence
  source: /note="Description of Artificial Sequence: Synthetic peptide"
NQRPILTIIT

SEQ ID NO: 29779 - protein, 9 aa, Artificial Sequence
  source: /note="Description of Artificial Sequence: Synthetic peptide"
SCMGGMNPR

SEQ ID NO: 29780 - protein, 9 aa, Artificial Sequence
  source: /note="Description of Artificial Sequence: Synthetic peptide"
NPRPILTII

SEQ ID NO: 29781 - protein, 10 aa, Artificial Sequence
  source: /note="Description of Artificial Sequence: Synthetic peptide"
GMNPRPILTI

SEQ ID NO: 29782 - protein, 10 aa, Artificial Sequence
  source: /note="Description of Artificial Sequence: Synthetic peptide"
CMGGMNPRPI

SEQ ID NO: 29783 - protein, 10 aa, Artificial Sequence
  source: /note="Description of Artificial Sequence: Synthetic peptide"
SSCMGGMNPR

SEQ ID NO: 29784 - protein, 10 aa, Artificial Sequence
  source: /note="Description of Artificial Sequence: Synthetic peptide"
NPRPILTIIT

SEQ ID NO: 29785 - protein, 9 aa, Artificial Sequence
  source: /note="Description of Artificial Sequence: Synthetic peptide"
GPILTIITL

SEQ ID NO: 29786 - protein, 9 aa, Artificial Sequence
  source: /note="Description of Artificial Sequence: Synthetic peptide"
MNRGPILTI

SEQ ID NO: 29787 - protein, 10 aa, Artificial Sequence
  source: /note="Description of Artificial Sequence: Synthetic peptide"
GMNRGPILTI

SEQ ID NO: 29788 - protein, 10 aa, Artificial Sequence
  source: /note="Description of Artificial Sequence: Synthetic peptide"
CMGGMNRGPI

SEQ ID NO: 29789 - protein, 10 aa, Artificial Sequence
  source: /note="Description of Artificial Sequence: Synthetic peptide"
MNRGPILTII

SEQ ID NO: 29790 - protein, 9 aa, Artificial Sequence
  source: /note="Description of Artificial Sequence: Synthetic peptide"
MNRMPILTI

SEQ ID NO: 29791 - protein, 9 aa, Artificial Sequence
  source: /note="Description of Artificial Sequence: Synthetic peptide"
MPILTIITL

SEQ ID NO: 29792 - protein, 9 aa, Artificial Sequence
  source: /note="Description of Artificial Sequence: Synthetic peptide"
MGGMNRMPI

SEQ ID NO: 29793 - protein, 9 aa, Artificial Sequence
  source: /note="Description of Artificial Sequence: Synthetic peptide"
SCMGGMNRM

SEQ ID NO: 29794 - protein, 9 aa, Artificial Sequence
  source: /note="Description of Artificial Sequence: Synthetic peptide"
NRMPILTII

SEQ ID NO: 29795 - protein, 10 aa, Artificial Sequence
  source: /note="Description of Artificial Sequence: Synthetic peptide"
CMGGMNRMPI

SEQ ID NO: 29796 - protein, 10 aa, Artificial Sequence
  source: /note="Description of Artificial Sequence: Synthetic peptide"
GMNRMPILTI

SEQ ID NO: 29797 - protein, 10 aa, Artificial Sequence
  source: /note="Description of Artificial Sequence: Synthetic peptide"
RMPILTIITL

SEQ ID NO: 29798 - protein, 10 aa, Artificial Sequence
  source: /note="Description of Artificial Sequence: Synthetic peptide"
MNRMPILTII

SEQ ID NO: 29799 - protein, 10 aa, Artificial Sequence
  source: /note="Description of Artificial Sequence: Synthetic peptide"
SSCMGGMNRM

SEQ ID NO: 29800 - protein, 10 aa, Artificial Sequence
  source: /note="Description of Artificial Sequence: Synthetic peptide"
MPILTIITLE

SEQ ID NO: 29801 - protein, 9 aa, Artificial Sequence
  source: /note="Description of Artificial Sequence: Synthetic peptide"
MNRSPILTI

SEQ ID NO: 29802 - protein, 9 aa, Artificial Sequence
  source: /note="Description of Artificial Sequence: Synthetic peptide"
SPILTIITL

SEQ ID NO: 29803 - protein, 9 aa, Artificial Sequence
  source: /note="Description of Artificial Sequence: Synthetic peptide"
MGGMNRSPI

SEQ ID NO: 29804 - protein, 10 aa, Artificial Sequence
  source: /note="Description of Artificial Sequence: Synthetic peptide"
GMNRSPILTI

SEQ ID NO: 29805 - protein, 10 aa, Artificial Sequence
  source: /note="Description of Artificial Sequence: Synthetic peptide"
CMGGMNRSPI

SEQ ID NO: 29806 - protein, 10 aa, Artificial Sequence
  source: /note="Description of Artificial Sequence: Synthetic peptide"
RSPILTIITL

SEQ ID NO: 29807 - protein, 10 aa, Artificial Sequence
  source: /note="Description of Artificial Sequence: Synthetic peptide"
MNRSPILTII

SEQ ID NO: 29808 - protein, 9 aa, Artificial Sequence
  source: /note="Description of Artificial Sequence: Synthetic peptide"
RLILTIITL

SEQ ID NO: 29809 - protein, 9 aa, Artificial Sequence
  source: /note="Description of Artificial Sequence: Synthetic peptide"
GMNRRLILT

SEQ ID NO: 29810 - protein, 9 aa, Artificial Sequence
  source: /note="Description of Artificial Sequence: Synthetic peptide"
MNRRLILTI

SEQ ID NO: 29811 - protein, 9 aa, Artificial Sequence
  source: /note="Description of Artificial Sequence: Synthetic peptide"
GGMNRRLIL

SEQ ID NO: 29812 - protein, 10 aa, Artificial Sequence
  source: /note="Description of Artificial Sequence: Synthetic peptide"
GMNRRLILTI

SEQ ID NO: 29813 - protein, 10 aa, Artificial Sequence
  source: /note="Description of Artificial Sequence: Synthetic peptide"
MNRRLILTII

SEQ ID NO: 29814 - protein, 10 aa, Artificial Sequence
  source: /note="Description of Artificial Sequence: Synthetic peptide"
RRLILTIITL

SEQ ID NO: 29815 - protein, 9 aa, Artificial Sequence
  source: /note="Description of Artificial Sequence: Synthetic peptide"
RPILTIFTL

SEQ ID NO: 29816 - protein, 9 aa, Artificial Sequence
  source: /note="Description of Artificial Sequence: Synthetic peptide"
NRRPILTIF

SEQ ID NO: 29817 - protein, 10 aa, Artificial Sequence
  source: /note="Description of Artificial Sequence: Synthetic peptide"
FTLEDSSGNL

SEQ ID NO: 29818 - protein, 10 aa, Artificial Sequence
  source: /note="Description of Artificial Sequence: Synthetic peptide"
MNRRPILTIF

SEQ ID NO: 29819 - protein, 10 aa, Artificial Sequence
  source: /note="Description of Artificial Sequence: Synthetic peptide"
RRPILTIFTL

SEQ ID NO: 29820 - protein, 9 aa, Artificial Sequence
  source: /note="Description of Artificial Sequence: Synthetic peptide"
ILTIITLEY

SEQ ID NO: 29821 - protein, 9 aa, Artificial Sequence
  source: /note="Description of Artificial Sequence: Synthetic peptide"
LEYSSGNLL

SEQ ID NO: 29822 - protein, 10 aa, Artificial Sequence
  source: /note="Description of Artificial Sequence: Synthetic peptide"
PILTIITLEY

SEQ ID NO: 29823 - protein, 10 aa, Artificial Sequence
  source: /note="Description of Artificial Sequence: Synthetic peptide"
EYSSGNLLGR

SEQ ID NO: 29824 - protein, 10 aa, Artificial Sequence
  source: /note="Description of Artificial Sequence: Synthetic peptide"
LEYSSGNLLG

SEQ ID NO: 29825 - protein, 9 aa, Artificial Sequence
  source: /note="Description of Artificial Sequence: Synthetic peptide"
IITLEDSSV

SEQ ID NO: 29826 - protein, 9 aa, Artificial Sequence
  source: /note="Description of Artificial Sequence: Synthetic peptide"
DSSVNLLGR

SEQ ID NO: 29827 - protein, 9 aa, Artificial Sequence
  source: /note="Description of Artificial Sequence: Synthetic peptide"
LEDSSVNLL

SEQ ID NO: 29828 - protein, 9 aa, Artificial Sequence
  source: /note="Description of Artificial Sequence: Synthetic peptide"
VNLLGRNSF

SEQ ID NO: 29829 - protein, 10 aa, Artificial Sequence
  source: /note="Description of Artificial Sequence: Synthetic peptide"
TIITLEDSSV

SEQ ID NO: 29830 - protein, 10 aa, Artificial Sequence
  source: /note="Description of Artificial Sequence: Synthetic peptide"
TLEDSSVNLL

SEQ ID NO: 29831 - protein, 10 aa, Artificial Sequence
  source: /note="Description of Artificial Sequence: Synthetic peptide"
SVNLLGRNSF

SEQ ID NO: 29832 - protein, 9 aa, Artificial Sequence
  source: /note="Description of Artificial Sequence: Synthetic peptide"
LLRRNSFEV

SEQ ID NO: 29833 - protein, 9 aa, Artificial Sequence
  source: /note="Description of Artificial Sequence: Synthetic peptide"
DSSGNLLRR

SEQ ID NO: 29834 - protein, 9 aa, Artificial Sequence
  source: /note="Description of Artificial Sequence: Synthetic peptide"
GNLLRRNSF

SEQ ID NO: 29835 - protein, 10 aa, Artificial Sequence
  source: /note="Description of Artificial Sequence: Synthetic peptide"
NLLRRNSFEV

SEQ ID NO: 29836 - protein, 10 aa, Artificial Sequence
  source: /note="Description of Artificial Sequence: Synthetic peptide"
LLRRNSFEVR

SEQ ID NO: 29837 - protein, 10 aa, Artificial Sequence
  source: /note="Description of Artificial Sequence: Synthetic peptide"
SGNLLRRNSF

SEQ ID NO: 29838 - protein, 9 aa, Artificial Sequence
  source: /note="Description of Artificial Sequence: Synthetic peptide"
LLERNSFEV

SEQ ID NO: 29839 - protein, 9 aa, Artificial Sequence
  source: /note="Description of Artificial Sequence: Synthetic peptide"
DSSGNLLER

SEQ ID NO: 29840 - protein, 9 aa, Artificial Sequence
  source: /note="Description of Artificial Sequence: Synthetic peptide"
GNLLERNSF

SEQ ID NO: 29841 - protein, 10 aa, Artificial Sequence
  source: /note="Description of Artificial Sequence: Synthetic peptide"
NLLERNSFEV

SEQ ID NO: 29842 - protein, 10 aa, Artificial Sequence
  source: /note="Description of Artificial Sequence: Synthetic peptide"
SGNLLERNSF

SEQ ID NO: 29843 - protein, 10 aa, Artificial Sequence
  source: /note="Description of Artificial Sequence: Synthetic peptide"
LERNSFEVRV

SEQ ID NO: 29844 - protein, 9 aa, Artificial Sequence
  source: /note="Description of Artificial Sequence: Synthetic peptide"
LLVRNSFEV

SEQ ID NO: 29845 - protein, 9 aa, Artificial Sequence
  source: /note="Description of Artificial Sequence: Synthetic peptide"
LVRNSFEVR

SEQ ID NO: 29846 - protein, 9 aa, Artificial Sequence
  source: /note="Description of Artificial Sequence: Synthetic peptide"
GNLLVRNSF

SEQ ID NO: 29847 - protein, 10 aa, Artificial Sequence
  source: /note="Description of Artificial Sequence: Synthetic peptide"
NLLVRNSFEV

SEQ ID NO: 29848 - protein, 10 aa, Artificial Sequence
  source: /note="Description of Artificial Sequence: Synthetic peptide"
LVRNSFEVRV

SEQ ID NO: 29849 - protein, 10 aa, Artificial Sequence
  source: /note="Description of Artificial Sequence: Synthetic peptide"
SGNLLVRNSF

SEQ ID NO: 29850 - protein, 10 aa, Artificial Sequence
  source: /note="Description of Artificial Sequence: Synthetic peptide"
LEDSSGNLLV

SEQ ID NO: 29851 - protein, 9 aa, Artificial Sequence
  source: /note="Description of Artificial Sequence: Synthetic peptide"
LLGPNSFEV

SEQ ID NO: 29852 - protein, 9 aa, Artificial Sequence
  source: /note="Description of Artificial Sequence: Synthetic peptide"
GNLLGPNSF

SEQ ID NO: 29853 - protein, 10 aa, Artificial Sequence
  source: /note="Description of Artificial Sequence: Synthetic peptide"
NLLGPNSFEV

SEQ ID NO: 29854 - protein, 10 aa, Artificial Sequence
  source: /note="Description of Artificial Sequence: Synthetic peptide"
SGNLLGPNSF

SEQ ID NO: 29855 - protein, 9 aa, Artificial Sequence
  source: /note="Description of Artificial Sequence: Synthetic peptide"
LLGRNSFKV

SEQ ID NO: 29856 - protein, 9 aa, Artificial Sequence
  source: /note="Description of Artificial Sequence: Synthetic peptide"
NLLGRNSFK

SEQ ID NO: 29857 - protein, 9 aa, Artificial Sequence
  source: /note="Description of Artificial Sequence: Synthetic peptide"
LGRNSFKVR

SEQ ID NO: 29858 - protein, 9 aa, Artificial Sequence
  source: /note="Description of Artificial Sequence: Synthetic peptide"
KVRVCACPG

SEQ ID NO: 29859 - protein, 9 aa, Artificial Sequence
  source: /note="Description of Artificial Sequence: Synthetic peptide"
NSFKVRVCA

SEQ ID NO: 29860 - protein, 9 aa, Artificial Sequence
  source: /note="Description of Artificial Sequence: Synthetic peptide"
SFKVRVCAC

SEQ ID NO: 29861 - protein, 10 aa, Artificial Sequence
  source: /note="Description of Artificial Sequence: Synthetic peptide"
NLLGRNSFKV

SEQ ID NO: 29862 - protein, 10 aa, Artificial Sequence
  source: /note="Description of Artificial Sequence: Synthetic peptide"
GNLLGRNSFK

SEQ ID NO: 29863 - protein, 10 aa, Artificial Sequence
  source: /note="Description of Artificial Sequence: Synthetic peptide"
KVRVCACPGR

SEQ ID NO: 29864 - protein, 9 aa, Artificial Sequence
  source: /note="Description of Artificial Sequence: Synthetic peptide"
LLGRNSFEM

SEQ ID NO: 29865 - protein, 9 aa, Artificial Sequence
  source: /note="Description of Artificial Sequence: Synthetic peptide"
LGRNSFEMR

SEQ ID NO: 29866 - protein, 9 aa, Artificial Sequence
  source: /note="Description of Artificial Sequence: Synthetic peptide"
NSFEMRVCA

SEQ ID NO: 29867 - protein, 9 aa, Artificial Sequence
  source: /note="Description of Artificial Sequence: Synthetic peptide"
FEMRVCACP

SEQ ID NO: 29868 - protein, 10 aa, Artificial Sequence
  source: /note="Description of Artificial Sequence: Synthetic peptide"
NLLGRNSFEM

SEQ ID NO: 29869 - protein, 10 aa, Artificial Sequence
  source: /note="Description of Artificial Sequence: Synthetic peptide"
EMRVCACPGR

SEQ ID NO: 29870 - protein, 10 aa, Artificial Sequence
  source: /note="Description of Artificial Sequence: Synthetic peptide"
FEMRVCACPG

SEQ ID NO: 29871 - protein, 9 aa, Artificial Sequence
  source: /note="Description of Artificial Sequence: Synthetic peptide"
NSFEVCVCA

SEQ ID NO: 29872 - protein, 10 aa, Artificial Sequence
  source: /note="Description of Artificial Sequence: Synthetic peptide"
EVCVCACPGR

SEQ ID NO: 29873 - protein, 10 aa, Artificial Sequence
  source: /note="Description of Artificial Sequence: Synthetic peptide"
FEVCVCACPG

SEQ ID NO: 29874 - protein, 9 aa, Artificial Sequence
  source: /note="Description of Artificial Sequence: Synthetic peptide"
NSFEVHVCA

SEQ ID NO: 29875 - protein, 9 aa, Artificial Sequence
  source: /note="Description of Artificial Sequence: Synthetic peptide"
LGRNSFEVH

SEQ ID NO: 29876 - protein, 10 aa, Artificial Sequence
  source: /note="Description of Artificial Sequence: Synthetic peptide"
EVHVCACPGR

SEQ ID NO: 29877 - protein, 10 aa, Artificial Sequence
  source: /note="Description of Artificial Sequence: Synthetic peptide"
HVCACPGRDR

SEQ ID NO: 29878 - protein, 10 aa, Artificial Sequence
  source: /note="Description of Artificial Sequence: Synthetic peptide"
FEVHVCACPG

SEQ ID NO: 29879 - protein, 9 aa, Artificial Sequence
  source: /note="Description of Artificial Sequence: Synthetic peptide"
NSFEVLVCA

SEQ ID NO: 29880 - protein, 9 aa, Artificial Sequence
  source: /note="Description of Artificial Sequence: Synthetic peptide"
LGRNSFEVL

SEQ ID NO: 29881 - protein, 10 aa, Artificial Sequence
  source: /note="Description of Artificial Sequence: Synthetic peptide"
LLGRNSFEVL

SEQ ID NO: 29882 - protein, 10 aa, Artificial Sequence
  source: /note="Description of Artificial Sequence: Synthetic peptide"
EVLVCACPGR

SEQ ID NO: 29883 - protein, 10 aa, Artificial Sequence
  source: /note="Description of Artificial Sequence: Synthetic peptide"
FEVLVCACPG

SEQ ID NO: 29884 - protein, 9 aa, Artificial Sequence
  source: /note="Description of Artificial Sequence: Synthetic peptide"
NSFEVRFCA

SEQ ID NO: 29885 - protein, 9 aa, Artificial Sequence
  source: /note="Description of Artificial Sequence: Synthetic peptide"
GRNSFEVRF

SEQ ID NO: 29886 - protein, 10 aa, Artificial Sequence
  source: /note="Description of Artificial Sequence: Synthetic peptide"
EVRFCACPGR

SEQ ID NO: 29887 - protein, 10 aa, Artificial Sequence
  source: /note="Description of Artificial Sequence: Synthetic peptide"
LGRNSFEVRF

SEQ ID NO: 29888 - protein, 10 aa, Artificial Sequence
  source: /note="Description of Artificial Sequence: Synthetic peptide"
FEVRFCACPG

SEQ ID NO: 29889 - protein, 9 aa, Artificial Sequence
  source: /note="Description of Artificial Sequence: Synthetic peptide"
RNSFEVRVY

SEQ ID NO: 29890 - protein, 9 aa, Artificial Sequence
  source: /note="Description of Artificial Sequence: Synthetic peptide"
YACPGRDRR

SEQ ID NO: 29891 - protein, 9 aa, Artificial Sequence
  source: /note="Description of Artificial Sequence: Synthetic peptide"
NSFEVRVYA

SEQ ID NO: 29892 - protein, 10 aa, Artificial Sequence
  source: /note="Description of Artificial Sequence: Synthetic peptide"
RVYACPGRDR

SEQ ID NO: 29893 - protein, 10 aa, Artificial Sequence
  source: /note="Description of Artificial Sequence: Synthetic peptide"
EVRVYACPGR

SEQ ID NO: 29894 - protein, 10 aa, Artificial Sequence
  source: /note="Description of Artificial Sequence: Synthetic peptide"
GRNSFEVRVY

SEQ ID NO: 29895 - protein, 10 aa, Artificial Sequence
  source: /note="Description of Artificial Sequence: Synthetic peptide"
FEVRVYACPG

SEQ ID NO: 29896 - protein, 9 aa, Artificial Sequence
  source: /note="Description of Artificial Sequence: Synthetic peptide"
FACPGRDRR

SEQ ID NO: 29897 - protein, 9 aa, Artificial Sequence
  source: /note="Description of Artificial Sequence: Synthetic peptide"
NSFEVRVFA

SEQ ID NO: 29898 - protein, 9 aa, Artificial Sequence
  source: /note="Description of Artificial Sequence: Synthetic peptide"
RNSFEVRVF

SEQ ID NO: 29899 - protein, 9 aa, Artificial Sequence
  source: /note="Description of Artificial Sequence: Synthetic peptide"
FEVRVFACP

SEQ ID NO: 29900 - protein, 10 aa, Artificial Sequence
  source: /note="Description of Artificial Sequence: Synthetic peptide"
RVFACPGRDR

SEQ ID NO: 29901 - protein, 10 aa, Artificial Sequence
  source: /note="Description of Artificial Sequence: Synthetic peptide"
EVRVFACPGR

SEQ ID NO: 29902 - protein, 10 aa, Artificial Sequence
  source: /note="Description of Artificial Sequence: Synthetic peptide"
VFACPGRDRR

SEQ ID NO: 29903 - protein, 10 aa, Artificial Sequence
  source: /note="Description of Artificial Sequence: Synthetic peptide"
GRNSFEVRVF

SEQ ID NO: 29904 - protein, 10 aa, Artificial Sequence
  source: /note="Description of Artificial Sequence: Synthetic peptide"
FEVRVFACPG

SEQ ID NO: 29905 - protein, 9 aa, Artificial Sequence
  source: /note="Description of Artificial Sequence: Synthetic peptide"
CAFPGRDRR

SEQ ID NO: 29906 - protein, 9 aa, Artificial Sequence
  source: /note="Description of Artificial Sequence: Synthetic peptide"
SFEVRVCAF

SEQ ID NO: 29907 - protein, 10 aa, Artificial Sequence
  source: /note="Description of Artificial Sequence: Synthetic peptide"
EVRVCAFPGR

SEQ ID NO: 29908 - protein, 10 aa, Artificial Sequence
  source: /note="Description of Artificial Sequence: Synthetic peptide"
NSFEVRVCAF

SEQ ID NO: 29909 - protein, 10 aa, Artificial Sequence
  source: /note="Description of Artificial Sequence: Synthetic peptide"
FEVRVCAFPG

SEQ ID NO: 29910 - protein, 9 aa, Artificial Sequence
  source: /note="Description of Artificial Sequence: Synthetic peptide"
CACSGRDRR

SEQ ID NO: 29911 - protein, 9 aa, Artificial Sequence
  source: /note="Description of Artificial Sequence: Synthetic peptide"
FEVRVCACS

SEQ ID NO: 29912 - protein, 10 aa, Artificial Sequence
  source: /note="Description of Artificial Sequence: Synthetic peptide"
EVRVCACSGR

SEQ ID NO: 29913 - protein, 10 aa, Artificial Sequence
  source: /note="Description of Artificial Sequence: Synthetic peptide"
FEVRVCACSG

SEQ ID NO: 29914 - protein, 9 aa, Artificial Sequence
  source: /note="Description of Artificial Sequence: Synthetic peptide"
CACPGRNRR

SEQ ID NO: 29915 - protein, 10 aa, Artificial Sequence
  source: /note="Description of Artificial Sequence: Synthetic peptide"
RVCACPGRNR

SEQ ID NO: 29916 - protein, 9 aa, Artificial Sequence
  source: /note="Description of Artificial Sequence: Synthetic peptide"
CACPGRDWR

SEQ ID NO: 29917 - protein, 10 aa, Artificial Sequence
  source: /note="Description of Artificial Sequence: Synthetic peptide"
RDWRTEEENL

SEQ ID NO: 29918 - protein, 9 aa, Artificial Sequence
  source: /note="Description of Artificial Sequence: Synthetic peptide"
RTKEENLRK

SEQ ID NO: 29919 - protein, 10 aa, Artificial Sequence
  source: /note="Description of Artificial Sequence: Synthetic peptide"
RTKEENLRKK

SEQ ID NO: 29920 - protein, 9 aa, Artificial Sequence
  source: /note="Description of Artificial Sequence: Synthetic peptide"
RTEKENLRK

SEQ ID NO: 29921 - protein, 10 aa, Artificial Sequence
  source: /note="Description of Artificial Sequence: Synthetic peptide"
RTEKENLRKK

SEQ ID NO: 29922 - protein, 9 aa, Artificial Sequence
  source: /note="Description of Artificial Sequence: Synthetic peptide"
KEETTGWRI

SEQ ID NO: 29923 - protein, 9 aa, Artificial Sequence
  source: /note="Description of Artificial Sequence: Synthetic peptide"
RIFHPSDPW

SEQ ID NO: 29924 - protein, 9 aa, Artificial Sequence
  source: /note="Description of Artificial Sequence: Synthetic peptide"
EETTGWRIF

SEQ ID NO: 29925 - protein, 10 aa, Artificial Sequence
  source: /note="Description of Artificial Sequence: Synthetic peptide"
RIFHPSDPWA

SEQ ID NO: 29926 - protein, 10 aa, Artificial Sequence
  source: /note="Description of Artificial Sequence: Synthetic peptide"
LPNNTSSSPA

SEQ ID NO: 29927 - protein, 10 aa, Artificial Sequence
  source: /note="Description of Artificial Sequence: Synthetic peptide"
KEETTGWRIF

SEQ ID NO: 29928 - protein, 10 aa, Artificial Sequence
  source: /note="Description of Artificial Sequence: Synthetic peptide"
WRIFHPSDPW

SEQ ID NO: 29929 - protein, 10 aa, Artificial Sequence
  source: /note="Description of Artificial Sequence: Synthetic peptide"
EETTGWRIFH

SEQ ID NO: 29930 - protein, 10 aa, Artificial Sequence
  source: /note="Description of Artificial Sequence: Synthetic peptide"
SPAKEETTGW

SEQ ID NO: 29931 - protein, 9 aa, Artificial Sequence
  source: /note="Description of Artificial Sequence: Synthetic peptide"
SNMLLKPPW

SEQ ID NO: 29932 - protein, 9 aa, Artificial Sequence
  source: /note="Description of Artificial Sequence: Synthetic peptide"
FLAGDGRAT

SEQ ID NO: 29933 - protein, 9 aa, Artificial Sequence
  source: /note="Description of Artificial Sequence: Synthetic peptide"
GRATEVPSL

SEQ ID NO: 29934 - protein, 9 aa, Artificial Sequence
  source: /note="Description of Artificial Sequence: Synthetic peptide"
TEVPSLTAL

SEQ ID NO: 29935 - protein, 10 aa, Artificial Sequence
  source: /note="Description of Artificial Sequence: Synthetic peptide"
TEVPSLTALH

SEQ ID NO: 29936 - protein, 9 aa, Artificial Sequence
  source: /note="Description of Artificial Sequence: Synthetic peptide"
QVQDQLMNK

SEQ ID NO: 29937 - protein, 9 aa, Artificial Sequence
  source: /note="Description of Artificial Sequence: Synthetic peptide"
KELTERLFV

SEQ ID NO: 29938 - protein, 10 aa, Artificial Sequence
  source: /note="Description of Artificial Sequence: Synthetic peptide"
LMNKELTERL

SEQ ID NO: 29939 - protein, 10 aa, Artificial Sequence
  source: /note="Description of Artificial Sequence: Synthetic peptide"
QLMNKELTER

SEQ ID NO: 29940 - protein, 10 aa, Artificial Sequence
  source: /note="Description of Artificial Sequence: Synthetic peptide"
VQDQLMNKEL

SEQ ID NO: 29941 - protein, 10 aa, Artificial Sequence
  source: /note="Description of Artificial Sequence: Synthetic peptide"
MNKELTERLF

SEQ ID NO: 29942 - protein, 10 aa, Artificial Sequence
  source: /note="Description of Artificial Sequence: Synthetic peptide"
KELTERLFVL

SEQ ID NO: 29943 - protein, 9 aa, Artificial Sequence
  source: /note="Description of Artificial Sequence: Synthetic peptide"
CLCTDPYEL

SEQ ID NO: 29944 - protein, 9 aa, Artificial Sequence
  source: /note="Description of Artificial Sequence: Synthetic peptide"
FQCLCTDPY

SEQ ID NO: 29945 - protein, 10 aa, Artificial Sequence
  source: /note="Description of Artificial Sequence: Synthetic peptide"
GFQCLCTDPY

SEQ ID NO: 29946 - protein, 9 aa, Artificial Sequence
  source: /note="Description of Artificial Sequence: Synthetic peptide"
KLSLESEGA

SEQ ID NO: 29947 - protein, 9 aa, Artificial Sequence
  source: /note="Description of Artificial Sequence: Synthetic peptide"
PSKDRAAKK

SEQ ID NO: 29948 - protein, 9 aa, Artificial Sequence
  source: /note="Description of Artificial Sequence: Synthetic peptide"
DRAAKKLSL

SEQ ID NO: 29949 - protein, 9 aa, Artificial Sequence
  source: /note="Description of Artificial Sequence: Synthetic peptide"
AEAIHLPQV

SEQ ID NO: 29950 - protein, 10 aa, Artificial Sequence
  source: /note="Description of Artificial Sequence: Synthetic peptide"
FAEAIHLPQV

SEQ ID NO: 29951 - protein, 10 aa, Artificial Sequence
  source: /note="Description of Artificial Sequence: Synthetic peptide"
AIHLPQVAGV

SEQ ID NO: 29952 - protein, 10 aa, Artificial Sequence
  source: /note="Description of Artificial Sequence: Synthetic peptide"
HLPQVAGVPR

SEQ ID NO: 29953 - protein, 10 aa, Artificial Sequence
  source: /note="Description of Artificial Sequence: Synthetic peptide"
LPQVAGVPRF

SEQ ID NO: 29954 - protein, 10 aa, Artificial Sequence
  source: /note="Description of Artificial Sequence: Synthetic peptide"
AEAIHLPQVA

SEQ ID NO: 29955 - protein, 9 aa, Artificial Sequence
  source: /note="Description of Artificial Sequence: Synthetic peptide"
GPIPGPIPV

SEQ ID NO: 29956 - protein, 9 aa, Artificial Sequence
  source: /note="Description of Artificial Sequence: Synthetic peptide"
IPGPIPVPI

SEQ ID NO: 29957 - protein, 9 aa, Artificial Sequence
  source: /note="Description of Artificial Sequence: Synthetic peptide"
IPVPIPGPI

SEQ ID NO: 29958 - protein, 9 aa, Artificial Sequence
  source: /note="Description of Artificial Sequence: Synthetic peptide"
FIKHFIIYL

SEQ ID NO: 29959 - protein, 9 aa, Artificial Sequence
  source: /note="Description of Artificial Sequence: Synthetic peptide"
IIYLIPRYV

SEQ ID NO: 29960 - protein, 9 aa, Artificial Sequence
  source: /note="Description of Artificial Sequence: Synthetic peptide"
FIIYLIPRY

SEQ ID NO: 29961 - protein, 9 aa, Artificial Sequence
  source: /note="Description of Artificial Sequence: Synthetic peptide"
HFIIYLIPR

SEQ ID NO: 29962 - protein, 9 aa, Artificial Sequence
  source: /note="Description of Artificial Sequence: Synthetic peptide"
IYLIPRYVR

SEQ ID NO: 29963 - protein, 9 aa, Artificial Sequence
  source: /note="Description of Artificial Sequence: Synthetic peptide"
IKHFIIYLI

SEQ ID NO: 29964 - protein, 10 aa, Artificial Sequence
  source: /note="Description of Artificial Sequence: Synthetic peptide"
FIKHFIIYLI

SEQ ID NO: 29965 - protein, 10 aa, Artificial Sequence
  source: /note="Description of Artificial Sequence: Synthetic peptide"
FIIYLIPRYV

SEQ ID NO: 29966 - protein, 10 aa, Artificial Sequence
  source: /note="Description of Artificial Sequence: Synthetic peptide"
YLIPRYVRDL

SEQ ID NO: 29967 - protein, 10 aa, Artificial Sequence
  source: /note="Description of Artificial Sequence: Synthetic peptide"
IIYLIPRYVR

SEQ ID NO: 29968 - protein, 10 aa, Artificial Sequence
  source: /note="Description of Artificial Sequence: Synthetic peptide"
LIPRYVRDLK

SEQ ID NO: 29969 - protein, 10 aa, Artificial Sequence
  source: /note="Description of Artificial Sequence: Synthetic peptide"
LFIKHFIIYL

SEQ ID NO: 29970 - protein, 10 aa, Artificial Sequence
  source: /note="Description of Artificial Sequence: Synthetic peptide"
KHFIIYLIPR

SEQ ID NO: 29971 - protein, 10 aa, Artificial Sequence
  source: /note="Description of Artificial Sequence: Synthetic peptide"
HFIIYLIPRY

SEQ ID NO: 29972 - protein, 9 aa, Artificial Sequence
  source: /note="Description of Artificial Sequence: Synthetic peptide"
VEILFGEKI

SEQ ID NO: 29973 - protein, 9 aa, Artificial Sequence
  source: /note="Description of Artificial Sequence: Synthetic peptide"
GEKITSSDV

SEQ ID NO: 29974 - protein, 10 aa, Artificial Sequence
  source: /note="Description of Artificial Sequence: Synthetic peptide"
GEKITSSDVV

SEQ ID NO: 29975 - protein, 10 aa, Artificial Sequence
  source: /note="Description of Artificial Sequence: Synthetic peptide"
VEILFGEKIT

SEQ ID NO: 29976 - protein, 9 aa, Artificial Sequence
  source: /note="Description of Artificial Sequence: Synthetic peptide"
KHQNHYRVY

SEQ ID NO: 29977 - protein, 9 aa, Artificial Sequence
  source: /note="Description of Artificial Sequence: Synthetic peptide"
QNHYRVYNL

SEQ ID NO: 29978 - protein, 9 aa, Artificial Sequence
  source: /note="Description of Artificial Sequence: Synthetic peptide"
KKHQNHYRV

SEQ ID NO: 29979 - protein, 10 aa, Artificial Sequence
  source: /note="Description of Artificial Sequence: Synthetic peptide"
FLDKKHQNHY

SEQ ID NO: 29980 - protein, 10 aa, Artificial Sequence
  source: /note="Description of Artificial Sequence: Synthetic peptide"
HQNHYRVYNL

SEQ ID NO: 29981 - protein, 10 aa, Artificial Sequence
  source: /note="Description of Artificial Sequence: Synthetic peptide"
KKHQNHYRVY

SEQ ID NO: 29982 - protein, 9 aa, Artificial Sequence
  source: /note="Description of Artificial Sequence: Synthetic peptide"
MESSKKMDF

SEQ ID NO: 29983 - protein, 9 aa, Artificial Sequence
  source: /note="Description of Artificial Sequence: Synthetic peptide"
KKMDFPGAL

SEQ ID NO: 29984 - protein, 10 aa, Artificial Sequence
  source: /note="Description of Artificial Sequence: Synthetic peptide"
SSKKMDFPGA

SEQ ID NO: 29985 - protein, 10 aa, Artificial Sequence
  source: /note="Description of Artificial Sequence: Synthetic peptide"
SKKMDFPGAL

SEQ ID NO: 29986 - protein, 9 aa, Artificial Sequence
  source: /note="Description of Artificial Sequence: Synthetic peptide"
KSARYNHFS

SEQ ID NO: 29987 - protein, 9 aa, Artificial Sequence
  source: /note="Description of Artificial Sequence: Synthetic peptide"
SARYNHFSG

SEQ ID NO: 29988 - protein, 9 aa, Artificial Sequence
  source: /note="Description of Artificial Sequence: Synthetic peptide"
GKSARYNHF

SEQ ID NO: 29989 - protein, 10 aa, Artificial Sequence
  source: /note="Description of Artificial Sequence: Synthetic peptide"
KSARYNHFSG

SEQ ID NO: 29990 - protein, 10 aa, Artificial Sequence
  source: /note="Description of Artificial Sequence: Synthetic peptide"
SARYNHFSGG

SEQ ID NO: 29991 - protein, 10 aa, Artificial Sequence
  source: /note="Description of Artificial Sequence: Synthetic peptide"
SGKSARYNHF

SEQ ID NO: 29992 - protein, 10 aa, Artificial Sequence
  source: /note="Description of Artificial Sequence: Synthetic peptide"
NHFSGGPSNL

SEQ ID NO: 29993 - protein, 9 aa, Artificial Sequence
  source: /note="Description of Artificial Sequence: Synthetic peptide"
DEVYCLNNF

SEQ ID NO: 29994 - protein, 9 aa, Artificial Sequence
  source: /note="Description of Artificial Sequence: Synthetic peptide"
FLLGLMFQI

SEQ ID NO: 29995 - protein, 9 aa, Artificial Sequence
  source: /note="Description of Artificial Sequence: Synthetic peptide"
LMFQITAKA

SEQ ID NO: 29996 - protein, 9 aa, Artificial Sequence
  source: /note="Description of Artificial Sequence: Synthetic peptide"
FQITAKASI

SEQ ID NO: 29997 - protein, 9 aa, Artificial Sequence
  source: /note="Description of Artificial Sequence: Synthetic peptide"
GLMFQITAK

SEQ ID NO: 29998 - protein, 10 aa, Artificial Sequence
  source: /note="Description of Artificial Sequence: Synthetic peptide"
FLLGLMFQIT

SEQ ID NO: 29999 - protein, 10 aa, Artificial Sequence
  source: /note="Description of Artificial Sequence: Synthetic peptide"
GLMFQITAKA

SEQ ID NO: 30000 - protein, 10 aa, Artificial Sequence
  source: /note="Description of Artificial Sequence: Synthetic peptide"
FQITAKASII

SEQ ID NO: 30001 - protein, 10 aa, Artificial Sequence
  source: /note="Description of Artificial Sequence: Synthetic peptide"
LGLMFQITAK

SEQ ID NO: 30002 - protein, 10 aa, Artificial Sequence
  source: /note="Description of Artificial Sequence: Synthetic peptide"
VFLLGLMFQI

SEQ ID NO: 30003 - protein, 10 aa, Artificial Sequence
  source: /note="Description of Artificial Sequence: Synthetic peptide"
MFQITAKASI

SEQ ID NO: 30004 - protein, 10 aa, Artificial Sequence
  source: /note="Description of Artificial Sequence: Synthetic peptide"
LMFQITAKAS

SEQ ID NO: 30005 - protein, 10 aa, Artificial Sequence
  source: /note="Description of Artificial Sequence: Synthetic peptide"
QITAKASIIF

SEQ ID NO: 30006 - protein, 9 aa, Artificial Sequence
  source: /note="Description of Artificial Sequence: Synthetic peptide"
SKKEQKTEW

SEQ ID NO: 30007 - protein, 9 aa, Artificial Sequence
  source: /note="Description of Artificial Sequence: Synthetic peptide"
TEWEWKLQI

SEQ ID NO: 30008 - protein, 9 aa, Artificial Sequence
  source: /note="Description of Artificial Sequence: Synthetic peptide"
KEQKTEWEW

SEQ ID NO: 30009 - protein, 10 aa, Artificial Sequence
  source: /note="Description of Artificial Sequence: Synthetic peptide"
RSRSSKKEQK

SEQ ID NO: 30010 - protein, 9 aa, Artificial Sequence
  source: /note="Description of Artificial Sequence: Synthetic peptide"
LYGDEIKDF

SEQ ID NO: 30011 - protein, 9 aa, Artificial Sequence
  source: /note="Description of Artificial Sequence: Synthetic peptide"
IKDFTQAEL

SEQ ID NO: 30012 - protein, 9 aa, Artificial Sequence
  source: /note="Description of Artificial Sequence: Synthetic peptide"
DEIKDFTQA

SEQ ID NO: 30013 - protein, 10 aa, Artificial Sequence
  source: /note="Description of Artificial Sequence: Synthetic peptide"
EIKDFTQAEL

SEQ ID NO: 30014 - protein, 10 aa, Artificial Sequence
  source: /note="Description of Artificial Sequence: Synthetic peptide"
KDFTQAELAL

SEQ ID NO: 30015 - protein, 10 aa, Artificial Sequence
  source: /note="Description of Artificial Sequence: Synthetic peptide"
DEIKDFTQAE

SEQ ID NO: 30016 - protein, 9 aa, Artificial Sequence
  source: /note="Description of Artificial Sequence: Synthetic peptide"
NLYCGQNKK

SEQ ID NO: 30017 - protein, 9 aa, Artificial Sequence
  source: /note="Description of Artificial Sequence: Synthetic peptide"
NQHPSPNLY

SEQ ID NO: 30018 - protein, 9 aa, Artificial Sequence
  source: /note="Description of Artificial Sequence: Synthetic peptide"
KQNQHPSPN

SEQ ID NO: 30019 - protein, 10 aa, Artificial Sequence
  source: /note="Description of Artificial Sequence: Synthetic peptide"
KQNQHPSPNL

SEQ ID NO: 30020 - protein, 10 aa, Artificial Sequence
  source: /note="Description of Artificial Sequence: Synthetic peptide"
QNQHPSPNLY

SEQ ID NO: 30021 - protein, 9 aa, Artificial Sequence
  source: /note="Description of Artificial Sequence: Synthetic peptide"
KLWADQISL

SEQ ID NO: 30022 - protein, 9 aa, Artificial Sequence
  source: /note="Description of Artificial Sequence: Synthetic peptide"
AQKLWADQI

SEQ ID NO: 30023 - protein, 10 aa, Artificial Sequence
  source: /note="Description of Artificial Sequence: Synthetic peptide"
KLWADQISLA

SEQ ID NO: 30024 - protein, 10 aa, Artificial Sequence
  source: /note="Description of Artificial Sequence: Synthetic peptide"
QISLAGSNIF

SEQ ID NO: 30025 - protein, 10 aa, Artificial Sequence
  source: /note="Description of Artificial Sequence: Synthetic peptide"
QKLWADQISL

SEQ ID NO: 30026 - protein, 10 aa, Artificial Sequence
  source: /note="Description of Artificial Sequence: Synthetic peptide"
DQISLAGSNI

SEQ ID NO: 30027 - protein, 9 aa, Artificial Sequence
  source: /note="Description of Artificial Sequence: Synthetic peptide"
YTHMYDPYK

SEQ ID NO: 30028 - protein, 9 aa, Artificial Sequence
  source: /note="Description of Artificial Sequence: Synthetic peptide"
MYDPYKCFK

SEQ ID NO: 30029 - protein, 9 aa, Artificial Sequence
  source: /note="Description of Artificial Sequence: Synthetic peptide"
QQGQYTHMY

SEQ ID NO: 30030 - protein, 9 aa, Artificial Sequence
  source: /note="Description of Artificial Sequence: Synthetic peptide"
KQQGQYTHM

SEQ ID NO: 30031 - protein, 9 aa, Artificial Sequence
  source: /note="Description of Artificial Sequence: Synthetic peptide"
HMYDPYKCF

SEQ ID NO: 30032 - protein, 9 aa, Artificial Sequence
  source: /note="Description of Artificial Sequence: Synthetic peptide"
QKQQGQYTH

SEQ ID NO: 30033 - protein, 9 aa, Artificial Sequence
  source: /note="Description of Artificial Sequence: Synthetic peptide"
GQYTHMYDP

SEQ ID NO: 30034 - protein, 9 aa, Artificial Sequence
  source: /note="Description of Artificial Sequence: Synthetic peptide"
YKCFKILKM

SEQ ID NO: 30035 - protein, 9 aa, Artificial Sequence
  source: /note="Description of Artificial Sequence: Synthetic peptide"
DPYKCFKIL

SEQ ID NO: 30036 - protein, 10 aa, Artificial Sequence
  source: /note="Description of Artificial Sequence: Synthetic peptide"
HMYDPYKCFK

SEQ ID NO: 30037 - protein, 10 aa, Artificial Sequence
  source: /note="Description of Artificial Sequence: Synthetic peptide"
MYDPYKCFKI

SEQ ID NO: 30038 - protein, 10 aa, Artificial Sequence
  source: /note="Description of Artificial Sequence: Synthetic peptide"
KQQGQYTHMY

SEQ ID NO: 30039 - protein, 10 aa, Artificial Sequence
  source: /note="Description of Artificial Sequence: Synthetic peptide"
GQYTHMYDPY

SEQ ID NO: 30040 - protein, 10 aa, Artificial Sequence
  source: /note="Description of Artificial Sequence: Synthetic peptide"
GQKQQGQYTH

SEQ ID NO: 30041 - protein, 10 aa, Artificial Sequence
  source: /note="Description of Artificial Sequence: Synthetic peptide"
QKQQGQYTHM

SEQ ID NO: 30042 - protein, 10 aa, Artificial Sequence
  source: /note="Description of Artificial Sequence: Synthetic peptide"
THMYDPYKCF

SEQ ID NO: 30043 - protein, 10 aa, Artificial Sequence
  source: /note="Description of Artificial Sequence: Synthetic peptide"
SPGQKQQGQY

SEQ ID NO: 30044 - protein, 9 aa, Artificial Sequence
  source: /note="Description of Artificial Sequence: Synthetic peptide"
FTKDNQVHI

SEQ ID NO: 30045 - protein, 9 aa, Artificial Sequence
  source: /note="Description of Artificial Sequence: Synthetic peptide"
NQVHIGPKM

SEQ ID NO: 30046 - protein, 10 aa, Artificial Sequence
  source: /note="Description of Artificial Sequence: Synthetic peptide"
KDNQVHIGPK

SEQ ID NO: 30047 - protein, 9 aa, Artificial Sequence
  source: /note="Description of Artificial Sequence: Synthetic peptide"
RSCIQAYFY

SEQ ID NO: 30048 - protein, 9 aa, Artificial Sequence
  source: /note="Description of Artificial Sequence: Synthetic peptide"
CIQAYFYDL

SEQ ID NO: 30049 - protein, 9 aa, Artificial Sequence
  source: /note="Description of Artificial Sequence: Synthetic peptide"
NARSCIQAY

SEQ ID NO: 30050 - protein, 9 aa, Artificial Sequence
  source: /note="Description of Artificial Sequence: Synthetic peptide"
ARSCIQAYF

SEQ ID NO: 30051 - protein, 9 aa, Artificial Sequence
  source: /note="Description of Artificial Sequence: Synthetic peptide"
IQAYFYDLH

SEQ ID NO: 30052 - protein, 10 aa, Artificial Sequence
  source: /note="Description of Artificial Sequence: Synthetic peptide"
ARSCIQAYFY

SEQ ID NO: 30053 - protein, 10 aa, Artificial Sequence
  source: /note="Description of Artificial Sequence: Synthetic peptide"
ENARSCIQAY

SEQ ID NO: 30054 - protein, 10 aa, Artificial Sequence
  source: /note="Description of Artificial Sequence: Synthetic peptide"
NARSCIQAYF

SEQ ID NO: 30055 - protein, 10 aa, Artificial Sequence
  source: /note="Description of Artificial Sequence: Synthetic peptide"
AENARSCIQA

SEQ ID NO: 30056 - protein, 9 aa, Artificial Sequence
  source: /note="Description of Artificial Sequence: Synthetic peptide"
LEVAVGVCL

SEQ ID NO: 30057 - protein, 10 aa, Artificial Sequence
  source: /note="Description of Artificial Sequence: Synthetic peptide"
ALRTGSSDTK

SEQ ID NO: 30058 - protein, 9 aa, Artificial Sequence
  source: /note="Description of Artificial Sequence: Synthetic peptide"
RLKKMASLD

SEQ ID NO: 30059 - protein, 9 aa, Artificial Sequence
  source: /note="Description of Artificial Sequence: Synthetic peptide"
KMASLDRKA

SEQ ID NO: 30060 - protein, 10 aa, Artificial Sequence
  source: /note="Description of Artificial Sequence: Synthetic peptide"
RLKKMASLDR

SEQ ID NO: 30061 - protein, 10 aa, Artificial Sequence
  source: /note="Description of Artificial Sequence: Synthetic peptide"
MASLDRKASL

SEQ ID NO: 30062 - protein, 10 aa, Artificial Sequence
  source: /note="Description of Artificial Sequence: Synthetic peptide"
KKMASLDRKA

SEQ ID NO: 30063 - protein, 10 aa, Artificial Sequence
  source: /note="Description of Artificial Sequence: Synthetic peptide"
ASLDRKASLW

SEQ ID NO: 30064 - protein, 10 aa, Artificial Sequence
  source: /note="Description of Artificial Sequence: Synthetic peptide"
LDRKASLWLF

SEQ ID NO: 30065 - protein, 9 aa, Artificial Sequence
  source: /note="Description of Artificial Sequence: Synthetic peptide"
NKHNQVLTF

SEQ ID NO: 30066 - protein, 10 aa, Artificial Sequence
  source: /note="Description of Artificial Sequence: Synthetic peptide"
RQEEKHVCNK

SEQ ID NO: 30067 - protein, 10 aa, Artificial Sequence
  source: /note="Description of Artificial Sequence: Synthetic peptide"
CNKHNQVLTF

SEQ ID NO: 30068 - protein, 10 aa, Artificial Sequence
  source: /note="Description of Artificial Sequence: Synthetic peptide"
NKHNQVLTFF

SEQ ID NO: 30069 - protein, 9 aa, Artificial Sequence
  source: /note="Description of Artificial Sequence: Synthetic peptide"
MLKKFKEDI

SEQ ID NO: 30070 - protein, 10 aa, Artificial Sequence
  source: /note="Description of Artificial Sequence: Synthetic peptide"
KFKEDIRGEL

SEQ ID NO: 30071 - protein, 10 aa, Artificial Sequence
  source: /note="Description of Artificial Sequence: Synthetic peptide"
MLKKFKEDIR

SEQ ID NO: 30072 - protein, 9 aa, Artificial Sequence
  source: /note="Description of Artificial Sequence: Synthetic peptide"
AQLLASVNK

SEQ ID NO: 30073 - protein, 9 aa, Artificial Sequence
  source: /note="Description of Artificial Sequence: Synthetic peptide"
SVNKEHEHK

SEQ ID NO: 30074 - protein, 9 aa, Artificial Sequence
  source: /note="Description of Artificial Sequence: Synthetic peptide"
RKAQLLASV

SEQ ID NO: 30075 - protein, 10 aa, Artificial Sequence
  source: /note="Description of Artificial Sequence: Synthetic peptide"
KAQLLASVNK

SEQ ID NO: 30076 - protein, 10 aa, Artificial Sequence
  source: /note="Description of Artificial Sequence: Synthetic peptide"
ASVNKEHEHK

SEQ ID NO: 30077 - protein, 10 aa, Artificial Sequence
  source: /note="Description of Artificial Sequence: Synthetic peptide"
RRKAQLLASV

SEQ ID NO: 30078 - protein, 10 aa, Artificial Sequence
  source: /note="Description of Artificial Sequence: Synthetic peptide"
LKGQQVREPV

SEQ ID NO: 30079 - protein, 9 aa, Artificial Sequence
  source: /note="Description of Artificial Sequence: Synthetic peptide"
RIQDFVWRV

SEQ ID NO: 30080 - protein, 9 aa, Artificial Sequence
  source: /note="Description of Artificial Sequence: Synthetic peptide"
FVWRVEQRK

SEQ ID NO: 30081 - protein, 9 aa, Artificial Sequence
  source: /note="Description of Artificial Sequence: Synthetic peptide"
DFVWRVEQR

SEQ ID NO: 30082 - protein, 9 aa, Artificial Sequence
  source: /note="Description of Artificial Sequence: Synthetic peptide"
WRVEQRKIL

SEQ ID NO: 30083 - protein, 10 aa, Artificial Sequence
  source: /note="Description of Artificial Sequence: Synthetic peptide"
DFVWRVEQRK

SEQ ID NO: 30084 - protein, 10 aa, Artificial Sequence
  source: /note="Description of Artificial Sequence: Synthetic peptide"
WRVEQRKILL

SEQ ID NO: 30085 - protein, 9 aa, Artificial Sequence
  source: /note="Description of Artificial Sequence: Synthetic peptide"
GGRTRSPGR

SEQ ID NO: 30086 - protein, 9 aa, Artificial Sequence
  source: /note="Description of Artificial Sequence: Synthetic peptide"
RTRSPGRAE

SEQ ID NO: 30087 - protein, 10 aa, Artificial Sequence
  source: /note="Description of Artificial Sequence: Synthetic peptide"
GGRTRSPGRA

SEQ ID NO: 30088 - protein, 10 aa, Artificial Sequence
  source: /note="Description of Artificial Sequence: Synthetic peptide"
RTRSPGRAEV

SEQ ID NO: 30089 - protein, 9 aa, Artificial Sequence
  source: /note="Description of Artificial Sequence: Synthetic peptide"
KMIKWTLLK

SEQ ID NO: 30090 - protein, 9 aa, Artificial Sequence
  source: /note="Description of Artificial Sequence: Synthetic peptide"
EFINLKMIK

SEQ ID NO: 30091 - protein, 9 aa, Artificial Sequence
  source: /note="Description of Artificial Sequence: Synthetic peptide"
NLKMIKWTL

SEQ ID NO: 30092 - protein, 9 aa, Artificial Sequence
  source: /note="Description of Artificial Sequence: Synthetic peptide"
LKMIKWTLL

SEQ ID NO: 30093 - protein, 9 aa, Artificial Sequence
  source: /note="Description of Artificial Sequence: Synthetic peptide"
KREFINLKM

SEQ ID NO: 30094 - protein, 9 aa, Artificial Sequence
  source: /note="Description of Artificial Sequence: Synthetic peptide"
REFINLKMI

SEQ ID NO: 30095 - protein, 9 aa, Artificial Sequence
  source: /note="Description of Artificial Sequence: Synthetic peptide"
DEKREFINL

SEQ ID NO: 30096 - protein, 10 aa, Artificial Sequence
  source: /note="Description of Artificial Sequence: Synthetic peptide"
NLKMIKWTLL

SEQ ID NO: 30097 - protein, 10 aa, Artificial Sequence
  source: /note="Description of Artificial Sequence: Synthetic peptide"
EKREFINLKM

SEQ ID NO: 30098 - protein, 10 aa, Artificial Sequence
  source: /note="Description of Artificial Sequence: Synthetic peptide"
KMIKWTLLKS

SEQ ID NO: 30099 - protein, 9 aa, Artificial Sequence
  source: /note="Description of Artificial Sequence: Synthetic peptide"
WMPRQETSL

SEQ ID NO: 30100 - protein, 9 aa, Artificial Sequence
  source: /note="Description of Artificial Sequence: Synthetic peptide"
KWMPRQETS

SEQ ID NO: 30101 - protein, 9 aa, Artificial Sequence
  source: /note="Description of Artificial Sequence: Synthetic peptide"
LPFYKWMPR

SEQ ID NO: 30102 - protein, 9 aa, Artificial Sequence
  source: /note="Description of Artificial Sequence: Synthetic peptide"
MPRQETSLT

SEQ ID NO: 30103 - protein, 9 aa, Artificial Sequence
  source: /note="Description of Artificial Sequence: Synthetic peptide"
YKWMPRQET

SEQ ID NO: 30104 - protein, 10 aa, Artificial Sequence
  source: /note="Description of Artificial Sequence: Synthetic peptide"
KWMPRQETSL

SEQ ID NO: 30105 - protein, 10 aa, Artificial Sequence
  source: /note="Description of Artificial Sequence: Synthetic peptide"
GLPFYKWMPR

SEQ ID NO: 30106 - protein, 10 aa, Artificial Sequence
  source: /note="Description of Artificial Sequence: Synthetic peptide"
MPRQETSLTS

SEQ ID NO: 30107 - protein, 10 aa, Artificial Sequence
  source: /note="Description of Artificial Sequence: Synthetic peptide"
YKWMPRQETS

SEQ ID NO: 30108 - protein, 9 aa, Artificial Sequence
  source: /note="Description of Artificial Sequence: Synthetic peptide"
VYNVRTVIL

SEQ ID NO: 30109 - protein, 9 aa, Artificial Sequence
  source: /note="Description of Artificial Sequence: Synthetic peptide"
QVYNVRTVI

SEQ ID NO: 30110 - protein, 10 aa, Artificial Sequence
  source: /note="Description of Artificial Sequence: Synthetic peptide"
PQVYNVRTVI

SEQ ID NO: 30111 - protein, 10 aa, Artificial Sequence
  source: /note="Description of Artificial Sequence: Synthetic peptide"
QVYNVRTVIL

SEQ ID NO: 30112 - protein, 10 aa, Artificial Sequence
  source: /note="Description of Artificial Sequence: Synthetic peptide"
NFNKQNKLKR

SEQ ID NO: 30113 - protein, 10 aa, Artificial Sequence
  source: /note="Description of Artificial Sequence: Synthetic peptide"
LQNFNKQNKL

SEQ ID NO: 30114 - protein, 9 aa, Artificial Sequence
  source: /note="Description of Artificial Sequence: Synthetic peptide"
YMNRLQPST

SEQ ID NO: 30115 - protein, 9 aa, Artificial Sequence
  source: /note="Description of Artificial Sequence: Synthetic peptide"
RLQPSTQWY

SEQ ID NO: 30116 - protein, 9 aa, Artificial Sequence
  source: /note="Description of Artificial Sequence: Synthetic peptide"
LQPSTQWYK

SEQ ID NO: 30117 - protein, 9 aa, Artificial Sequence
  source: /note="Description of Artificial Sequence: Synthetic peptide"
LHRMLYMNR

SEQ ID NO: 30118 - protein, 9 aa, Artificial Sequence
  source: /note="Description of Artificial Sequence: Synthetic peptide"
STQWYKITA

SEQ ID NO: 30119 - protein, 9 aa, Artificial Sequence
  source: /note="Description of Artificial Sequence: Synthetic peptide"
KKHLHRMLY

SEQ ID NO: 30120 - protein, 9 aa, Artificial Sequence
  source: /note="Description of Artificial Sequence: Synthetic peptide"
EFTKKHLHR

SEQ ID NO: 30121 - protein, 9 aa, Artificial Sequence
  source: /note="Description of Artificial Sequence: Synthetic peptide"
FTKKHLHRM

SEQ ID NO: 30122 - protein, 9 aa, Artificial Sequence
  source: /note="Description of Artificial Sequence: Synthetic peptide"
LEFTKKHLH

SEQ ID NO: 30123 - protein, 9 aa, Artificial Sequence
  source: /note="Description of Artificial Sequence: Synthetic peptide"
KHLHRMLYM

SEQ ID NO: 30124 - protein, 9 aa, Artificial Sequence
  source: /note="Description of Artificial Sequence: Synthetic peptide"
HRMLYMNRL

SEQ ID NO: 30125 - protein, 9 aa, Artificial Sequence
  source: /note="Description of Artificial Sequence: Synthetic peptide"
QPSTQWYKI

SEQ ID NO: 30126 - protein, 10 aa, Artificial Sequence
  source: /note="Description of Artificial Sequence: Synthetic peptide"
MLYMNRLQPS

SEQ ID NO: 30127 - protein, 10 aa, Artificial Sequence
  source: /note="Description of Artificial Sequence: Synthetic peptide"
HLHRMLYMNR

SEQ ID NO: 30128 - protein, 10 aa, Artificial Sequence
  source: /note="Description of Artificial Sequence: Synthetic peptide"
RLQPSTQWYK

SEQ ID NO: 30129 - protein, 10 aa, Artificial Sequence
  source: /note="Description of Artificial Sequence: Synthetic peptide"
LQPSTQWYKI

SEQ ID NO: 30130 - protein, 10 aa, Artificial Sequence
  source: /note="Description of Artificial Sequence: Synthetic peptide"
KKHLHRMLYM

SEQ ID NO: 30131 - protein, 10 aa, Artificial Sequence
  source: /note="Description of Artificial Sequence: Synthetic peptide"
FTKKHLHRML

SEQ ID NO: 30132 - protein, 10 aa, Artificial Sequence
  source: /note="Description of Artificial Sequence: Synthetic peptide"
TKKHLHRMLY

SEQ ID NO: 30133 - protein, 10 aa, Artificial Sequence
  source: /note="Description of Artificial Sequence: Synthetic peptide"
RMLYMNRLQP

SEQ ID NO: 30134 - protein, 10 aa, Artificial Sequence
  source: /note="Description of Artificial Sequence: Synthetic peptide"
YMNRLQPSTQ

SEQ ID NO: 30135 - protein, 10 aa, Artificial Sequence
  source: /note="Description of Artificial Sequence: Synthetic peptide"
MNRLQPSTQW

SEQ ID NO: 30136 - protein, 10 aa, Artificial Sequence
  source: /note="Description of Artificial Sequence: Synthetic peptide"
CPLEFTKKHL

SEQ ID NO: 30137 - protein, 9 aa, Artificial Sequence
  source: /note="Description of Artificial Sequence: Synthetic peptide"
FAISNILSL

SEQ ID NO: 30138 - protein, 9 aa, Artificial Sequence
  source: /note="Description of Artificial Sequence: Synthetic peptide"
AISNILSLL

SEQ ID NO: 30139 - protein, 9 aa, Artificial Sequence
  source: /note="Description of Artificial Sequence: Synthetic peptide"
ISNILSLLR

SEQ ID NO: 30140 - protein, 9 aa, Artificial Sequence
  source: /note="Description of Artificial Sequence: Synthetic peptide"
SLLRLISLF

SEQ ID NO: 30141 - protein, 9 aa, Artificial Sequence
  source: /note="Description of Artificial Sequence: Synthetic peptide"
LSLLRLISL

SEQ ID NO: 30142 - protein, 10 aa, Artificial Sequence
  source: /note="Description of Artificial Sequence: Synthetic peptide"
FAISNILSLL

SEQ ID NO: 30143 - protein, 10 aa, Artificial Sequence
  source: /note="Description of Artificial Sequence: Synthetic peptide"
ILSLLRLISL

SEQ ID NO: 30144 - protein, 10 aa, Artificial Sequence
  source: /note="Description of Artificial Sequence: Synthetic peptide"
LLRLISLFTA

SEQ ID NO: 30145 - protein, 10 aa, Artificial Sequence
  source: /note="Description of Artificial Sequence: Synthetic peptide"
AISNILSLLR

SEQ ID NO: 30146 - protein, 10 aa, Artificial Sequence
  source: /note="Description of Artificial Sequence: Synthetic peptide"
LFAISNILSL

SEQ ID NO: 30147 - protein, 10 aa, Artificial Sequence
  source: /note="Description of Artificial Sequence: Synthetic peptide"
LSLLRLISLF

SEQ ID NO: 30148 - protein, 10 aa, Artificial Sequence
  source: /note="Description of Artificial Sequence: Synthetic peptide"
ISNILSLLRL

SEQ ID NO: 30149 - protein, 9 aa, Artificial Sequence
  source: /note="Description of Artificial Sequence: Synthetic peptide"
KELITVFWM

SEQ ID NO: 30150 - protein, 10 aa, Artificial Sequence
  source: /note="Description of Artificial Sequence: Synthetic peptide"
WMGSEGHQDI

SEQ ID NO: 30151 - protein, 10 aa, Artificial Sequence
  source: /note="Description of Artificial Sequence: Synthetic peptide"
KKKELITVFW

SEQ ID NO: 30152 - protein, 10 aa, Artificial Sequence
  source: /note="Description of Artificial Sequence: Synthetic peptide"
KKELITVFWM

SEQ ID NO: 30153 - protein, 10 aa, Artificial Sequence
  source: /note="Description of Artificial Sequence: Synthetic peptide"
KELITVFWMG

SEQ ID NO: 30154 - protein, 9 aa, Artificial Sequence
  source: /note="Description of Artificial Sequence: Synthetic peptide"
FILADNWTT

SEQ ID NO: 30155 - protein, 9 aa, Artificial Sequence
  source: /note="Description of Artificial Sequence: Synthetic peptide"
LADNWTTGK

SEQ ID NO: 30156 - protein, 9 aa, Artificial Sequence
  source: /note="Description of Artificial Sequence: Synthetic peptide"
ADNWTTGKY

SEQ ID NO: 30157 - protein, 9 aa, Artificial Sequence
  source: /note="Description of Artificial Sequence: Synthetic peptide"
SHFILADNW

SEQ ID NO: 30158 - protein, 10 aa, Artificial Sequence
  source: /note="Description of Artificial Sequence: Synthetic peptide"
LADNWTTGKY

SEQ ID NO: 30159 - protein, 10 aa, Artificial Sequence
  source: /note="Description of Artificial Sequence: Synthetic peptide"
ILADNWTTGK

SEQ ID NO: 30160 - protein, 10 aa, Artificial Sequence
  source: /note="Description of Artificial Sequence: Synthetic peptide"
WTTGKYGAEV

SEQ ID NO: 30161 - protein, 10 aa, Artificial Sequence
  source: /note="Description of Artificial Sequence: Synthetic peptide"
HSHFILADNW

SEQ ID NO: 30162 - protein, 9 aa, Artificial Sequence
  source: /note="Description of Artificial Sequence: Synthetic peptide"
LLSFGVAHK

SEQ ID NO: 30163 - protein, 9 aa, Artificial Sequence
  source: /note="Description of Artificial Sequence: Synthetic peptide"
SFGVAHKAI

SEQ ID NO: 30164 - protein, 9 aa, Artificial Sequence
  source: /note="Description of Artificial Sequence: Synthetic peptide"
AHKAILSPK

SEQ ID NO: 30165 - protein, 9 aa, Artificial Sequence
  source: /note="Description of Artificial Sequence: Synthetic peptide"
LSFGVAHKA

SEQ ID NO: 30166 - protein, 9 aa, Artificial Sequence
  source: /note="Description of Artificial Sequence: Synthetic peptide"
VLLSFGVAH

SEQ ID NO: 30167 - protein, 10 aa, Artificial Sequence
  source: /note="Description of Artificial Sequence: Synthetic peptide"
LLSFGVAHKA

SEQ ID NO: 30168 - protein, 10 aa, Artificial Sequence
  source: /note="Description of Artificial Sequence: Synthetic peptide"
VLLSFGVAHK

SEQ ID NO: 30169 - protein, 10 aa, Artificial Sequence
  source: /note="Description of Artificial Sequence: Synthetic peptide"
VAHKAILSPK

SEQ ID NO: 30170 - protein, 10 aa, Artificial Sequence
  source: /note="Description of Artificial Sequence: Synthetic peptide"
LSFGVAHKAI

SEQ ID NO: 30171 - protein, 9 aa, Artificial Sequence
  source: /note="Description of Artificial Sequence: Synthetic peptide"
ITQKFYAFY

SEQ ID NO: 30172 - protein, 9 aa, Artificial Sequence
  source: /note="Description of Artificial Sequence: Synthetic peptide"
KSKKLPITQ

SEQ ID NO: 30173 - protein, 9 aa, Artificial Sequence
  source: /note="Description of Artificial Sequence: Synthetic peptide"
KLPITQKFY

SEQ ID NO: 30174 - protein, 9 aa, Artificial Sequence
  source: /note="Description of Artificial Sequence: Synthetic peptide"
KKLPITQKF

SEQ ID NO: 30175 - protein, 9 aa, Artificial Sequence
  source: /note="Description of Artificial Sequence: Synthetic peptide"
TQKFYAFYH

SEQ ID NO: 30176 - protein, 9 aa, Artificial Sequence
  source: /note="Description of Artificial Sequence: Synthetic peptide"
QKFYAFYHA

SEQ ID NO: 30177 - protein, 9 aa, Artificial Sequence
  source: /note="Description of Artificial Sequence: Synthetic peptide"
LPITQKFYA

SEQ ID NO: 30178 - protein, 10 aa, Artificial Sequence
  source: /note="Description of Artificial Sequence: Synthetic peptide"
KLPITQKFYA

SEQ ID NO: 30179 - protein, 10 aa, Artificial Sequence
  source: /note="Description of Artificial Sequence: Synthetic peptide"
KSKKLPITQK

SEQ ID NO: 30180 - protein, 10 aa, Artificial Sequence
  source: /note="Description of Artificial Sequence: Synthetic peptide"
ITQKFYAFYH

SEQ ID NO: 30181 - protein, 10 aa, Artificial Sequence
  source: /note="Description of Artificial Sequence: Synthetic peptide"
TQKFYAFYHA

SEQ ID NO: 30182 - protein, 10 aa, Artificial Sequence
  source: /note="Description of Artificial Sequence: Synthetic peptide"
KKLPITQKFY

SEQ ID NO: 30183 - protein, 10 aa, Artificial Sequence
  source: /note="Description of Artificial Sequence: Synthetic peptide"
PITQKFYAFY

SEQ ID NO: 30184 - protein, 10 aa, Artificial Sequence
  source: /note="Description of Artificial Sequence: Synthetic peptide"
LPITQKFYAF

SEQ ID NO: 30185 - protein, 10 aa, Artificial Sequence
  source: /note="Description of Artificial Sequence: Synthetic peptide"
SKKLPITQKF

SEQ ID NO: 30186 - protein, 10 aa, Artificial Sequence
  source: /note="Description of Artificial Sequence: Synthetic peptide"
QKFYAFYHAP

SEQ ID NO: 30187 - protein, 9 aa, Artificial Sequence
  source: /note="Description of Artificial Sequence: Synthetic peptide"
SESTNSVCL

SEQ ID NO: 30188 - protein, 10 aa, Artificial Sequence
  source: /note="Description of Artificial Sequence: Synthetic peptide"
KESESTNSVC

SEQ ID NO: 30189 - protein, 10 aa, Artificial Sequence
  source: /note="Description of Artificial Sequence: Synthetic peptide"
SESTNSVCLM

SEQ ID NO: 30190 - protein, 9 aa, Artificial Sequence
  source: /note="Description of Artificial Sequence: Synthetic peptide"
VLAGLCPLL

SEQ ID NO: 30191 - protein, 9 aa, Artificial Sequence
  source: /note="Description of Artificial Sequence: Synthetic peptide"
HSVPHPPRA

SEQ ID NO: 30192 - protein, 9 aa, Artificial Sequence
  source: /note="Description of Artificial Sequence: Synthetic peptide"
HPPRAGPVL

SEQ ID NO: 30193 - protein, 9 aa, Artificial Sequence
  source: /note="Description of Artificial Sequence: Synthetic peptide"
RAGPVLAGL

SEQ ID NO: 30194 - protein, 10 aa, Artificial Sequence
  source: /note="Description of Artificial Sequence: Synthetic peptide"
DFHSVPHPPR

SEQ ID NO: 30195 - protein, 10 aa, Artificial Sequence
  source: /note="Description of Artificial Sequence: Synthetic peptide"
VPHPPRAGPV

SEQ ID NO: 30196 - protein, 10 aa, Artificial Sequence
  source: /note="Description of Artificial Sequence: Synthetic peptide"
GPVLAGLCPL

SEQ ID NO: 30197 - protein, 9 aa, Artificial Sequence
  source: /note="Description of Artificial Sequence: Synthetic peptide"
WLWFWSKYK

SEQ ID NO: 30198 - protein, 9 aa, Artificial Sequence
  source: /note="Description of Artificial Sequence: Synthetic peptide"
FQSEADWLW

SEQ ID NO: 30199 - protein, 9 aa, Artificial Sequence
  source: /note="Description of Artificial Sequence: Synthetic peptide"
SEADWLWFW

SEQ ID NO: 30200 - protein, 9 aa, Artificial Sequence
  source: /note="Description of Artificial Sequence: Synthetic peptide"
LWFWSKYKL

SEQ ID NO: 30201 - protein, 10 aa, Artificial Sequence
  source: /note="Description of Artificial Sequence: Synthetic peptide"
WLWFWSKYKL

SEQ ID NO: 30202 - protein, 10 aa, Artificial Sequence
  source: /note="Description of Artificial Sequence: Synthetic peptide"
EADWLWFWSK

SEQ ID NO: 30203 - protein, 10 aa, Artificial Sequence
  source: /note="Description of Artificial Sequence: Synthetic peptide"
DFQSEADWLW

SEQ ID NO: 30204 - protein, 10 aa, Artificial Sequence
  source: /note="Description of Artificial Sequence: Synthetic peptide"
FQSEADWLWF

SEQ ID NO: 30205 - protein, 10 aa, Artificial Sequence
  source: /note="Description of Artificial Sequence: Synthetic peptide"
WFWSKYKLSV

SEQ ID NO: 30206 - protein, 10 aa, Artificial Sequence
  source: /note="Description of Artificial Sequence: Synthetic peptide"
DWLWFWSKYK

SEQ ID NO: 30207 - protein, 10 aa, Artificial Sequence
  source: /note="Description of Artificial Sequence: Synthetic peptide"
ADWLWFWSKY

SEQ ID NO: 30208 - protein, 10 aa, Artificial Sequence
  source: /note="Description of Artificial Sequence: Synthetic peptide"
SEADWLWFWS

SEQ ID NO: 30209 - protein, 9 aa, Artificial Sequence
  source: /note="Description of Artificial Sequence: Synthetic peptide"
MVLLLLAYV

SEQ ID NO: 30210 - protein, 9 aa, Artificial Sequence
  source: /note="Description of Artificial Sequence: Synthetic peptide"
VLLLLAYVL

SEQ ID NO: 30211 - protein, 9 aa, Artificial Sequence
  source: /note="Description of Artificial Sequence: Synthetic peptide"
RGMVLLLLA

SEQ ID NO: 30212 - protein, 9 aa, Artificial Sequence
  source: /note="Description of Artificial Sequence: Synthetic peptide"
GMVLLLLAY

SEQ ID NO: 30213 - protein, 10 aa, Artificial Sequence
  source: /note="Description of Artificial Sequence: Synthetic peptide"
GMVLLLLAYV

SEQ ID NO: 30214 - protein, 10 aa, Artificial Sequence
  source: /note="Description of Artificial Sequence: Synthetic peptide"
MVLLLLAYVL

SEQ ID NO: 30215 - protein, 10 aa, Artificial Sequence
  source: /note="Description of Artificial Sequence: Synthetic peptide"
VLLLLAYVLL

SEQ ID NO: 30216 - protein, 10 aa, Artificial Sequence
  source: /note="Description of Artificial Sequence: Synthetic peptide"
RGMVLLLLAY

SEQ ID NO: 30217 - protein, 9 aa, Artificial Sequence
  source: /note="Description of Artificial Sequence: Synthetic peptide"
GQTELNIAI

SEQ ID NO: 30218 - protein, 9 aa, Artificial Sequence
  source: /note="Description of Artificial Sequence: Synthetic peptide"
ELNIAIERR

SEQ ID NO: 30219 - protein, 9 aa, Artificial Sequence
  source: /note="Description of Artificial Sequence: Synthetic peptide"
EAYEGQTEL

SEQ ID NO: 30220 - protein, 9 aa, Artificial Sequence
  source: /note="Description of Artificial Sequence: Synthetic peptide"
YEGQTELNI

SEQ ID NO: 30221 - protein, 10 aa, Artificial Sequence
  source: /note="Description of Artificial Sequence: Synthetic peptide"
AYEGQTELNI

SEQ ID NO: 30222 - protein, 10 aa, Artificial Sequence
  source: /note="Description of Artificial Sequence: Synthetic peptide"
QTELNIAIER

SEQ ID NO: 30223 - protein, 10 aa, Artificial Sequence
  source: /note="Description of Artificial Sequence: Synthetic peptide"
EEAYEGQTEL

SEQ ID NO: 30224 - protein, 10 aa, Artificial Sequence
  source: /note="Description of Artificial Sequence: Synthetic peptide"
YEGQTELNIA

SEQ ID NO: 30225 - protein, 9 aa, Artificial Sequence
  source: /note="Description of Artificial Sequence: Synthetic peptide"
LMHFCWLMA

SEQ ID NO: 30226 - protein, 9 aa, Artificial Sequence
  source: /note="Description of Artificial Sequence: Synthetic peptide"
MHFCWLMAV

SEQ ID NO: 30227 - protein, 9 aa, Artificial Sequence
  source: /note="Description of Artificial Sequence: Synthetic peptide"
KMIFGDLMH

SEQ ID NO: 30228 - protein, 9 aa, Artificial Sequence
  source: /note="Description of Artificial Sequence: Synthetic peptide"
MIFGDLMHF

SEQ ID NO: 30229 - protein, 9 aa, Artificial Sequence
  source: /note="Description of Artificial Sequence: Synthetic peptide"
DLMHFCWLM

SEQ ID NO: 30230 - protein, 9 aa, Artificial Sequence
  source: /note="Description of Artificial Sequence: Synthetic peptide"
GDLMHFCWL

SEQ ID NO: 30231 - protein, 10 aa, Artificial Sequence
  source: /note="Description of Artificial Sequence: Synthetic peptide"
MIFGDLMHFC

SEQ ID NO: 30232 - protein, 10 aa, Artificial Sequence
  source: /note="Description of Artificial Sequence: Synthetic peptide"
LMHFCWLMAV

SEQ ID NO: 30233 - protein, 10 aa, Artificial Sequence
  source: /note="Description of Artificial Sequence: Synthetic peptide"
KMIFGDLMHF

SEQ ID NO: 30234 - protein, 10 aa, Artificial Sequence
  source: /note="Description of Artificial Sequence: Synthetic peptide"
IFGDLMHFCW

SEQ ID NO: 30235 - protein, 10 aa, Artificial Sequence
  source: /note="Description of Artificial Sequence: Synthetic peptide"
HFCWLMAVVI

SEQ ID NO: 30236 - protein, 10 aa, Artificial Sequence
  source: /note="Description of Artificial Sequence: Synthetic peptide"
MHFCWLMAVV

SEQ ID NO: 30237 - protein, 10 aa, Artificial Sequence
  source: /note="Description of Artificial Sequence: Synthetic peptide"
GDLMHFCWLM

SEQ ID NO: 30238 - protein, 9 aa, Artificial Sequence
  source: /note="Description of Artificial Sequence: Synthetic peptide"
TAARWLYIR

SEQ ID NO: 30239 - protein, 9 aa, Artificial Sequence
  source: /note="Description of Artificial Sequence: Synthetic peptide"
AARWLYIRG

SEQ ID NO: 30240 - protein, 9 aa, Artificial Sequence
  source: /note="Description of Artificial Sequence: Synthetic peptide"
HNTAARWLY

SEQ ID NO: 30241 - protein, 9 aa, Artificial Sequence
  source: /note="Description of Artificial Sequence: Synthetic peptide"
NTAARWLYI

SEQ ID NO: 30242 - protein, 9 aa, Artificial Sequence
  source: /note="Description of Artificial Sequence: Synthetic peptide"
QKHNTAARW

SEQ ID NO: 30243 - protein, 9 aa, Artificial Sequence
  source: /note="Description of Artificial Sequence: Synthetic peptide"
KHNTAARWL

SEQ ID NO: 30244 - protein, 10 aa, Artificial Sequence
  source: /note="Description of Artificial Sequence: Synthetic peptide"
WLYIRGHNGK

SEQ ID NO: 30245 - protein, 10 aa, Artificial Sequence
  source: /note="Description of Artificial Sequence: Synthetic peptide"
NTAARWLYIR

SEQ ID NO: 30246 - protein, 10 aa, Artificial Sequence
  source: /note="Description of Artificial Sequence: Synthetic peptide"
AARWLYIRGH

SEQ ID NO: 30247 - protein, 10 aa, Artificial Sequence
  source: /note="Description of Artificial Sequence: Synthetic peptide"
RWLYIRGHNG

SEQ ID NO: 30248 - protein, 10 aa, Artificial Sequence
  source: /note="Description of Artificial Sequence: Synthetic peptide"
KHNTAARWLY

SEQ ID NO: 30249 - protein, 10 aa, Artificial Sequence
  source: /note="Description of Artificial Sequence: Synthetic peptide"
VQKHNTAARW

SEQ ID NO: 30250 - protein, 10 aa, Artificial Sequence
  source: /note="Description of Artificial Sequence: Synthetic peptide"
QKHNTAARWL

SEQ ID NO: 30251 - protein, 9 aa, Artificial Sequence
  source: /note="Description of Artificial Sequence: Synthetic peptide"
SMMSLEDNK

SEQ ID NO: 30252 - protein, 9 aa, Artificial Sequence
  source: /note="Description of Artificial Sequence: Synthetic peptide"
CFLVSMMSL

SEQ ID NO: 30253 - protein, 9 aa, Artificial Sequence
  source: /note="Description of Artificial Sequence: Synthetic peptide"
VIKCFLVSM

SEQ ID NO: 30254 - protein, 9 aa, Artificial Sequence
  source: /note="Description of Artificial Sequence: Synthetic peptide"
IKCFLVSMM

SEQ ID NO: 30255 - protein, 10 aa, Artificial Sequence
  source: /note="Description of Artificial Sequence: Synthetic peptide"
VSMMSLEDNK

SEQ ID NO: 30256 - protein, 10 aa, Artificial Sequence
  source: /note="Description of Artificial Sequence: Synthetic peptide"
EVIKCFLVSM

SEQ ID NO: 30257 - protein, 10 aa, Artificial Sequence
  source: /note="Description of Artificial Sequence: Synthetic peptide"
KCFLVSMMSL

SEQ ID NO: 30258 - protein, 10 aa, Artificial Sequence
  source: /note="Description of Artificial Sequence: Synthetic peptide"
SMMSLEDNKH

SEQ ID NO: 30259 - protein, 10 aa, Artificial Sequence
  source: /note="Description of Artificial Sequence: Synthetic peptide"
WEVIKCFLVS

SEQ ID NO: 30260 - protein, 9 aa, Artificial Sequence
  source: /note="Description of Artificial Sequence: Synthetic peptide"
KVFCTTAGG

SEQ ID NO: 30261 - protein, 9 aa, Artificial Sequence
  source: /note="Description of Artificial Sequence: Synthetic peptide"
YSKVFCTTA

SEQ ID NO: 30262 - protein, 9 aa, Artificial Sequence
  source: /note="Description of Artificial Sequence: Synthetic peptide"
SKVFCTTAG

SEQ ID NO: 30263 - protein, 10 aa, Artificial Sequence
  source: /note="Description of Artificial Sequence: Synthetic peptide"
KVFCTTAGGK

SEQ ID NO: 30264 - protein, 10 aa, Artificial Sequence
  source: /note="Description of Artificial Sequence: Synthetic peptide"
HPYSKVFCTT

SEQ ID NO: 30265 - protein, 9 aa, Artificial Sequence
  source: /note="Description of Artificial Sequence: Synthetic peptide"
NTSSVGAQL

SEQ ID NO: 30266 - protein, 9 aa, Artificial Sequence
  source: /note="Description of Artificial Sequence: Synthetic peptide"
GQNTSSVGA

SEQ ID NO: 30267 - protein, 10 aa, Artificial Sequence
  source: /note="Description of Artificial Sequence: Synthetic peptide"
NTSSVGAQLM

SEQ ID NO: 30268 - protein, 9 aa, Artificial Sequence
  source: /note="Description of Artificial Sequence: Synthetic peptide"
DLKRGHQKL

SEQ ID NO: 30269 - protein, 9 aa, Artificial Sequence
  source: /note="Description of Artificial Sequence: Synthetic peptide"
RGHQKLEEM

SEQ ID NO: 30270 - protein, 9 aa, Artificial Sequence
  source: /note="Description of Artificial Sequence: Synthetic peptide"
KLEEMVTSL

SEQ ID NO: 30271 - protein, 9 aa, Artificial Sequence
  source: /note="Description of Artificial Sequence: Synthetic peptide"
SLDQEVAEV

SEQ ID NO: 30272 - protein, 9 aa, Artificial Sequence
  source: /note="Description of Artificial Sequence: Synthetic peptide"
MVTSLDQEV

SEQ ID NO: 30273 - protein, 10 aa, Artificial Sequence
  source: /note="Description of Artificial Sequence: Synthetic peptide"
EMVTSLDQEV

SEQ ID NO: 30274 - protein, 10 aa, Artificial Sequence
  source: /note="Description of Artificial Sequence: Synthetic peptide"
TSLDQEVAEV

SEQ ID NO: 30275 - protein, 10 aa, Artificial Sequence
  source: /note="Description of Artificial Sequence: Synthetic peptide"
QKLEEMVTSL

SEQ ID NO: 30276 - protein, 9 aa, Artificial Sequence
  source: /note="Description of Artificial Sequence: Synthetic peptide"
SPNGGLDIL

SEQ ID NO: 30277 - protein, 9 aa, Artificial Sequence
  source: /note="Description of Artificial Sequence: Synthetic peptide"
MSDLGPQEM

SEQ ID NO: 30278 - protein, 9 aa, Artificial Sequence
  source: /note="Description of Artificial Sequence: Synthetic peptide"
QEMVHISKF

SEQ ID NO: 30279 - protein, 10 aa, Artificial Sequence
  source: /note="Description of Artificial Sequence: Synthetic peptide"
MSDLGPQEMV

SEQ ID NO: 30280 - protein, 10 aa, Artificial Sequence
  source: /note="Description of Artificial Sequence: Synthetic peptide"
IMSDLGPQEM

SEQ ID NO: 30281 - protein, 10 aa, Artificial Sequence
  source: /note="Description of Artificial Sequence: Synthetic peptide"
MVHISKFTGL

SEQ ID NO: 30282 - protein, 10 aa, Artificial Sequence
  source: /note="Description of Artificial Sequence: Synthetic peptide"
PQEMVHISKF

SEQ ID NO: 30283 - protein, 10 aa, Artificial Sequence
  source: /note="Description of Artificial Sequence: Synthetic peptide"
QEMVHISKFT

SEQ ID NO: 30284 - protein, 9 aa, Artificial Sequence
  source: /note="Description of Artificial Sequence: Synthetic peptide"
RFRCRQCST

SEQ ID NO: 30285 - protein, 9 aa, Artificial Sequence
  source: /note="Description of Artificial Sequence: Synthetic peptide"
RCRQCSTAY

SEQ ID NO: 30286 - protein, 9 aa, Artificial Sequence
  source: /note="Description of Artificial Sequence: Synthetic peptide"
CSTAYDTLV

SEQ ID NO: 30287 - protein, 9 aa, Artificial Sequence
  source: /note="Description of Artificial Sequence: Synthetic peptide"
TAYDTLVEL

SEQ ID NO: 30288 - protein, 9 aa, Artificial Sequence
  source: /note="Description of Artificial Sequence: Synthetic peptide"
RQCSTAYDT

SEQ ID NO: 30289 - protein, 10 aa, Artificial Sequence
  source: /note="Description of Artificial Sequence: Synthetic peptide"
STAYDTLVEL

SEQ ID NO: 30290 - protein, 10 aa, Artificial Sequence
  source: /note="Description of Artificial Sequence: Synthetic peptide"
RFRCRQCSTA

SEQ ID NO: 30291 - protein, 10 aa, Artificial Sequence
  source: /note="Description of Artificial Sequence: Synthetic peptide"
FRCRQCSTAY

SEQ ID NO: 30292 - protein, 10 aa, Artificial Sequence
  source: /note="Description of Artificial Sequence: Synthetic peptide"
RQCSTAYDTL

SEQ ID NO: 30293 - protein, 10 aa, Artificial Sequence
  source: /note="Description of Artificial Sequence: Synthetic peptide"
RDVCKDGSPL

SEQ ID NO: 30294 - protein, 9 aa, Artificial Sequence
  source: /note="Description of Artificial Sequence: Synthetic peptide"
ALAKHVRAK

SEQ ID NO: 30295 - protein, 9 aa, Artificial Sequence
  source: /note="Description of Artificial Sequence: Synthetic peptide"
LAKHVRAKA

SEQ ID NO: 30296 - protein, 9 aa, Artificial Sequence
  source: /note="Description of Artificial Sequence: Synthetic peptide"
HVRAKALSS

SEQ ID NO: 30297 - protein, 9 aa, Artificial Sequence
  source: /note="Description of Artificial Sequence: Synthetic peptide"
RAKALSSTL

SEQ ID NO: 30298 - protein, 9 aa, Artificial Sequence
  source: /note="Description of Artificial Sequence: Synthetic peptide"
KALSSTLRL

SEQ ID NO: 30299 - protein, 9 aa, Artificial Sequence
  source: /note="Description of Artificial Sequence: Synthetic peptide"
AKHVRAKAL

SEQ ID NO: 30300 - protein, 10 aa, Artificial Sequence
  source: /note="Description of Artificial Sequence: Synthetic peptide"
ALAKHVRAKA

SEQ ID NO: 30301 - protein, 10 aa, Artificial Sequence
  source: /note="Description of Artificial Sequence: Synthetic peptide"
QALAKHVRAK

SEQ ID NO: 30302 - protein, 10 aa, Artificial Sequence
  source: /note="Description of Artificial Sequence: Synthetic peptide"
HVRAKALSST

SEQ ID NO: 30303 - protein, 10 aa, Artificial Sequence
  source: /note="Description of Artificial Sequence: Synthetic peptide"
RAKALSSTLR

SEQ ID NO: 30304 - protein, 10 aa, Artificial Sequence
  source: /note="Description of Artificial Sequence: Synthetic peptide"
KALSSTLRLA

SEQ ID NO: 30305 - protein, 10 aa, Artificial Sequence
  source: /note="Description of Artificial Sequence: Synthetic peptide"
LAKHVRAKAL

SEQ ID NO: 30306 - protein, 10 aa, Artificial Sequence
  source: /note="Description of Artificial Sequence: Synthetic peptide"
VRAKALSSTL

SEQ ID NO: 30307 - protein, 10 aa, Artificial Sequence
  source: /note="Description of Artificial Sequence: Synthetic peptide"
AKALSSTLRL

SEQ ID NO: 30308 - protein, 9 aa, Artificial Sequence
  source: /note="Description of Artificial Sequence: Synthetic peptide"
LTFFLLLLV

SEQ ID NO: 30309 - protein, 9 aa, Artificial Sequence
  source: /note="Description of Artificial Sequence: Synthetic peptide"
FLLLLVVFL

SEQ ID NO: 30310 - protein, 9 aa, Artificial Sequence
  source: /note="Description of Artificial Sequence: Synthetic peptide"
LLLLVVFLL

SEQ ID NO: 30311 - protein, 9 aa, Artificial Sequence
  source: /note="Description of Artificial Sequence: Synthetic peptide"
LLVVFLLEA

SEQ ID NO: 30312 - protein, 9 aa, Artificial Sequence
  source: /note="Description of Artificial Sequence: Synthetic peptide"
FFLLLLVVF

SEQ ID NO: 30313 - protein, 10 aa, Artificial Sequence
  source: /note="Description of Artificial Sequence: Synthetic peptide"
LLTFFLLLLV

SEQ ID NO: 30314 - protein, 10 aa, Artificial Sequence
  source: /note="Description of Artificial Sequence: Synthetic peptide"
LTFFLLLLVV

SEQ ID NO: 30315 - protein, 10 aa, Artificial Sequence
  source: /note="Description of Artificial Sequence: Synthetic peptide"
FLLLLVVFLL

SEQ ID NO: 30316 - protein, 10 aa, Artificial Sequence
  source: /note="Description of Artificial Sequence: Synthetic peptide"
LLLVVFLLEA

SEQ ID NO: 30317 - protein, 10 aa, Artificial Sequence
  source: /note="Description of Artificial Sequence: Synthetic peptide"
TFFLLLLVVF

SEQ ID NO: 30318 - protein, 10 aa, Artificial Sequence
  source: /note="Description of Artificial Sequence: Synthetic peptide"
FFLLLLVVFL

SEQ ID NO: 30319 - protein, 9 aa, Artificial Sequence
  source: /note="Description of Artificial Sequence: Synthetic peptide"
GTEPLWTPK

SEQ ID NO: 30320 - protein, 10 aa, Artificial Sequence
  source: /note="Description of Artificial Sequence: Synthetic peptide"
RGTEPLWTPK

SEQ ID NO: 30321 - protein, 9 aa, Artificial Sequence
  source: /note="Description of Artificial Sequence: Synthetic peptide"
WGRNDRFNY

SEQ ID NO: 30322 - protein, 9 aa, Artificial Sequence
  source: /note="Description of Artificial Sequence: Synthetic peptide"
VCRFIGWGR

SEQ ID NO: 30323 - protein, 9 aa, Artificial Sequence
  source: /note="Description of Artificial Sequence: Synthetic peptide"
FIGWGRNDR

SEQ ID NO: 30324 - protein, 9 aa, Artificial Sequence
  source: /note="Description of Artificial Sequence: Synthetic peptide"
IGWGRNDRF

SEQ ID NO: 30325 - protein, 10 aa, Artificial Sequence
  source: /note="Description of Artificial Sequence: Synthetic peptide"
HVCRFIGWGR

SEQ ID NO: 30326 - protein, 10 aa, Artificial Sequence
  source: /note="Description of Artificial Sequence: Synthetic peptide"
GWGRNDRFNY

SEQ ID NO: 30327 - protein, 10 aa, Artificial Sequence
  source: /note="Description of Artificial Sequence: Synthetic peptide"
RFIGWGRNDR

SEQ ID NO: 30328 - protein, 10 aa, Artificial Sequence
  source: /note="Description of Artificial Sequence: Synthetic peptide"
FIGWGRNDRF

SEQ ID NO: 30329 - protein, 9 aa, Artificial Sequence
  source: /note="Description of Artificial Sequence: Synthetic peptide"
NMTTVSYLK

SEQ ID NO: 30330 - protein, 9 aa, Artificial Sequence
  source: /note="Description of Artificial Sequence: Synthetic peptide"
TVSYLKTQK

SEQ ID NO: 30331 - protein, 9 aa, Artificial Sequence
  source: /note="Description of Artificial Sequence: Synthetic peptide"
EGNMTTVSY

SEQ ID NO: 30332 - protein, 9 aa, Artificial Sequence
  source: /note="Description of Artificial Sequence: Synthetic peptide"
GNMTTVSYL

SEQ ID NO: 30333 - protein, 10 aa, Artificial Sequence
  source: /note="Description of Artificial Sequence: Synthetic peptide"
GNMTTVSYLK

SEQ ID NO: 30334 - protein, 10 aa, Artificial Sequence
  source: /note="Description of Artificial Sequence: Synthetic peptide"
TTVSYLKTQK

SEQ ID NO: 30335 - protein, 10 aa, Artificial Sequence
  source: /note="Description of Artificial Sequence: Synthetic peptide"
REGNMTTVSY

SEQ ID NO: 30336 - protein, 9 aa, Artificial Sequence
  source: /note="Description of Artificial Sequence: Synthetic peptide"
TLKDHRWAV

SEQ ID NO: 30337 - protein, 9 aa, Artificial Sequence
  source: /note="Description of Artificial Sequence: Synthetic peptide"
GLWKAVQLL

SEQ ID NO: 30338 - protein, 9 aa, Artificial Sequence
  source: /note="Description of Artificial Sequence: Synthetic peptide"
LVMIFQCPV

SEQ ID NO: 30339 - protein, 9 aa, Artificial Sequence
  source: /note="Description of Artificial Sequence: Synthetic peptide"
SLRKGSLRL

SEQ ID NO: 30340 - protein, 9 aa, Artificial Sequence
  source: /note="Description of Artificial Sequence: Synthetic peptide"
RLSKGHECL

SEQ ID NO: 30341 - protein, 9 aa, Artificial Sequence
  source: /note="Description of Artificial Sequence: Synthetic peptide"
RASRVHTLK

SEQ ID NO: 30342 - protein, 9 aa, Artificial Sequence
  source: /note="Description of Artificial Sequence: Synthetic peptide"
TVQRRSLRK

SEQ ID NO: 30343 - protein, 9 aa, Artificial Sequence
  source: /note="Description of Artificial Sequence: Synthetic peptide"
WAVRLGLWK

SEQ ID NO: 30344 - protein, 9 aa, Artificial Sequence
  source: /note="Description of Artificial Sequence: Synthetic peptide"
LWKAVQLLK

SEQ ID NO: 30345 - protein, 9 aa, Artificial Sequence
  source: /note="Description of Artificial Sequence: Synthetic peptide"
RSLRKGSLR

SEQ ID NO: 30346 - protein, 9 aa, Artificial Sequence
  source: /note="Description of Artificial Sequence: Synthetic peptide"
RWAVRLGLW

SEQ ID NO: 30347 - protein, 9 aa, Artificial Sequence
  source: /note="Description of Artificial Sequence: Synthetic peptide"
IFQCPVRTL

SEQ ID NO: 30348 - protein, 9 aa, Artificial Sequence
  source: /note="Description of Artificial Sequence: Synthetic peptide"
RTLRAHSLI

SEQ ID NO: 30349 - protein, 9 aa, Artificial Sequence
  source: /note="Description of Artificial Sequence: Synthetic peptide"
KNKSKKKRK

SEQ ID NO: 30350 - protein, 9 aa, Artificial Sequence
  source: /note="Description of Artificial Sequence: Synthetic peptide"
KKRKSPITR

SEQ ID NO: 30351 - protein, 9 aa, Artificial Sequence
  source: /note="Description of Artificial Sequence: Synthetic peptide"
KSPITRNLR

SEQ ID NO: 30352 - protein, 9 aa, Artificial Sequence
  source: /note="Description of Artificial Sequence: Synthetic peptide"
RNLRQWPCL

SEQ ID NO: 30353 - protein, 9 aa, Artificial Sequence
  source: /note="Description of Artificial Sequence: Synthetic peptide"
CLRASRVHT

SEQ ID NO: 30354 - protein, 9 aa, Artificial Sequence
  source: /note="Description of Artificial Sequence: Synthetic peptide"
RVHTLKDHR

SEQ ID NO: 30355 - protein, 9 aa, Artificial Sequence
  source: /note="Description of Artificial Sequence: Synthetic peptide"
HTLKDHRWA

SEQ ID NO: 30356 - protein, 9 aa, Artificial Sequence
  source: /note="Description of Artificial Sequence: Synthetic peptide"
AVRLGLWKA

SEQ ID NO: 30357 - protein, 9 aa, Artificial Sequence
  source: /note="Description of Artificial Sequence: Synthetic peptide"
GSRNPTVQR

SEQ ID NO: 30358 - protein, 9 aa, Artificial Sequence
  source: /note="Description of Artificial Sequence: Synthetic peptide"
NLRQWPCLR

SEQ ID NO: 30359 - protein, 9 aa, Artificial Sequence
  source: /note="Description of Artificial Sequence: Synthetic peptide"
QWPCLRASR

SEQ ID NO: 30360 - protein, 9 aa, Artificial Sequence
  source: /note="Description of Artificial Sequence: Synthetic peptide"
PTVQRRSLR

SEQ ID NO: 30361 - protein, 9 aa, Artificial Sequence
  source: /note="Description of Artificial Sequence: Synthetic peptide"
VMIFQCPVR

SEQ ID NO: 30362 - protein, 9 aa, Artificial Sequence
  source: /note="Description of Artificial Sequence: Synthetic peptide"
FQCPVRTLR

SEQ ID NO: 30363 - protein, 9 aa, Artificial Sequence
  source: /note="Description of Artificial Sequence: Synthetic peptide"
WPCLRASRV

SEQ ID NO: 30364 - protein, 9 aa, Artificial Sequence
  source: /note="Description of Artificial Sequence: Synthetic peptide"
NPTVQRRSL

SEQ ID NO: 30365 - protein, 9 aa, Artificial Sequence
  source: /note="Description of Artificial Sequence: Synthetic peptide"
SKKKRKSPI

SEQ ID NO: 30366 - protein, 9 aa, Artificial Sequence
  source: /note="Description of Artificial Sequence: Synthetic peptide"
LRASRVHTL

SEQ ID NO: 30367 - protein, 9 aa, Artificial Sequence
  source: /note="Description of Artificial Sequence: Synthetic peptide"
RKSPITRNL

SEQ ID NO: 30368 - protein, 9 aa, Artificial Sequence
  source: /note="Description of Artificial Sequence: Synthetic peptide"
RQWPCLRAS

SEQ ID NO: 30369 - protein, 9 aa, Artificial Sequence
  source: /note="Description of Artificial Sequence: Synthetic peptide"
HRWAVRLGL

SEQ ID NO: 30370 - protein, 9 aa, Artificial Sequence
  source: /note="Description of Artificial Sequence: Synthetic peptide"
SKGHECLVM

SEQ ID NO: 30371 - protein, 9 aa, Artificial Sequence
  source: /note="Description of Artificial Sequence: Synthetic peptide"
GHECLVMIF

SEQ ID NO: 30372 - protein, 9 aa, Artificial Sequence
  source: /note="Description of Artificial Sequence: Synthetic peptide"
VRTLRAHSL

SEQ ID NO: 30373 - protein, 9 aa, Artificial Sequence
  source: /note="Description of Artificial Sequence: Synthetic peptide"
CPVRTLRAH

SEQ ID NO: 30374 - protein, 9 aa, Artificial Sequence
  source: /note="Description of Artificial Sequence: Synthetic peptide"
KDHRWAVRL

SEQ ID NO: 30375 - protein, 10 aa, Artificial Sequence
  source: /note="Description of Artificial Sequence: Synthetic peptide"
RLSKGHECLV

SEQ ID NO: 30376 - protein, 10 aa, Artificial Sequence
  source: /note="Description of Artificial Sequence: Synthetic peptide"
CLVMIFQCPV

SEQ ID NO: 30377 - protein, 10 aa, Artificial Sequence
  source: /note="Description of Artificial Sequence: Synthetic peptide"
MIFQCPVRTL

SEQ ID NO: 30378 - protein, 10 aa, Artificial Sequence
  source: /note="Description of Artificial Sequence: Synthetic peptide"
CLRASRVHTL

SEQ ID NO: 30379 - protein, 10 aa, Artificial Sequence
  source: /note="Description of Artificial Sequence: Synthetic peptide"
LLKGSRNPTV

SEQ ID NO: 30380 - protein, 10 aa, Artificial Sequence
  source: /note="Description of Artificial Sequence: Synthetic peptide"
GLWKAVQLLK

SEQ ID NO: 30381 - protein, 10 aa, Artificial Sequence
  source: /note="Description of Artificial Sequence: Synthetic peptide"
RWAVRLGLWK

SEQ ID NO: 30382 - protein, 10 aa, Artificial Sequence
  source: /note="Description of Artificial Sequence: Synthetic peptide"
LVMIFQCPVR

SEQ ID NO: 30383 - protein, 10 aa, Artificial Sequence
  source: /note="Description of Artificial Sequence: Synthetic peptide"
KSKKKRKSPI

SEQ ID NO: 30384 - protein, 10 aa, Artificial Sequence
  source: /note="Description of Artificial Sequence: Synthetic peptide"
KKKRKSPITR

SEQ ID NO: 30385 - protein, 10 aa, Artificial Sequence
  source: /note="Description of Artificial Sequence: Synthetic peptide"
KRKSPITRNL

SEQ ID NO: 30386 - protein, 10 aa, Artificial Sequence
  source: /note="Description of Artificial Sequence: Synthetic peptide"
ITRNLRQWPC

SEQ ID NO: 30387 - protein, 10 aa, Artificial Sequence
  source: /note="Description of Artificial Sequence: Synthetic peptide"
RNLRQWPCLR

SEQ ID NO: 30388 - protein, 10 aa, Artificial Sequence
  source: /note="Description of Artificial Sequence: Synthetic peptide"
RQWPCLRASR

SEQ ID NO: 30389 - protein, 10 aa, Artificial Sequence
  source: /note="Description of Artificial Sequence: Synthetic peptide"
HTLKDHRWAV

SEQ ID NO: 30390 - protein, 10 aa, Artificial Sequence
  source: /note="Description of Artificial Sequence: Synthetic peptide"
TLKDHRWAVR

SEQ ID NO: 30391 - protein, 10 aa, Artificial Sequence
  source: /note="Description of Artificial Sequence: Synthetic peptide"
AVRLGLWKAV

SEQ ID NO: 30392 - protein, 10 aa, Artificial Sequence
  source: /note="Description of Artificial Sequence: Synthetic peptide"
GSRNPTVQRR

SEQ ID NO: 30393 - protein, 10 aa, Artificial Sequence
  source: /note="Description of Artificial Sequence: Synthetic peptide"
RSLRKGSLRL

SEQ ID NO: 30394 - protein, 10 aa, Artificial Sequence
  source: /note="Description of Artificial Sequence: Synthetic peptide"
SLRKGSLRLS

SEQ ID NO: 30395 - protein, 10 aa, Artificial Sequence
  source: /note="Description of Artificial Sequence: Synthetic peptide"
RTLRAHSLIQ

SEQ ID NO: 30396 - protein, 10 aa, Artificial Sequence
  source: /note="Description of Artificial Sequence: Synthetic peptide"
IFQCPVRTLR

SEQ ID NO: 30397 - protein, 10 aa, Artificial Sequence
  source: /note="Description of Artificial Sequence: Synthetic peptide"
LSKGHECLVM

SEQ ID NO: 30398 - protein, 10 aa, Artificial Sequence
  source: /note="Description of Artificial Sequence: Synthetic peptide"
RVHTLKDHRW

SEQ ID NO: 30399 - protein, 10 aa, Artificial Sequence
  source: /note="Description of Artificial Sequence: Synthetic peptide"
HRWAVRLGLW

SEQ ID NO: 30400 - protein, 10 aa, Artificial Sequence
  source: /note="Description of Artificial Sequence: Synthetic peptide"
LRLSKGHECL

SEQ ID NO: 30401 - protein, 10 aa, Artificial Sequence
  source: /note="Description of Artificial Sequence: Synthetic peptide"
KGHECLVMIF

SEQ ID NO: 30402 - protein, 10 aa, Artificial Sequence
  source: /note="Description of Artificial Sequence: Synthetic peptide"
FQCPVRTLRA

SEQ ID NO: 30403 - protein, 10 aa, Artificial Sequence
  source: /note="Description of Artificial Sequence: Synthetic peptide"
SPITRNLRQW

SEQ ID NO: 30404 - protein, 9 aa, Artificial Sequence
  source: /note="Description of Artificial Sequence: Synthetic peptide"
RGVAIKFGK

SEQ ID NO: 30405 - protein, 9 aa, Artificial Sequence
  source: /note="Description of Artificial Sequence: Synthetic peptide"
RFKEFKARG

SEQ ID NO: 30406 - protein, 9 aa, Artificial Sequence
  source: /note="Description of Artificial Sequence: Synthetic peptide"
KARGVAIKF

SEQ ID NO: 30407 - protein, 9 aa, Artificial Sequence
  source: /note="Description of Artificial Sequence: Synthetic peptide"
EFKARGVAI

SEQ ID NO: 30408 - protein, 9 aa, Artificial Sequence
  source: /note="Description of Artificial Sequence: Synthetic peptide"
KEFKARGVA

SEQ ID NO: 30409 - protein, 10 aa, Artificial Sequence
  source: /note="Description of Artificial Sequence: Synthetic peptide"
RFKEFKARGV

SEQ ID NO: 30410 - protein, 10 aa, Artificial Sequence
  source: /note="Description of Artificial Sequence: Synthetic peptide"
EFKARGVAIK

SEQ ID NO: 30411 - protein, 10 aa, Artificial Sequence
  source: /note="Description of Artificial Sequence: Synthetic peptide"
KARGVAIKFG

SEQ ID NO: 30412 - protein, 10 aa, Artificial Sequence
  source: /note="Description of Artificial Sequence: Synthetic peptide"
KEFKARGVAI

SEQ ID NO: 30413 - protein, 10 aa, Artificial Sequence
  source: /note="Description of Artificial Sequence: Synthetic peptide"
FKARGVAIKF

SEQ ID NO: 30414 - protein, 10 aa, Artificial Sequence
  source: /note="Description of Artificial Sequence: Synthetic peptide"
RGVAIKFGKF

SEQ ID NO: 30415 - protein, 9 aa, Artificial Sequence
  source: /note="Description of Artificial Sequence: Synthetic peptide"
KLQACASWA

SEQ ID NO: 30416 - protein, 9 aa, Artificial Sequence
  source: /note="Description of Artificial Sequence: Synthetic peptide"
LQACASWAV

SEQ ID NO: 30417 - protein, 9 aa, Artificial Sequence
  source: /note="Description of Artificial Sequence: Synthetic peptide"
CKLQACASW

SEQ ID NO: 30418 - protein, 9 aa, Artificial Sequence
  source: /note="Description of Artificial Sequence: Synthetic peptide"
SWAVTGTPI

SEQ ID NO: 30419 - protein, 10 aa, Artificial Sequence
  source: /note="Description of Artificial Sequence: Synthetic peptide"
KLQACASWAV

SEQ ID NO: 30420 - protein, 10 aa, Artificial Sequence
  source: /note="Description of Artificial Sequence: Synthetic peptide"
LQACASWAVT

SEQ ID NO: 30421 - protein, 10 aa, Artificial Sequence
  source: /note="Description of Artificial Sequence: Synthetic peptide"
ASWAVTGTPI

SEQ ID NO: 30422 - protein, 9 aa, Artificial Sequence
  source: /note="Description of Artificial Sequence: Synthetic peptide"
SLNLHHLAL

SEQ ID NO: 30423 - protein, 9 aa, Artificial Sequence
  source: /note="Description of Artificial Sequence: Synthetic peptide"
GISLNLHHL

SEQ ID NO: 30424 - protein, 9 aa, Artificial Sequence
  source: /note="Description of Artificial Sequence: Synthetic peptide"
LHHLALHPH

SEQ ID NO: 30425 - protein, 10 aa, Artificial Sequence
  source: /note="Description of Artificial Sequence: Synthetic peptide"
GISLNLHHLA

SEQ ID NO: 30426 - protein, 10 aa, Artificial Sequence
  source: /note="Description of Artificial Sequence: Synthetic peptide"
ISLNLHHLAL

SEQ ID NO: 30427 - protein, 9 aa, Artificial Sequence
  source: /note="Description of Artificial Sequence: Synthetic peptide"
AAKAEAEAK

SEQ ID NO: 30428 - protein, 9 aa, Artificial Sequence
  source: /note="Description of Artificial Sequence: Synthetic peptide"
EAKATAETV

SEQ ID NO: 30429 - protein, 9 aa, Artificial Sequence
  source: /note="Description of Artificial Sequence: Synthetic peptide"
AEAEAKATA

SEQ ID NO: 30430 - protein, 9 aa, Artificial Sequence
  source: /note="Description of Artificial Sequence: Synthetic peptide"
AKATAETVA

SEQ ID NO: 30431 - protein, 9 aa, Artificial Sequence
  source: /note="Description of Artificial Sequence: Synthetic peptide"
AEAKATAET

SEQ ID NO: 30432 - protein, 10 aa, Artificial Sequence
  source: /note="Description of Artificial Sequence: Synthetic peptide"
AAAKAEAEAK

SEQ ID NO: 30433 - protein, 10 aa, Artificial Sequence
  source: /note="Description of Artificial Sequence: Synthetic peptide"
AEAKATAETV

SEQ ID NO: 30434 - protein, 9 aa, Artificial Sequence
  source: /note="Description of Artificial Sequence: Synthetic peptide"
TVLPHIWKV

SEQ ID NO: 30435 - protein, 9 aa, Artificial Sequence
  source: /note="Description of Artificial Sequence: Synthetic peptide"
SIRTVLPHI

SEQ ID NO: 30436 - protein, 9 aa, Artificial Sequence
  source: /note="Description of Artificial Sequence: Synthetic peptide"
RTVLPHIWK

SEQ ID NO: 30437 - protein, 9 aa, Artificial Sequence
  source: /note="Description of Artificial Sequence: Synthetic peptide"
TSIRTVLPH

SEQ ID NO: 30438 - protein, 10 aa, Artificial Sequence
  source: /note="Description of Artificial Sequence: Synthetic peptide"
KTSIRTVLPH

SEQ ID NO: 30439 - protein, 10 aa, Artificial Sequence
  source: /note="Description of Artificial Sequence: Synthetic peptide"
RTVLPHIWKV

SEQ ID NO: 30440 - protein, 10 aa, Artificial Sequence
  source: /note="Description of Artificial Sequence: Synthetic peptide"
TSIRTVLPHI

SEQ ID NO: 30441 - protein, 10 aa, Artificial Sequence
  source: /note="Description of Artificial Sequence: Synthetic peptide"
SIRTVLPHIW

SEQ ID NO: 30442 - protein, 10 aa, Artificial Sequence
  source: /note="Description of Artificial Sequence: Synthetic peptide"
LPHIWKVPDV

SEQ ID NO: 30443 - protein, 9 aa, Artificial Sequence
  source: /note="Description of Artificial Sequence: Synthetic peptide"
LQLGFLAII

SEQ ID NO: 30444 - protein, 9 aa, Artificial Sequence
  source: /note="Description of Artificial Sequence: Synthetic peptide"
ELQLGFLAI

SEQ ID NO: 30445 - protein, 9 aa, Artificial Sequence
  source: /note="Description of Artificial Sequence: Synthetic peptide"
VNGELQLGF

SEQ ID NO: 30446 - protein, 9 aa, Artificial Sequence
  source: /note="Description of Artificial Sequence: Synthetic peptide"
GELQLGFLA

SEQ ID NO: 30447 - protein, 10 aa, Artificial Sequence
  source: /note="Description of Artificial Sequence: Synthetic peptide"
RVNGELQLGF

SEQ ID NO: 30448 - protein, 10 aa, Artificial Sequence
  source: /note="Description of Artificial Sequence: Synthetic peptide"
GELQLGFLAI

SEQ ID NO: 30449 - protein, 9 aa, Artificial Sequence
  source: /note="Description of Artificial Sequence: Synthetic peptide"
AIYPAPPGL

SEQ ID NO: 30450 - protein, 9 aa, Artificial Sequence
  source: /note="Description of Artificial Sequence: Synthetic peptide"
GLHGRGGAL

SEQ ID NO: 30451 - protein, 9 aa, Artificial Sequence
  source: /note="Description of Artificial Sequence: Synthetic peptide"
HGRGGALQL

SEQ ID NO: 30452 - protein, 9 aa, Artificial Sequence
  source: /note="Description of Artificial Sequence: Synthetic peptide"
LQLHPDHPH

SEQ ID NO: 30453 - protein, 10 aa, Artificial Sequence
  source: /note="Description of Artificial Sequence: Synthetic peptide"
FAIYPAPPGL

SEQ ID NO: 30454 - protein, 10 aa, Artificial Sequence
  source: /note="Description of Artificial Sequence: Synthetic peptide"
AIYPAPPGLH

SEQ ID NO: 30455 - protein, 10 aa, Artificial Sequence
  source: /note="Description of Artificial Sequence: Synthetic peptide"
LEFAIYPAPP

SEQ ID NO: 30456 - protein, 10 aa, Artificial Sequence
  source: /note="Description of Artificial Sequence: Synthetic peptide"
LHGRGGALQL

SEQ ID NO: 30457 - protein, 9 aa, Artificial Sequence
  source: /note="Description of Artificial Sequence: Synthetic peptide"
LQFDGALNV

SEQ ID NO: 30458 - protein, 9 aa, Artificial Sequence
  source: /note="Description of Artificial Sequence: Synthetic peptide"
SSITASLQF

SEQ ID NO: 30459 - protein, 9 aa, Artificial Sequence
  source: /note="Description of Artificial Sequence: Synthetic peptide"
ASLQFDGAL

SEQ ID NO: 30460 - protein, 10 aa, Artificial Sequence
  source: /note="Description of Artificial Sequence: Synthetic peptide"
SLQFDGALNV

SEQ ID NO: 30461 - protein, 10 aa, Artificial Sequence
  source: /note="Description of Artificial Sequence: Synthetic peptide"
ITASLQFDGA

SEQ ID NO: 30462 - protein, 10 aa, Artificial Sequence
  source: /note="Description of Artificial Sequence: Synthetic peptide"
VSSITASLQF

SEQ ID NO: 30463 - protein, 10 aa, Artificial Sequence
  source: /note="Description of Artificial Sequence: Synthetic peptide"
LQFDGALNVD

SEQ ID NO: 30464 - protein, 9 aa, Artificial Sequence
  source: /note="Description of Artificial Sequence: Synthetic peptide"
ASGGRYMPR

SEQ ID NO: 30465 - protein, 9 aa, Artificial Sequence
  source: /note="Description of Artificial Sequence: Synthetic peptide"
RYMPRAVLV

SEQ ID NO: 30466 - protein, 9 aa, Artificial Sequence
  source: /note="Description of Artificial Sequence: Synthetic peptide"
GGRYMPRAV

SEQ ID NO: 30467 - protein, 9 aa, Artificial Sequence
  source: /note="Description of Artificial Sequence: Synthetic peptide"
MPRAVLVDL

SEQ ID NO: 30468 - protein, 9 aa, Artificial Sequence
  source: /note="Description of Artificial Sequence: Synthetic peptide"
HEASGGRYM

SEQ ID NO: 30469 - protein, 9 aa, Artificial Sequence
  source: /note="Description of Artificial Sequence: Synthetic peptide"
GRYMPRAVL

SEQ ID NO: 30470 - protein, 10 aa, Artificial Sequence
  source: /note="Description of Artificial Sequence: Synthetic peptide"
YMPRAVLVDL

SEQ ID NO: 30471 - protein, 10 aa, Artificial Sequence
  source: /note="Description of Artificial Sequence: Synthetic peptide"
EASGGRYMPR

SEQ ID NO: 30472 - protein, 10 aa, Artificial Sequence
  source: /note="Description of Artificial Sequence: Synthetic peptide"
HHEASGGRYM

SEQ ID NO: 30473 - protein, 9 aa, Artificial Sequence
  source: /note="Description of Artificial Sequence: Synthetic peptide"
MDSVHSGPF

SEQ ID NO: 30474 - protein, 9 aa, Artificial Sequence
  source: /note="Description of Artificial Sequence: Synthetic peptide"
HSGPFGQVL

SEQ ID NO: 30475 - protein, 10 aa, Artificial Sequence
  source: /note="Description of Artificial Sequence: Synthetic peptide"
SVHSGPFGQV

SEQ ID NO: 30476 - protein, 10 aa, Artificial Sequence
  source: /note="Description of Artificial Sequence: Synthetic peptide"
HSGPFGQVLR

SEQ ID NO: 30477 - protein, 10 aa, Artificial Sequence
  source: /note="Description of Artificial Sequence: Synthetic peptide"
TMDSVHSGPF

SEQ ID NO: 30478 - protein, 10 aa, Artificial Sequence
  source: /note="Description of Artificial Sequence: Synthetic peptide"
VHSGPFGQVL

SEQ ID NO: 30479 - protein, 9 aa, Artificial Sequence
  source: /note="Description of Artificial Sequence: Synthetic peptide"
HLYRSSDVL

SEQ ID NO: 30480 - protein, 9 aa, Artificial Sequence
  source: /note="Description of Artificial Sequence: Synthetic peptide"
RSSDVLLLH

SEQ ID NO: 30481 - protein, 9 aa, Artificial Sequence
  source: /note="Description of Artificial Sequence: Synthetic peptide"
LYRSSDVLL

SEQ ID NO: 30482 - protein, 9 aa, Artificial Sequence
  source: /note="Description of Artificial Sequence: Synthetic peptide"
YRSSDVLLL

SEQ ID NO: 30483 - protein, 10 aa, Artificial Sequence
  source: /note="Description of Artificial Sequence: Synthetic peptide"
HLYRSSDVLL

SEQ ID NO: 30484 - protein, 10 aa, Artificial Sequence
  source: /note="Description of Artificial Sequence: Synthetic peptide"
VLLLHENDAI

SEQ ID NO: 30485 - protein, 10 aa, Artificial Sequence
  source: /note="Description of Artificial Sequence: Synthetic peptide"
LYRSSDVLLL

SEQ ID NO: 30486 - protein, 10 aa, Artificial Sequence
  source: /note="Description of Artificial Sequence: Synthetic peptide"
SHLYRSSDVL

SEQ ID NO: 30487 - protein, 9 aa, Artificial Sequence
  source: /note="Description of Artificial Sequence: Synthetic peptide"
TTIQELKEK

SEQ ID NO: 30488 - protein, 9 aa, Artificial Sequence
  source: /note="Description of Artificial Sequence: Synthetic peptide"
SKDTTIQEL

SEQ ID NO: 30489 - protein, 10 aa, Artificial Sequence
  source: /note="Description of Artificial Sequence: Synthetic peptide"
AVIQSKDTTI

SEQ ID NO: 30490 - protein, 9 aa, Artificial Sequence
  source: /note="Description of Artificial Sequence: Synthetic peptide"
IIKVYFKGR

SEQ ID NO: 30491 - protein, 9 aa, Artificial Sequence
  source: /note="Description of Artificial Sequence: Synthetic peptide"
KVYFKGRSG

SEQ ID NO: 30492 - protein, 9 aa, Artificial Sequence
  source: /note="Description of Artificial Sequence: Synthetic peptide"
YFKGRSGDK

SEQ ID NO: 30493 - protein, 9 aa, Artificial Sequence
  source: /note="Description of Artificial Sequence: Synthetic peptide"
FKGRSGDKM

SEQ ID NO: 30494 - protein, 9 aa, Artificial Sequence
  source: /note="Description of Artificial Sequence: Synthetic peptide"
HEEIIKVYF

SEQ ID NO: 30495 - protein, 10 aa, Artificial Sequence
  source: /note="Description of Artificial Sequence: Synthetic peptide"
VYFKGRSGDK

SEQ ID NO: 30496 - protein, 10 aa, Artificial Sequence
  source: /note="Description of Artificial Sequence: Synthetic peptide"
EIIKVYFKGR

SEQ ID NO: 30497 - protein, 9 aa, Artificial Sequence
  source: /note="Description of Artificial Sequence: Synthetic peptide"
SSGYQSDQK

SEQ ID NO: 30498 - protein, 9 aa, Artificial Sequence
  source: /note="Description of Artificial Sequence: Synthetic peptide"
FIMYATIQT

SEQ ID NO: 30499 - protein, 9 aa, Artificial Sequence
  source: /note="Description of Artificial Sequence: Synthetic peptide"
IQTESIRWL

SEQ ID NO: 30500 - protein, 9 aa, Artificial Sequence
  source: /note="Description of Artificial Sequence: Synthetic peptide"
QTESIRWLI

SEQ ID NO: 30501 - protein, 9 aa, Artificial Sequence
  source: /note="Description of Artificial Sequence: Synthetic peptide"
YATIQTESI

SEQ ID NO: 30502 - protein, 9 aa, Artificial Sequence
  source: /note="Description of Artificial Sequence: Synthetic peptide"
IMYATIQTE

SEQ ID NO: 30503 - protein, 10 aa, Artificial Sequence
  source: /note="Description of Artificial Sequence: Synthetic peptide"
IQTESIRWLI

SEQ ID NO: 30504 - protein, 10 aa, Artificial Sequence
  source: /note="Description of Artificial Sequence: Synthetic peptide"
IMYATIQTES

SEQ ID NO: 30505 - protein, 10 aa, Artificial Sequence
  source: /note="Description of Artificial Sequence: Synthetic peptide"
MYATIQTESI

SEQ ID NO: 30506 - protein, 9 aa, Artificial Sequence
  source: /note="Description of Artificial Sequence: Synthetic peptide"
GIVPLCYVK

SEQ ID NO: 30507 - protein, 9 aa, Artificial Sequence
  source: /note="Description of Artificial Sequence: Synthetic peptide"
IVPLCYVKF

SEQ ID NO: 30508 - protein, 9 aa, Artificial Sequence
  source: /note="Description of Artificial Sequence: Synthetic peptide"
DGIVPLCYV

SEQ ID NO: 30509 - protein, 10 aa, Artificial Sequence
  source: /note="Description of Artificial Sequence: Synthetic peptide"
KEDGIVPLCY

SEQ ID NO: 30510 - protein, 10 aa, Artificial Sequence
  source: /note="Description of Artificial Sequence: Synthetic peptide"
GIVPLCYVKF

SEQ ID NO: 30511 - protein, 9 aa, Artificial Sequence
  source: /note="Description of Artificial Sequence: Synthetic peptide"
TVSETQWKV

SEQ ID NO: 30512 - protein, 9 aa, Artificial Sequence
  source: /note="Description of Artificial Sequence: Synthetic peptide"
ESMTLLFEV

SEQ ID NO: 30513 - protein, 9 aa, Artificial Sequence
  source: /note="Description of Artificial Sequence: Synthetic peptide"
TLLFEVFTI

SEQ ID NO: 30514 - protein, 9 aa, Artificial Sequence
  source: /note="Description of Artificial Sequence: Synthetic peptide"
STVSETQWK

SEQ ID NO: 30515 - protein, 9 aa, Artificial Sequence
  source: /note="Description of Artificial Sequence: Synthetic peptide"
SMTLLFEVF

SEQ ID NO: 30516 - protein, 9 aa, Artificial Sequence
  source: /note="Description of Artificial Sequence: Synthetic peptide"
EVFTIWLIY

SEQ ID NO: 30517 - protein, 9 aa, Artificial Sequence
  source: /note="Description of Artificial Sequence: Synthetic peptide"
QWKVTVTPR

SEQ ID NO: 30518 - protein, 9 aa, Artificial Sequence
  source: /note="Description of Artificial Sequence: Synthetic peptide"
MTLLFEVFT

SEQ ID NO: 30519 - protein, 9 aa, Artificial Sequence
  source: /note="Description of Artificial Sequence: Synthetic peptide"
TPRESMTLL

SEQ ID NO: 30520 - protein, 9 aa, Artificial Sequence
  source: /note="Description of Artificial Sequence: Synthetic peptide"
SETQWKVTV

SEQ ID NO: 30521 - protein, 9 aa, Artificial Sequence
  source: /note="Description of Artificial Sequence: Synthetic peptide"
TQWKVTVTP

SEQ ID NO: 30522 - protein, 9 aa, Artificial Sequence
  source: /note="Description of Artificial Sequence: Synthetic peptide"
LLFEVFTIW

SEQ ID NO: 30523 - protein, 9 aa, Artificial Sequence
  source: /note="Description of Artificial Sequence: Synthetic peptide"
FEVFTIWLI

SEQ ID NO: 30524 - protein, 10 aa, Artificial Sequence
  source: /note="Description of Artificial Sequence: Synthetic peptide"
MTLLFEVFTI

SEQ ID NO: 30525 - protein, 10 aa, Artificial Sequence
  source: /note="Description of Artificial Sequence: Synthetic peptide"
LLFEVFTIWL

SEQ ID NO: 30526 - protein, 10 aa, Artificial Sequence
  source: /note="Description of Artificial Sequence: Synthetic peptide"
STVSETQWKV

SEQ ID NO: 30527 - protein, 10 aa, Artificial Sequence
  source: /note="Description of Artificial Sequence: Synthetic peptide"
TQWKVTVTPR

SEQ ID NO: 30528 - protein, 10 aa, Artificial Sequence
  source: /note="Description of Artificial Sequence: Synthetic peptide"
ESMTLLFEVF

SEQ ID NO: 30529 - protein, 10 aa, Artificial Sequence
  source: /note="Description of Artificial Sequence: Synthetic peptide"
TLLFEVFTIW

SEQ ID NO: 30530 - protein, 10 aa, Artificial Sequence
  source: /note="Description of Artificial Sequence: Synthetic peptide"
LFEVFTIWLI

SEQ ID NO: 30531 - protein, 10 aa, Artificial Sequence
  source: /note="Description of Artificial Sequence: Synthetic peptide"
KVTVTPRESM

SEQ ID NO: 30532 - protein, 10 aa, Artificial Sequence
  source: /note="Description of Artificial Sequence: Synthetic peptide"
EVFTIWLIYS

SEQ ID NO: 30533 - protein, 10 aa, Artificial Sequence
  source: /note="Description of Artificial Sequence: Synthetic peptide"
TPRESMTLLF

SEQ ID NO: 30534 - protein, 10 aa, Artificial Sequence
  source: /note="Description of Artificial Sequence: Synthetic peptide"
RESMTLLFEV

SEQ ID NO: 30535 - protein, 10 aa, Artificial Sequence
  source: /note="Description of Artificial Sequence: Synthetic peptide"
FEVFTIWLIY

SEQ ID NO: 30536 - protein, 10 aa, Artificial Sequence
  source: /note="Description of Artificial Sequence: Synthetic peptide"
SETQWKVTVT

SEQ ID NO: 30537 - protein, 10 aa, Artificial Sequence
  source: /note="Description of Artificial Sequence: Synthetic peptide"
TPPFYSNSTV

SEQ ID NO: 30538 - protein, 9 aa, Artificial Sequence
  source: /note="Description of Artificial Sequence: Synthetic peptide"
YRLHNKPTF

SEQ ID NO: 30539 - protein, 10 aa, Artificial Sequence
  source: /note="Description of Artificial Sequence: Synthetic peptide"
CYRLHNKPTF

SEQ ID NO: 30540 - protein, 10 aa, Artificial Sequence
  source: /note="Description of Artificial Sequence: Synthetic peptide"
GDRCYRLHNK

SEQ ID NO: 30541 - protein, 10 aa, Artificial Sequence
  source: /note="Description of Artificial Sequence: Synthetic peptide"
GACRHGDRCY

SEQ ID NO: 30542 - protein, 9 aa, Artificial Sequence
  source: /note="Description of Artificial Sequence: Synthetic peptide"
FRLHNKPTF

SEQ ID NO: 30543 - protein, 10 aa, Artificial Sequence
  source: /note="Description of Artificial Sequence: Synthetic peptide"
CFRLHNKPTF

SEQ ID NO: 30544 - protein, 10 aa, Artificial Sequence
  source: /note="Description of Artificial Sequence: Synthetic peptide"
ACRHGDRCFR

SEQ ID NO: 30545 - protein, 10 aa, Artificial Sequence
  source: /note="Description of Artificial Sequence: Synthetic peptide"
GDRCFRLHNK

SEQ ID NO: 30546 - protein, 10 aa, Artificial Sequence
  source: /note="Description of Artificial Sequence: Synthetic peptide"
GACRHGDRCF

SEQ ID NO: 30547 - protein, 9 aa, Artificial Sequence
  source: /note="Description of Artificial Sequence: Synthetic peptide"
SLHFPFNKV

SEQ ID NO: 30548 - protein, 9 aa, Artificial Sequence
  source: /note="Description of Artificial Sequence: Synthetic peptide"
HLVLRLRGV

SEQ ID NO: 30549 - protein, 9 aa, Artificial Sequence
  source: /note="Description of Artificial Sequence: Synthetic peptide"
LLRFQQISL

SEQ ID NO: 30550 - protein, 9 aa, Artificial Sequence
  source: /note="Description of Artificial Sequence: Synthetic peptide"
VLRLRGVSK

SEQ ID NO: 30551 - protein, 9 aa, Artificial Sequence
  source: /note="Description of Artificial Sequence: Synthetic peptide"
GVSKFPLLR

SEQ ID NO: 30552 - protein, 9 aa, Artificial Sequence
  source: /note="Description of Artificial Sequence: Synthetic peptide"
ISLHFPFNK

SEQ ID NO: 30553 - protein, 9 aa, Artificial Sequence
  source: /note="Description of Artificial Sequence: Synthetic peptide"
RFQQISLHF

SEQ ID NO: 30554 - protein, 9 aa, Artificial Sequence
  source: /note="Description of Artificial Sequence: Synthetic peptide"
QQISLHFPF

SEQ ID NO: 30555 - protein, 9 aa, Artificial Sequence
  source: /note="Description of Artificial Sequence: Synthetic peptide"
RLRGVSKFP

SEQ ID NO: 30556 - protein, 9 aa, Artificial Sequence
  source: /note="Description of Artificial Sequence: Synthetic peptide"
RGVSKFPLL

SEQ ID NO: 30557 - protein, 9 aa, Artificial Sequence
  source: /note="Description of Artificial Sequence: Synthetic peptide"
FPLLRFQQI

SEQ ID NO: 30558 - protein, 9 aa, Artificial Sequence
  source: /note="Description of Artificial Sequence: Synthetic peptide"
FPFNKVVAF

SEQ ID NO: 30559 - protein, 9 aa, Artificial Sequence
  source: /note="Description of Artificial Sequence: Synthetic peptide"
LRLRGVSKF

SEQ ID NO: 30560 - protein, 9 aa, Artificial Sequence
  source: /note="Description of Artificial Sequence: Synthetic peptide"
LRGVSKFPL

SEQ ID NO: 30561 - protein, 9 aa, Artificial Sequence
  source: /note="Description of Artificial Sequence: Synthetic peptide"
VSKFPLLRF

SEQ ID NO: 30562 - protein, 9 aa, Artificial Sequence
  source: /note="Description of Artificial Sequence: Synthetic peptide"
LHFPFNKVV

SEQ ID NO: 30563 - protein, 10 aa, Artificial Sequence
  source: /note="Description of Artificial Sequence: Synthetic peptide"
RLRGVSKFPL

SEQ ID NO: 30564 - protein, 10 aa, Artificial Sequence
  source: /note="Description of Artificial Sequence: Synthetic peptide"
SLHFPFNKVV

SEQ ID NO: 30565 - protein, 10 aa, Artificial Sequence
  source: /note="Description of Artificial Sequence: Synthetic peptide"
LVLRLRGVSK

SEQ ID NO: 30566 - protein, 10 aa, Artificial Sequence
  source: /note="Description of Artificial Sequence: Synthetic peptide"
QISLHFPFNK

SEQ ID NO: 30567 - protein, 10 aa, Artificial Sequence
  source: /note="Description of Artificial Sequence: Synthetic peptide"
KFPLLRFQQI

SEQ ID NO: 30568 - protein, 10 aa, Artificial Sequence
  source: /note="Description of Artificial Sequence: Synthetic peptide"
FQQISLHFPF

SEQ ID NO: 30569 - protein, 10 aa, Artificial Sequence
  source: /note="Description of Artificial Sequence: Synthetic peptide"
HFPFNKVVAF

SEQ ID NO: 30570 - protein, 10 aa, Artificial Sequence
  source: /note="Description of Artificial Sequence: Synthetic peptide"
RGVSKFPLLR

SEQ ID NO: 30571 - protein, 10 aa, Artificial Sequence
  source: /note="Description of Artificial Sequence: Synthetic peptide"
ISLHFPFNKV

SEQ ID NO: 30572 - protein, 10 aa, Artificial Sequence
  source: /note="Description of Artificial Sequence: Synthetic peptide"
VLRLRGVSKF

SEQ ID NO: 30573 - protein, 10 aa, Artificial Sequence
  source: /note="Description of Artificial Sequence: Synthetic peptide"
GVSKFPLLRF

SEQ ID NO: 30574 - protein, 10 aa, Artificial Sequence
  source: /note="Description of Artificial Sequence: Synthetic peptide"
LRFQQISLHF

SEQ ID NO: 30575 - protein, 10 aa, Artificial Sequence
  source: /note="Description of Artificial Sequence: Synthetic peptide"
LHFPFNKVVA

SEQ ID NO: 30576 - protein, 10 aa, Artificial Sequence
  source: /note="Description of Artificial Sequence: Synthetic peptide"
FPLLRFQQIS

SEQ ID NO: 30577 - protein, 9 aa, Artificial Sequence
  source: /note="Description of Artificial Sequence: Synthetic peptide"
TSRGSSLQA

SEQ ID NO: 30578 - protein, 9 aa, Artificial Sequence
  source: /note="Description of Artificial Sequence: Synthetic peptide"
PPTSRGSSL

SEQ ID NO: 30579 - protein, 10 aa, Artificial Sequence
  source: /note="Description of Artificial Sequence: Synthetic peptide"
IPPTSRGSSL

SEQ ID NO: 30580 - protein, 10 aa, Artificial Sequence
  source: /note="Description of Artificial Sequence: Synthetic peptide"
IQDKEGIPPT

SEQ ID NO: 30581 - protein, 9 aa, Artificial Sequence
  source: /note="Description of Artificial Sequence: Synthetic peptide"
VPDWETHLV

SEQ ID NO: 30582 - protein, 10 aa, Artificial Sequence
  source: /note="Description of Artificial Sequence: Synthetic peptide"
VVPDWETHLV

SEQ ID NO: 30583 - protein, 10 aa, Artificial Sequence
  source: /note="Description of Artificial Sequence: Synthetic peptide"
DVVPDWETHL

SEQ ID NO: 30584 - protein, 10 aa, Artificial Sequence
  source: /note="Description of Artificial Sequence: Synthetic peptide"
WETHLVQNGI

SEQ ID NO: 30585 - protein, 10 aa, Artificial Sequence
  source: /note="Description of Artificial Sequence: Synthetic peptide"
LPLPDVVPDW

SEQ ID NO: 30586 - protein, 9 aa, Artificial Sequence
  source: /note="Description of Artificial Sequence: Synthetic peptide"
NSIIYDLQY

SEQ ID NO: 30587 - protein, 9 aa, Artificial Sequence
  source: /note="Description of Artificial Sequence: Synthetic peptide"
SIIYDLQYL

SEQ ID NO: 30588 - protein, 9 aa, Artificial Sequence
  source: /note="Description of Artificial Sequence: Synthetic peptide"
TINSIIYDL

SEQ ID NO: 30589 - protein, 9 aa, Artificial Sequence
  source: /note="Description of Artificial Sequence: Synthetic peptide"
IIYDLQYLF

SEQ ID NO: 30590 - protein, 9 aa, Artificial Sequence
  source: /note="Description of Artificial Sequence: Synthetic peptide"
IYDLQYLFL

SEQ ID NO: 30591 - protein, 10 aa, Artificial Sequence
  source: /note="Description of Artificial Sequence: Synthetic peptide"
IIYDLQYLFL

SEQ ID NO: 30592 - protein, 10 aa, Artificial Sequence
  source: /note="Description of Artificial Sequence: Synthetic peptide"
SIIYDLQYLF

SEQ ID NO: 30593 - protein, 10 aa, Artificial Sequence
  source: /note="Description of Artificial Sequence: Synthetic peptide"
INSIIYDLQY

SEQ ID NO: 30594 - protein, 10 aa, Artificial Sequence
  source: /note="Description of Artificial Sequence: Synthetic peptide"
LTINSIIYDL

SEQ ID NO: 30595 - protein, 10 aa, Artificial Sequence
  source: /note="Description of Artificial Sequence: Synthetic peptide"
NSIIYDLQYL

SEQ ID NO: 30596 - protein, 9 aa, Artificial Sequence
  source: /note="Description of Artificial Sequence: Synthetic peptide"
EIISLDILK

SEQ ID NO: 30597 - protein, 9 aa, Artificial Sequence
  source: /note="Description of Artificial Sequence: Synthetic peptide"
HPNVDKLEI

SEQ ID NO: 30598 - protein, 9 aa, Artificial Sequence
  source: /note="Description of Artificial Sequence: Synthetic peptide"
LEIISLDIL

SEQ ID NO: 30599 - protein, 10 aa, Artificial Sequence
  source: /note="Description of Artificial Sequence: Synthetic peptide"
HPNVDKLEII

SEQ ID NO: 30600 - protein, 9 aa, Artificial Sequence
  source: /note="Description of Artificial Sequence: Synthetic peptide"
SMTQLVRRA

SEQ ID NO: 30601 - protein, 9 aa, Artificial Sequence
  source: /note="Description of Artificial Sequence: Synthetic peptide"
TQLVRRAPR

SEQ ID NO: 30602 - protein, 9 aa, Artificial Sequence
  source: /note="Description of Artificial Sequence: Synthetic peptide"
LVRRAPRGL

SEQ ID NO: 30603 - protein, 10 aa, Artificial Sequence
  source: /note="Description of Artificial Sequence: Synthetic peptide"
MTQLVRRAPR

SEQ ID NO: 30604 - protein, 9 aa, Artificial Sequence
  source: /note="Description of Artificial Sequence: Synthetic peptide"
GTGNLVNTY

SEQ ID NO: 30605 - protein, 9 aa, Artificial Sequence
  source: /note="Description of Artificial Sequence: Synthetic peptide"
AVHGTGNLV

SEQ ID NO: 30606 - protein, 9 aa, Artificial Sequence
  source: /note="Description of Artificial Sequence: Synthetic peptide"
TGNLVNTYY

SEQ ID NO: 30607 - protein, 10 aa, Artificial Sequence
  source: /note="Description of Artificial Sequence: Synthetic peptide"
GTGNLVNTYY

SEQ ID NO: 30608 - protein, 10 aa, Artificial Sequence
  source: /note="Description of Artificial Sequence: Synthetic peptide"
VLAVHGTGNL

SEQ ID NO: 30609 - protein, 10 aa, Artificial Sequence
  source: /note="Description of Artificial Sequence: Synthetic peptide"
HGTGNLVNTY

SEQ ID NO: 30610 - protein, 10 aa, Artificial Sequence
  source: /note="Description of Artificial Sequence: Synthetic peptide"
LAVHGTGNLV

SEQ ID NO: 30611 - protein, 9 aa, Artificial Sequence
  source: /note="Description of Artificial Sequence: Synthetic peptide"
HMDCLTGPL

SEQ ID NO: 30612 - protein, 10 aa, Artificial Sequence
  source: /note="Description of Artificial Sequence: Synthetic peptide"
LTGPLSHEQK

SEQ ID NO: 30613 - protein, 10 aa, Artificial Sequence
  source: /note="Description of Artificial Sequence: Synthetic peptide"
THMDCLTGPL

SEQ ID NO: 30614 - protein, 9 aa, Artificial Sequence
  source: /note="Description of Artificial Sequence: Synthetic peptide"
GLLCPALHL

SEQ ID NO: 30615 - protein, 9 aa, Artificial Sequence
  source: /note="Description of Artificial Sequence: Synthetic peptide"
LLCPALHLV

SEQ ID NO: 30616 - protein, 9 aa, Artificial Sequence
  source: /note="Description of Artificial Sequence: Synthetic peptide"
ALHLVKPRV

SEQ ID NO: 30617 - protein, 9 aa, Artificial Sequence
  source: /note="Description of Artificial Sequence: Synthetic peptide"
ALVAPRGLL

SEQ ID NO: 30618 - protein, 9 aa, Artificial Sequence
  source: /note="Description of Artificial Sequence: Synthetic peptide"
VLHQNLDPT

SEQ ID NO: 30619 - protein, 9 aa, Artificial Sequence
  source: /note="Description of Artificial Sequence: Synthetic peptide"
MLHSCRIQK

SEQ ID NO: 30620 - protein, 9 aa, Artificial Sequence
  source: /note="Description of Artificial Sequence: Synthetic peptide"
SSSFSKWCR

SEQ ID NO: 30621 - protein, 9 aa, Artificial Sequence
  source: /note="Description of Artificial Sequence: Synthetic peptide"
SFSKWCRPW

SEQ ID NO: 30622 - protein, 9 aa, Artificial Sequence
  source: /note="Description of Artificial Sequence: Synthetic peptide"
APRGLLCPA

SEQ ID NO: 30623 - protein, 9 aa, Artificial Sequence
  source: /note="Description of Artificial Sequence: Synthetic peptide"
KPRVLHQNL

SEQ ID NO: 30624 - protein, 9 aa, Artificial Sequence
  source: /note="Description of Artificial Sequence: Synthetic peptide"
EQMLHSCRI

SEQ ID NO: 30625 - protein, 9 aa, Artificial Sequence
  source: /note="Description of Artificial Sequence: Synthetic peptide"
NLDPTSSSF

SEQ ID NO: 30626 - protein, 9 aa, Artificial Sequence
  source: /note="Description of Artificial Sequence: Synthetic peptide"
WCRPWLEQM

SEQ ID NO: 30627 - protein, 9 aa, Artificial Sequence
  source: /note="Description of Artificial Sequence: Synthetic peptide"
QKSDFSNNW

SEQ ID NO: 30628 - protein, 9 aa, Artificial Sequence
  source: /note="Description of Artificial Sequence: Synthetic peptide"
NNWNSSTQW

SEQ ID NO: 30629 - protein, 9 aa, Artificial Sequence
  source: /note="Description of Artificial Sequence: Synthetic peptide"
APLAPPALV

SEQ ID NO: 30630 - protein, 10 aa, Artificial Sequence
  source: /note="Description of Artificial Sequence: Synthetic peptide"
GLLCPALHLV

SEQ ID NO: 30631 - protein, 10 aa, Artificial Sequence
  source: /note="Description of Artificial Sequence: Synthetic peptide"
LLCPALHLVK

SEQ ID NO: 30632 - protein, 10 aa, Artificial Sequence
  source: /note="Description of Artificial Sequence: Synthetic peptide"
QMLHSCRIQK

SEQ ID NO: 30633 - protein, 10 aa, Artificial Sequence
  source: /note="Description of Artificial Sequence: Synthetic peptide"
TSSSFSKWCR

SEQ ID NO: 30634 - protein, 10 aa, Artificial Sequence
  source: /note="Description of Artificial Sequence: Synthetic peptide"
SFSKWCRPWL

SEQ ID NO: 30635 - protein, 10 aa, Artificial Sequence
  source: /note="Description of Artificial Sequence: Synthetic peptide"
KWCRPWLEQM

SEQ ID NO: 30636 - protein, 10 aa, Artificial Sequence
  source: /note="Description of Artificial Sequence: Synthetic peptide"
LAPPALVAPR

SEQ ID NO: 30637 - protein, 10 aa, Artificial Sequence
  source: /note="Description of Artificial Sequence: Synthetic peptide"
GPAAPLAPPA

SEQ ID NO: 30638 - protein, 10 aa, Artificial Sequence
  source: /note="Description of Artificial Sequence: Synthetic peptide"
APLAPPALVA

SEQ ID NO: 30639 - protein, 10 aa, Artificial Sequence
  source: /note="Description of Artificial Sequence: Synthetic peptide"
APRGLLCPAL

SEQ ID NO: 30640 - protein, 10 aa, Artificial Sequence
  source: /note="Description of Artificial Sequence: Synthetic peptide"
IQKSDFSNNW

SEQ ID NO: 30641 - protein, 10 aa, Artificial Sequence
  source: /note="Description of Artificial Sequence: Synthetic peptide"
RGLLCPALHL

SEQ ID NO: 30642 - protein, 10 aa, Artificial Sequence
  source: /note="Description of Artificial Sequence: Synthetic peptide"
HQNLDPTSSS

SEQ ID NO: 30643 - protein, 10 aa, Artificial Sequence
  source: /note="Description of Artificial Sequence: Synthetic peptide"
QNLDPTSSSF

SEQ ID NO: 30644 - protein, 10 aa, Artificial Sequence
  source: /note="Description of Artificial Sequence: Synthetic peptide"
SSFSKWCRPW

SEQ ID NO: 30645 - protein, 10 aa, Artificial Sequence
  source: /note="Description of Artificial Sequence: Synthetic peptide"
LEQMLHSCRI

SEQ ID NO: 30646 - protein, 10 aa, Artificial Sequence
  source: /note="Description of Artificial Sequence: Synthetic peptide"
HSCRIQKSDF

SEQ ID NO: 30647 - protein, 10 aa, Artificial Sequence
  source: /note="Description of Artificial Sequence: Synthetic peptide"
SNNWNSSTQW

SEQ ID NO: 30648 - protein, 10 aa, Artificial Sequence
  source: /note="Description of Artificial Sequence: Synthetic peptide"
DPTSSSFSKW

SEQ ID NO: 30649 - protein, 9 aa, Artificial Sequence
  source: /note="Description of Artificial Sequence: Synthetic peptide"
WEEVGACIF

SEQ ID NO: 30650 - protein, 9 aa, Artificial Sequence
  source: /note="Description of Artificial Sequence: Synthetic peptide"
QEIVNWEEV

SEQ ID NO: 30651 - protein, 10 aa, Artificial Sequence
  source: /note="Description of Artificial Sequence: Synthetic peptide"
WEEVGACIFH

SEQ ID NO: 30652 - protein, 9 aa, Artificial Sequence
  source: /note="Description of Artificial Sequence: Synthetic peptide"
LMQMTRPWL

SEQ ID NO: 30653 - protein, 9 aa, Artificial Sequence
  source: /note="Description of Artificial Sequence: Synthetic peptide"
TSHLMQMTR

SEQ ID NO: 30654 - protein, 9 aa, Artificial Sequence
  source: /note="Description of Artificial Sequence: Synthetic peptide"
CWTSHLMQM

SEQ ID NO: 30655 - protein, 9 aa, Artificial Sequence
  source: /note="Description of Artificial Sequence: Synthetic peptide"
FPPCWTSHL

SEQ ID NO: 30656 - protein, 9 aa, Artificial Sequence
  source: /note="Description of Artificial Sequence: Synthetic peptide"
HLMQMTRPW

SEQ ID NO: 30657 - protein, 9 aa, Artificial Sequence
  source: /note="Description of Artificial Sequence: Synthetic peptide"
AEGFPPCWT

SEQ ID NO: 30658 - protein, 10 aa, Artificial Sequence
  source: /note="Description of Artificial Sequence: Synthetic peptide"
HLMQMTRPWL

SEQ ID NO: 30659 - protein, 10 aa, Artificial Sequence
  source: /note="Description of Artificial Sequence: Synthetic peptide"
WTSHLMQMTR

SEQ ID NO: 30660 - protein, 10 aa, Artificial Sequence
  source: /note="Description of Artificial Sequence: Synthetic peptide"
GFPPCWTSHL

SEQ ID NO: 30661 - protein, 10 aa, Artificial Sequence
  source: /note="Description of Artificial Sequence: Synthetic peptide"
FPPCWTSHLM

SEQ ID NO: 30662 - protein, 10 aa, Artificial Sequence
  source: /note="Description of Artificial Sequence: Synthetic peptide"
SHLMQMTRPW

SEQ ID NO: 30663 - protein, 10 aa, Artificial Sequence
  source: /note="Description of Artificial Sequence: Synthetic peptide"
AEGFPPCWTS

SEQ ID NO: 30664 - protein, 9 aa, Artificial Sequence
  source: /note="Description of Artificial Sequence: Synthetic peptide"
KNSPCCQKK

SEQ ID NO: 30665 - protein, 9 aa, Artificial Sequence
  source: /note="Description of Artificial Sequence: Synthetic peptide"
KLRVQNQGH

SEQ ID NO: 30666 - protein, 9 aa, Artificial Sequence
  source: /note="Description of Artificial Sequence: Synthetic peptide"
RVQNQGHLL

SEQ ID NO: 30667 - protein, 9 aa, Artificial Sequence
  source: /note="Description of Artificial Sequence: Synthetic peptide"
VQNQGHLLM

SEQ ID NO: 30668 - protein, 9 aa, Artificial Sequence
  source: /note="Description of Artificial Sequence: Synthetic peptide"
LRVQNQGHL

SEQ ID NO: 30669 - protein, 9 aa, Artificial Sequence
  source: /note="Description of Artificial Sequence: Synthetic peptide"
NQGHLLMIL

SEQ ID NO: 30670 - protein, 10 aa, Artificial Sequence
  source: /note="Description of Artificial Sequence: Synthetic peptide"
MQNRQKKKGK

SEQ ID NO: 30671 - protein, 10 aa, Artificial Sequence
  source: /note="Description of Artificial Sequence: Synthetic peptide"
KGKNSPCCQK

SEQ ID NO: 30672 - protein, 10 aa, Artificial Sequence
  source: /note="Description of Artificial Sequence: Synthetic peptide"
KLRVQNQGHL

SEQ ID NO: 30673 - protein, 10 aa, Artificial Sequence
  source: /note="Description of Artificial Sequence: Synthetic peptide"
RVQNQGHLLM

SEQ ID NO: 30674 - protein, 10 aa, Artificial Sequence
  source: /note="Description of Artificial Sequence: Synthetic peptide"
LRVQNQGHLL

SEQ ID NO: 30675 - protein, 10 aa, Artificial Sequence
  source: /note="Description of Artificial Sequence: Synthetic peptide"
VQNQGHLLMI

SEQ ID NO: 30676 - protein, 10 aa, Artificial Sequence
  source: /note="Description of Artificial Sequence: Synthetic peptide"
NQGHLLMILL

SEQ ID NO: 30677 - protein, 9 aa, Artificial Sequence
  source: /note="Description of Artificial Sequence: Synthetic peptide"
GFYTPSPGK

SEQ ID NO: 30678 - protein, 9 aa, Artificial Sequence
  source: /note="Description of Artificial Sequence: Synthetic peptide"
RGFYTPSPG

SEQ ID NO: 30679 - protein, 10 aa, Artificial Sequence
  source: /note="Description of Artificial Sequence: Synthetic peptide"
RGFYTPSPGK

SEQ ID NO: 30680 - protein, 10 aa, Artificial Sequence
  source: /note="Description of Artificial Sequence: Synthetic peptide"
SPGKNTEARL

SEQ ID NO: 30681 - protein, 9 aa, Artificial Sequence
  source: /note="Description of Artificial Sequence: Synthetic peptide"
KKCVRSESL

SEQ ID NO: 30682 - protein, 9 aa, Artificial Sequence
  source: /note="Description of Artificial Sequence: Synthetic peptide"
NIHNLGATV

SEQ ID NO: 30683 - protein, 9 aa, Artificial Sequence
  source: /note="Description of Artificial Sequence: Synthetic peptide"
IFVSNIHNL

SEQ ID NO: 30684 - protein, 10 aa, Artificial Sequence
  source: /note="Description of Artificial Sequence: Synthetic peptide"
YIFVSNIHNL

SEQ ID NO: 30685 - protein, 10 aa, Artificial Sequence
  source: /note="Description of Artificial Sequence: Synthetic peptide"
FVSNIHNLGA

SEQ ID NO: 30686 - protein, 10 aa, Artificial Sequence
  source: /note="Description of Artificial Sequence: Synthetic peptide"
HNLGATVDLY

SEQ ID NO: 30687 - protein, 10 aa, Artificial Sequence
  source: /note="Description of Artificial Sequence: Synthetic peptide"
KEYIFVSNIH

SEQ ID NO: 30688 - protein, 9 aa, Artificial Sequence
  source: /note="Description of Artificial Sequence: Synthetic peptide"
ARAGWTSPI

SEQ ID NO: 30689 - protein, 9 aa, Artificial Sequence
  source: /note="Description of Artificial Sequence: Synthetic peptide"
AGWTSPIPL

SEQ ID NO: 30690 - protein, 10 aa, Artificial Sequence
  source: /note="Description of Artificial Sequence: Synthetic peptide"
MARAGWTSPI

SEQ ID NO: 30691 - protein, 10 aa, Artificial Sequence
  source: /note="Description of Artificial Sequence: Synthetic peptide"
RAGWTSPIPL

SEQ ID NO: 30692 - protein, 9 aa, Artificial Sequence
  source: /note="Description of Artificial Sequence: Synthetic peptide"
LLQPFGDSI

SEQ ID NO: 30693 - protein, 9 aa, Artificial Sequence
  source: /note="Description of Artificial Sequence: Synthetic peptide"
DFVLTWLEI

SEQ ID NO: 30694 - protein, 9 aa, Artificial Sequence
  source: /note="Description of Artificial Sequence: Synthetic peptide"
TWLEIDHLL

SEQ ID NO: 30695 - protein, 9 aa, Artificial Sequence
  source: /note="Description of Artificial Sequence: Synthetic peptide"
LEIDHLLQP

SEQ ID NO: 30696 - protein, 10 aa, Artificial Sequence
  source: /note="Description of Artificial Sequence: Synthetic peptide"
VLTWLEIDHL

SEQ ID NO: 30697 - protein, 10 aa, Artificial Sequence
  source: /note="Description of Artificial Sequence: Synthetic peptide"
HLLQPFGDSI

SEQ ID NO: 30698 - protein, 10 aa, Artificial Sequence
  source: /note="Description of Artificial Sequence: Synthetic peptide"
LEIDHLLQPF

SEQ ID NO: 30699 - protein, 10 aa, Artificial Sequence
  source: /note="Description of Artificial Sequence: Synthetic peptide"
KDFVLTWLEI

SEQ ID NO: 30700 - protein, 10 aa, Artificial Sequence
  source: /note="Description of Artificial Sequence: Synthetic peptide"
QPFGDSIRRW

SEQ ID NO: 30701 - protein, 9 aa, Artificial Sequence
  source: /note="Description of Artificial Sequence: Synthetic peptide"
KENIMKLSI

SEQ ID NO: 30702 - protein, 9 aa, Artificial Sequence
  source: /note="Description of Artificial Sequence: Synthetic peptide"
IMKLSIIQH

SEQ ID NO: 30703 - protein, 10 aa, Artificial Sequence
  source: /note="Description of Artificial Sequence: Synthetic peptide"
YKENIMKLSI

SEQ ID NO: 30704 - protein, 10 aa, Artificial Sequence
  source: /note="Description of Artificial Sequence: Synthetic peptide"
KENIMKLSII

SEQ ID NO: 30705 - protein, 10 aa, Artificial Sequence
  source: /note="Description of Artificial Sequence: Synthetic peptide"
HCKPAKPLHK

SEQ ID NO: 30706 - protein, 10 aa, Artificial Sequence
  source: /note="Description of Artificial Sequence: Synthetic peptide"
KPAKPLHKEM

SEQ ID NO: 30707 - protein, 9 aa, Artificial Sequence
  source: /note="Description of Artificial Sequence: Synthetic peptide"
RVKNIIYVL

SEQ ID NO: 30708 - protein, 9 aa, Artificial Sequence
  source: /note="Description of Artificial Sequence: Synthetic peptide"
TFMERVKNI

SEQ ID NO: 30709 - protein, 9 aa, Artificial Sequence
  source: /note="Description of Artificial Sequence: Synthetic peptide"
KNIIYVLYF

SEQ ID NO: 30710 - protein, 9 aa, Artificial Sequence
  source: /note="Description of Artificial Sequence: Synthetic peptide"
IIYVLYFDF

SEQ ID NO: 30711 - protein, 9 aa, Artificial Sequence
  source: /note="Description of Artificial Sequence: Synthetic peptide"
VKNIIYVLY

SEQ ID NO: 30712 - protein, 9 aa, Artificial Sequence
  source: /note="Description of Artificial Sequence: Synthetic peptide"
MERVKNIIY

SEQ ID NO: 30713 - protein, 9 aa, Artificial Sequence
  source: /note="Description of Artificial Sequence: Synthetic peptide"
FMERVKNII

SEQ ID NO: 30714 - protein, 10 aa, Artificial Sequence
  source: /note="Description of Artificial Sequence: Synthetic peptide"
FMERVKNIIY

SEQ ID NO: 30715 - protein, 10 aa, Artificial Sequence
  source: /note="Description of Artificial Sequence: Synthetic peptide"
RVKNIIYVLY

SEQ ID NO: 30716 - protein, 10 aa, Artificial Sequence
  source: /note="Description of Artificial Sequence: Synthetic peptide"
TFMERVKNII

SEQ ID NO: 30717 - protein, 10 aa, Artificial Sequence
  source: /note="Description of Artificial Sequence: Synthetic peptide"
NIIYVLYFDF

SEQ ID NO: 30718 - protein, 10 aa, Artificial Sequence
  source: /note="Description of Artificial Sequence: Synthetic peptide"
IIYVLYFDFW

SEQ ID NO: 30719 - protein, 10 aa, Artificial Sequence
  source: /note="Description of Artificial Sequence: Synthetic peptide"
MTFMERVKNI

SEQ ID NO: 30720 - protein, 10 aa, Artificial Sequence
  source: /note="Description of Artificial Sequence: Synthetic peptide"
MERVKNIIYV

SEQ ID NO: 30721 - protein, 10 aa, Artificial Sequence
  source: /note="Description of Artificial Sequence: Synthetic peptide"
VKNIIYVLYF

SEQ ID NO: 30722 - protein, 9 aa, Artificial Sequence
  source: /note="Description of Artificial Sequence: Synthetic peptide"
KLFDILDHY

SEQ ID NO: 30723 - protein, 9 aa, Artificial Sequence
  source: /note="Description of Artificial Sequence: Synthetic peptide"
FSGRLTAIK

SEQ ID NO: 30724 - protein, 9 aa, Artificial Sequence
  source: /note="Description of Artificial Sequence: Synthetic peptide"
SGRLTAIKL

SEQ ID NO: 30725 - protein, 9 aa, Artificial Sequence
  source: /note="Description of Artificial Sequence: Synthetic peptide"
TAIKLFDIL

SEQ ID NO: 30726 - protein, 9 aa, Artificial Sequence
  source: /note="Description of Artificial Sequence: Synthetic peptide"
GRLTAIKLF

SEQ ID NO: 30727 - protein, 10 aa, Artificial Sequence
  source: /note="Description of Artificial Sequence: Synthetic peptide"
RLTAIKLFDI

SEQ ID NO: 30728 - protein, 10 aa, Artificial Sequence
  source: /note="Description of Artificial Sequence: Synthetic peptide"
KLFDILDHYT

SEQ ID NO: 30729 - protein, 10 aa, Artificial Sequence
  source: /note="Description of Artificial Sequence: Synthetic peptide"
IFSGRLTAIK

SEQ ID NO: 30730 - protein, 10 aa, Artificial Sequence
  source: /note="Description of Artificial Sequence: Synthetic peptide"
SGRLTAIKLF

SEQ ID NO: 30731 - protein, 10 aa, Artificial Sequence
  source: /note="Description of Artificial Sequence: Synthetic peptide"
IKLFDILDHY

SEQ ID NO: 30732 - protein, 9 aa, Artificial Sequence
  source: /note="Description of Artificial Sequence: Synthetic peptide"
HLQAPSPSL

SEQ ID NO: 30733 - protein, 9 aa, Artificial Sequence
  source: /note="Description of Artificial Sequence: Synthetic peptide"
SLWPWNMLC

SEQ ID NO: 30734 - protein, 9 aa, Artificial Sequence
  source: /note="Description of Artificial Sequence: Synthetic peptide"
IQHLQAPSP

SEQ ID NO: 30735 - protein, 9 aa, Artificial Sequence
  source: /note="Description of Artificial Sequence: Synthetic peptide"
LQAPSPSLW

SEQ ID NO: 30736 - protein, 9 aa, Artificial Sequence
  source: /note="Description of Artificial Sequence: Synthetic peptide"
APSPSLWPW

SEQ ID NO: 30737 - protein, 9 aa, Artificial Sequence
  source: /note="Description of Artificial Sequence: Synthetic peptide"
SPSLWPWNM

SEQ ID NO: 30738 - protein, 10 aa, Artificial Sequence
  source: /note="Description of Artificial Sequence: Synthetic peptide"
TLKDDIPPSI

SEQ ID NO: 30739 - protein, 10 aa, Artificial Sequence
  source: /note="Description of Artificial Sequence: Synthetic peptide"
SPSLWPWNML

SEQ ID NO: 30740 - protein, 10 aa, Artificial Sequence
  source: /note="Description of Artificial Sequence: Synthetic peptide"
IQHLQAPSPS

SEQ ID NO: 30741 - protein, 10 aa, Artificial Sequence
  source: /note="Description of Artificial Sequence: Synthetic peptide"
QHLQAPSPSL

SEQ ID NO: 30742 - protein, 10 aa, Artificial Sequence
  source: /note="Description of Artificial Sequence: Synthetic peptide"
HLQAPSPSLW

SEQ ID NO: 30743 - protein, 10 aa, Artificial Sequence
  source: /note="Description of Artificial Sequence: Synthetic peptide"
IPPSIQHLQA

SEQ ID NO: 30744 - protein, 9 aa, Artificial Sequence
  source: /note="Description of Artificial Sequence: Synthetic peptide"
LVSPIGGGL

SEQ ID NO: 30745 - protein, 9 aa, Artificial Sequence
  source: /note="Description of Artificial Sequence: Synthetic peptide"
SPIGGGLSA

SEQ ID NO: 30746 - protein, 9 aa, Artificial Sequence
  source: /note="Description of Artificial Sequence: Synthetic peptide"
CEGDLVSPI

SEQ ID NO: 30747 - protein, 10 aa, Artificial Sequence
  source: /note="Description of Artificial Sequence: Synthetic peptide"
SPIGGGLSAA

SEQ ID NO: 30748 - protein, 9 aa, Artificial Sequence
  source: /note="Description of Artificial Sequence: Synthetic peptide"
RPHAPGQAN

SEQ ID NO: 30749 - protein, 9 aa, Artificial Sequence
  source: /note="Description of Artificial Sequence: Synthetic peptide"
KLAMLLVTL

SEQ ID NO: 30750 - protein, 9 aa, Artificial Sequence
  source: /note="Description of Artificial Sequence: Synthetic peptide"
LAMLLVTLV

SEQ ID NO: 30751 - protein, 9 aa, Artificial Sequence
  source: /note="Description of Artificial Sequence: Synthetic peptide"
AMLLVTLVA

SEQ ID NO: 30752 - protein, 9 aa, Artificial Sequence
  source: /note="Description of Artificial Sequence: Synthetic peptide"
MLLVTLVAA

SEQ ID NO: 30753 - protein, 9 aa, Artificial Sequence
  source: /note="Description of Artificial Sequence: Synthetic peptide"
HMKAKLAML

SEQ ID NO: 30754 - protein, 9 aa, Artificial Sequence
  source: /note="Description of Artificial Sequence: Synthetic peptide"
KAKLAMLLV

SEQ ID NO: 30755 - protein, 9 aa, Artificial Sequence
  source: /note="Description of Artificial Sequence: Synthetic peptide"
LHMKAKLAM

SEQ ID NO: 30756 - protein, 9 aa, Artificial Sequence
  source: /note="Description of Artificial Sequence: Synthetic peptide"
MKAKLAMLL

SEQ ID NO: 30757 - protein, 9 aa, Artificial Sequence
  source: /note="Description of Artificial Sequence: Synthetic peptide"
AKLAMLLVT

SEQ ID NO: 30758 - protein, 10 aa, Artificial Sequence
  source: /note="Description of Artificial Sequence: Synthetic peptide"
KLAMLLVTLV

SEQ ID NO: 30759 - protein, 10 aa, Artificial Sequence
  source: /note="Description of Artificial Sequence: Synthetic peptide"
AMLLVTLVAA

SEQ ID NO: 30760 - protein, 10 aa, Artificial Sequence
  source: /note="Description of Artificial Sequence: Synthetic peptide"
MLLVTLVAAA

SEQ ID NO: 30761 - protein, 10 aa, Artificial Sequence
  source: /note="Description of Artificial Sequence: Synthetic peptide"
HMKAKLAMLL

SEQ ID NO: 30762 - protein, 10 aa, Artificial Sequence
  source: /note="Description of Artificial Sequence: Synthetic peptide"
KAKLAMLLVT

SEQ ID NO: 30763 - protein, 10 aa, Artificial Sequence
  source: /note="Description of Artificial Sequence: Synthetic peptide"
SLHMKAKLAM

SEQ ID NO: 30764 - protein, 10 aa, Artificial Sequence
  source: /note="Description of Artificial Sequence: Synthetic peptide"
LHMKAKLAML

SEQ ID NO: 30765 - protein, 10 aa, Artificial Sequence
  source: /note="Description of Artificial Sequence: Synthetic peptide"
MKAKLAMLLV

SEQ ID NO: 30766 - protein, 10 aa, Artificial Sequence
  source: /note="Description of Artificial Sequence: Synthetic peptide"
AKLAMLLVTL

SEQ ID NO: 30767 - protein, 10 aa, Artificial Sequence
  source: /note="Description of Artificial Sequence: Synthetic peptide"
LAMLLVTLVA

SEQ ID NO: 30768 - protein, 9 aa, Artificial Sequence
  source: /note="Description of Artificial Sequence: Synthetic peptide"
SLLVALPPV

SEQ ID NO: 30769 - protein, 10 aa, Artificial Sequence
  source: /note="Description of Artificial Sequence: Synthetic peptide"
ALPPVTSQEA

SEQ ID NO: 30770 - protein, 10 aa, Artificial Sequence
  source: /note="Description of Artificial Sequence: Synthetic peptide"
ESLLVALPPV

SEQ ID NO: 30771 - protein, 10 aa, Artificial Sequence
  source: /note="Description of Artificial Sequence: Synthetic peptide"
LPPVTSQEAM

SEQ ID NO: 30772 - protein, 9 aa, Artificial Sequence
  source: /note="Description of Artificial Sequence: Synthetic peptide"
YTSVNRGPA

SEQ ID NO: 30773 - protein, 9 aa, Artificial Sequence
  source: /note="Description of Artificial Sequence: Synthetic peptide"
SVAARSGPF

SEQ ID NO: 30774 - protein, 9 aa, Artificial Sequence
  source: /note="Description of Artificial Sequence: Synthetic peptide"
ARSGPFAPV

SEQ ID NO: 30775 - protein, 10 aa, Artificial Sequence
  source: /note="Description of Artificial Sequence: Synthetic peptide"
SVAARSGPFA

SEQ ID NO: 30776 - protein, 10 aa, Artificial Sequence
  source: /note="Description of Artificial Sequence: Synthetic peptide"
AARSGPFAPV

SEQ ID NO: 30777 - protein, 10 aa, Artificial Sequence
  source: /note="Description of Artificial Sequence: Synthetic peptide"
LSVAARSGPF

SEQ ID NO: 30778 - protein, 10 aa, Artificial Sequence
  source: /note="Description of Artificial Sequence: Synthetic peptide"
ARSGPFAPVL

SEQ ID NO: 30779 - protein, 9 aa, Artificial Sequence
  source: /note="Description of Artificial Sequence: Synthetic peptide"
VKVPDFSEY

SEQ ID NO: 30780 - protein, 10 aa, Artificial Sequence
  source: /note="Description of Artificial Sequence: Synthetic peptide"
SVCYSHTDVK

SEQ ID NO: 30781 - protein, 10 aa, Artificial Sequence
  source: /note="Description of Artificial Sequence: Synthetic peptide"
DVKVPDFSEY

SEQ ID NO: 30782 - protein, 10 aa, Artificial Sequence
  source: /note="Description of Artificial Sequence: Synthetic peptide"
SHTDVKVPDF

SEQ ID NO: 30783 - protein, 9 aa, Artificial Sequence
  source: /note="Description of Artificial Sequence: Synthetic peptide"
HVWAAVCHR

SEQ ID NO: 30784 - protein, 9 aa, Artificial Sequence
  source: /note="Description of Artificial Sequence: Synthetic peptide"
RLPAGPEAF

SEQ ID NO: 30785 - protein, 9 aa, Artificial Sequence
  source: /note="Description of Artificial Sequence: Synthetic peptide"
HARPLGHRA

SEQ ID NO: 30786 - protein, 9 aa, Artificial Sequence
  source: /note="Description of Artificial Sequence: Synthetic peptide"
AARPTGETV

SEQ ID NO: 30787 - protein, 9 aa, Artificial Sequence
  source: /note="Description of Artificial Sequence: Synthetic peptide"
RSSRGLHAA

SEQ ID NO: 30788 - protein, 9 aa, Artificial Sequence
  source: /note="Description of Artificial Sequence: Synthetic peptide"
SSRGLHAAH

SEQ ID NO: 30789 - protein, 9 aa, Artificial Sequence
  source: /note="Description of Artificial Sequence: Synthetic peptide"
AVCHREELR

SEQ ID NO: 30790 - protein, 9 aa, Artificial Sequence
  source: /note="Description of Artificial Sequence: Synthetic peptide"
EAFCPLPRL

SEQ ID NO: 30791 - protein, 9 aa, Artificial Sequence
  source: /note="Description of Artificial Sequence: Synthetic peptide"
ETVKAGGSV

SEQ ID NO: 30792 - protein, 9 aa, Artificial Sequence
  source: /note="Description of Artificial Sequence: Synthetic peptide"
QVHTPQHHV

SEQ ID NO: 30793 - protein, 9 aa, Artificial Sequence
  source: /note="Description of Artificial Sequence: Synthetic peptide"
HTPQHHVWA

SEQ ID NO: 30794 - protein, 9 aa, Artificial Sequence
  source: /note="Description of Artificial Sequence: Synthetic peptide"
LPRLGLGAA

SEQ ID NO: 30795 - protein, 9 aa, Artificial Sequence
  source: /note="Description of Artificial Sequence: Synthetic peptide"
RPLGHRAPE

SEQ ID NO: 30796 - protein, 9 aa, Artificial Sequence
  source: /note="Description of Artificial Sequence: Synthetic peptide"
APEGAARPT

SEQ ID NO: 30797 - protein, 9 aa, Artificial Sequence
  source: /note="Description of Artificial Sequence: Synthetic peptide"
TPQHHVWAA

SEQ ID NO: 30798 - protein, 9 aa, Artificial Sequence
  source: /note="Description of Artificial Sequence: Synthetic peptide"
RAASGANRW

SEQ ID NO: 30799 - protein, 9 aa, Artificial Sequence
  source: /note="Description of Artificial Sequence: Synthetic peptide"
AEHARPLGH

SEQ ID NO: 30800 - protein, 9 aa, Artificial Sequence
  source: /note="Description of Artificial Sequence: Synthetic peptide"
RGARHGQVH

SEQ ID NO: 30801 - protein, 9 aa, Artificial Sequence
  source: /note="Description of Artificial Sequence: Synthetic peptide"
GQVHTPQHH

SEQ ID NO: 30802 - protein, 9 aa, Artificial Sequence
  source: /note="Description of Artificial Sequence: Synthetic peptide"
EELRSSRGL

SEQ ID NO: 30803 - protein, 10 aa, Artificial Sequence
  source: /note="Description of Artificial Sequence: Synthetic peptide"
GQVHTPQHHV

SEQ ID NO: 30804 - protein, 10 aa, Artificial Sequence
  source: /note="Description of Artificial Sequence: Synthetic peptide"
AGRLPAGPEA

SEQ ID NO: 30805 - protein, 10 aa, Artificial Sequence
  source: /note="Description of Artificial Sequence: Synthetic peptide"
AARPTGETVK

SEQ ID NO: 30806 - protein, 10 aa, Artificial Sequence
  source: /note="Description of Artificial Sequence: Synthetic peptide"
TVKAGGSVNR

SEQ ID NO: 30807 - protein, 10 aa, Artificial Sequence
  source: /note="Description of Artificial Sequence: Synthetic peptide"
RSSRGLHAAH

SEQ ID NO: 30808 - protein, 10 aa, Artificial Sequence
  source: /note="Description of Artificial Sequence: Synthetic peptide"
SSRGLHAAHH

SEQ ID NO: 30809 - protein, 10 aa, Artificial Sequence
  source: /note="Description of Artificial Sequence: Synthetic peptide"
HTPQHHVWAA

SEQ ID NO: 30810 - protein, 10 aa, Artificial Sequence
  source: /note="Description of Artificial Sequence: Synthetic peptide"
LPRLGLGAAA

SEQ ID NO: 30811 - protein, 10 aa, Artificial Sequence
  source: /note="Description of Artificial Sequence: Synthetic peptide"
RPLGHRAPEG

SEQ ID NO: 30812 - protein, 10 aa, Artificial Sequence
  source: /note="Description of Artificial Sequence: Synthetic peptide"
TPQHHVWAAV

SEQ ID NO: 30813 - protein, 10 aa, Artificial Sequence
  source: /note="Description of Artificial Sequence: Synthetic peptide"
ELRSSRGLHA

SEQ ID NO: 30814 - protein, 10 aa, Artificial Sequence
  source: /note="Description of Artificial Sequence: Synthetic peptide"
GRLPAGPEAF

SEQ ID NO: 30815 - protein, 10 aa, Artificial Sequence
  source: /note="Description of Artificial Sequence: Synthetic peptide"
WEHAEHARPL

SEQ ID NO: 30816 - protein, 10 aa, Artificial Sequence
  source: /note="Description of Artificial Sequence: Synthetic peptide"
QVHTPQHHVW

SEQ ID NO: 30817 - protein, 10 aa, Artificial Sequence
  source: /note="Description of Artificial Sequence: Synthetic peptide"
WAAVCHREEL

SEQ ID NO: 30818 - protein, 10 aa, Artificial Sequence
  source: /note="Description of Artificial Sequence: Synthetic peptide"
REELRSSRGL

SEQ ID NO: 30819 - protein, 10 aa, Artificial Sequence
  source: /note="Description of Artificial Sequence: Synthetic peptide"
LRSSRGLHAA

SEQ ID NO: 30820 - protein, 10 aa, Artificial Sequence
  source: /note="Description of Artificial Sequence: Synthetic peptide"
PEAFCPLPRL

SEQ ID NO: 30821 - protein, 10 aa, Artificial Sequence
  source: /note="Description of Artificial Sequence: Synthetic peptide"
GETVKAGGSV

SEQ ID NO: 30822 - protein, 10 aa, Artificial Sequence
  source: /note="Description of Artificial Sequence: Synthetic peptide"
CPLPRLGLGA

SEQ ID NO: 30823 - protein, 9 aa, Artificial Sequence
  source: /note="Description of Artificial Sequence: Synthetic peptide"
GAAARGAGK

SEQ ID NO: 30824 - protein, 9 aa, Artificial Sequence
  source: /note="Description of Artificial Sequence: Synthetic peptide"
VARPGCGAA

SEQ ID NO: 30825 - protein, 9 aa, Artificial Sequence
  source: /note="Description of Artificial Sequence: Synthetic peptide"
SVARPGCGA

SEQ ID NO: 30826 - protein, 9 aa, Artificial Sequence
  source: /note="Description of Artificial Sequence: Synthetic peptide"
TPPDPSPPF

SEQ ID NO: 30827 - protein, 10 aa, Artificial Sequence
  source: /note="Description of Artificial Sequence: Synthetic peptide"
VARPGCGAAA

SEQ ID NO: 30828 - protein, 10 aa, Artificial Sequence
  source: /note="Description of Artificial Sequence: Synthetic peptide"
CGAAARGAGK

SEQ ID NO: 30829 - protein, 10 aa, Artificial Sequence
  source: /note="Description of Artificial Sequence: Synthetic peptide"
SVARPGCGAA

SEQ ID NO: 30830 - protein, 9 aa, Artificial Sequence
  source: /note="Description of Artificial Sequence: Synthetic peptide"
FQTENGGQV

SEQ ID NO: 30831 - protein, 10 aa, Artificial Sequence
  source: /note="Description of Artificial Sequence: Synthetic peptide"
QTENGGQVMY

SEQ ID NO: 30832 - protein, 10 aa, Artificial Sequence
  source: /note="Description of Artificial Sequence: Synthetic peptide"
FQTENGGQVM

SEQ ID NO: 30833 - protein, 9 aa, Artificial Sequence
  source: /note="Description of Artificial Sequence: Synthetic peptide"
YQLSHNGNL

SEQ ID NO: 30834 - protein, 9 aa, Artificial Sequence
  source: /note="Description of Artificial Sequence: Synthetic peptide"
QLSHNGNLL

SEQ ID NO: 30835 - protein, 9 aa, Artificial Sequence
  source: /note="Description of Artificial Sequence: Synthetic peptide"
LSHNGNLLF

SEQ ID NO: 30836 - protein, 9 aa, Artificial Sequence
  source: /note="Description of Artificial Sequence: Synthetic peptide"
SQYQLSHNG

SEQ ID NO: 30837 - protein, 9 aa, Artificial Sequence
  source: /note="Description of Artificial Sequence: Synthetic peptide"
SHNGNLLFL

SEQ ID NO: 30838 - protein, 10 aa, Artificial Sequence
  source: /note="Description of Artificial Sequence: Synthetic peptide"
YQLSHNGNLL

SEQ ID NO: 30839 - protein, 10 aa, Artificial Sequence
  source: /note="Description of Artificial Sequence: Synthetic peptide"
QYQLSHNGNL

SEQ ID NO: 30840 - protein, 10 aa, Artificial Sequence
  source: /note="Description of Artificial Sequence: Synthetic peptide"
QLSHNGNLLF

SEQ ID NO: 30841 - protein, 10 aa, Artificial Sequence
  source: /note="Description of Artificial Sequence: Synthetic peptide"
SQYQLSHNGN

SEQ ID NO: 30842 - protein, 10 aa, Artificial Sequence
  source: /note="Description of Artificial Sequence: Synthetic peptide"
LSHNGNLLFL

SEQ ID NO: 30843 - protein, 9 aa, Artificial Sequence
  source: /note="Description of Artificial Sequence: Synthetic peptide"
VLFTGILYV

SEQ ID NO: 30844 - protein, 9 aa, Artificial Sequence
  source: /note="Description of Artificial Sequence: Synthetic peptide"
SVLFTGILY

SEQ ID NO: 30845 - protein, 9 aa, Artificial Sequence
  source: /note="Description of Artificial Sequence: Synthetic peptide"
TGILYVDPV

SEQ ID NO: 30846 - protein, 9 aa, Artificial Sequence
  source: /note="Description of Artificial Sequence: Synthetic peptide"
HSVLFTGIL

SEQ ID NO: 30847 - protein, 10 aa, Artificial Sequence
  source: /note="Description of Artificial Sequence: Synthetic peptide"
HSVLFTGILY

SEQ ID NO: 30848 - protein, 10 aa, Artificial Sequence
  source: /note="Description of Artificial Sequence: Synthetic peptide"
SVLFTGILYV

SEQ ID NO: 30849 - protein, 10 aa, Artificial Sequence
  source: /note="Description of Artificial Sequence: Synthetic peptide"
FTGILYVDPV

SEQ ID NO: 30850 - protein, 10 aa, Artificial Sequence
  source: /note="Description of Artificial Sequence: Synthetic peptide"
LYVDPVGNNY

SEQ ID NO: 30851 - protein, 9 aa, Artificial Sequence
  source: /note="Description of Artificial Sequence: Synthetic peptide"
GTWPSTQLH

SEQ ID NO: 30852 - protein, 9 aa, Artificial Sequence
  source: /note="Description of Artificial Sequence: Synthetic peptide"
TWPSTQLHV

SEQ ID NO: 30853 - protein, 9 aa, Artificial Sequence
  source: /note="Description of Artificial Sequence: Synthetic peptide"
WPSTQLHVM

SEQ ID NO: 30854 - protein, 10 aa, Artificial Sequence
  source: /note="Description of Artificial Sequence: Synthetic peptide"
TWPSTQLHVM

SEQ ID NO: 30855 - protein, 10 aa, Artificial Sequence
  source: /note="Description of Artificial Sequence: Synthetic peptide"
TQLHVMNNNM

SEQ ID NO: 30856 - protein, 10 aa, Artificial Sequence
  source: /note="Description of Artificial Sequence: Synthetic peptide"
VEYKPPKNPL

SEQ ID NO: 30857 - protein, 10 aa, Artificial Sequence
  source: /note="Description of Artificial Sequence: Synthetic peptide"
QAKNQQRQQK

SEQ ID NO: 30858 - protein, 10 aa, Artificial Sequence
  source: /note="Description of Artificial Sequence: Synthetic peptide"
QQRQQKIQGK

SEQ ID NO: 30859 - protein, 10 aa, Artificial Sequence
  source: /note="Description of Artificial Sequence: Synthetic peptide"
AKNQQRQQKI

SEQ ID NO: 30860 - protein, 9 aa, Artificial Sequence
  source: /note="Description of Artificial Sequence: Synthetic peptide"
ETDYHLHHV

SEQ ID NO: 30861 - protein, 9 aa, Artificial Sequence
  source: /note="Description of Artificial Sequence: Synthetic peptide"
HLHHVVVYF

SEQ ID NO: 30862 - protein, 9 aa, Artificial Sequence
  source: /note="Description of Artificial Sequence: Synthetic peptide"
YHLHHVVVY

SEQ ID NO: 30863 - protein, 9 aa, Artificial Sequence
  source: /note="Description of Artificial Sequence: Synthetic peptide"
TDYHLHHVV

SEQ ID NO: 30864 - protein, 10 aa, Artificial Sequence
  source: /note="Description of Artificial Sequence: Synthetic peptide"
ETDYHLHHVV

SEQ ID NO: 30865 - protein, 10 aa, Artificial Sequence
  source: /note="Description of Artificial Sequence: Synthetic peptide"
HLHHVVVYFI

SEQ ID NO: 30866 - protein, 10 aa, Artificial Sequence
  source: /note="Description of Artificial Sequence: Synthetic peptide"
YHLHHVVVYF

SEQ ID NO: 30867 - protein, 10 aa, Artificial Sequence
  source: /note="Description of Artificial Sequence: Synthetic peptide"
DTPPETDYHL

SEQ ID NO: 30868 - protein, 10 aa, Artificial Sequence
  source: /note="Description of Artificial Sequence: Synthetic peptide"
TDYHLHHVVV

SEQ ID NO: 30869 - protein, 9 aa, Artificial Sequence
  source: /note="Description of Artificial Sequence: Synthetic peptide"
MLSLSQTPA

SEQ ID NO: 30870 - protein, 9 aa, Artificial Sequence
  source: /note="Description of Artificial Sequence: Synthetic peptide"
RIMLSLSQT

SEQ ID NO: 30871 - protein, 9 aa, Artificial Sequence
  source: /note="Description of Artificial Sequence: Synthetic peptide"
IMLSLSQTP

SEQ ID NO: 30872 - protein, 10 aa, Artificial Sequence
  source: /note="Description of Artificial Sequence: Synthetic peptide"
IMLSLSQTPA

SEQ ID NO: 30873 - protein, 9 aa, Artificial Sequence
  source: /note="Description of Artificial Sequence: Synthetic peptide"
FTYDDMQVL

SEQ ID NO: 30874 - protein, 9 aa, Artificial Sequence
  source: /note="Description of Artificial Sequence: Synthetic peptide"
MQVLGIQEA

SEQ ID NO: 30875 - protein, 10 aa, Artificial Sequence
  source: /note="Description of Artificial Sequence: Synthetic peptide"
TYDDMQVLGI

SEQ ID NO: 30876 - protein, 10 aa, Artificial Sequence
  source: /note="Description of Artificial Sequence: Synthetic peptide"
MQVLGIQEAQ

SEQ ID NO: 30877 - protein, 9 aa, Artificial Sequence
  source: /note="Description of Artificial Sequence: Synthetic peptide"
LLFIDKLSY

SEQ ID NO: 30878 - protein, 9 aa, Artificial Sequence
  source: /note="Description of Artificial Sequence: Synthetic peptide"
TLKNNVLLF

SEQ ID NO: 30879 - protein, 9 aa, Artificial Sequence
  source: /note="Description of Artificial Sequence: Synthetic peptide"
RLTLKNNVL

SEQ ID NO: 30880 - protein, 9 aa, Artificial Sequence
  source: /note="Description of Artificial Sequence: Synthetic peptide"
LKNNVLLFI

SEQ ID NO: 30881 - protein, 10 aa, Artificial Sequence
  source: /note="Description of Artificial Sequence: Synthetic peptide"
TLKNNVLLFI

SEQ ID NO: 30882 - protein, 10 aa, Artificial Sequence
  source: /note="Description of Artificial Sequence: Synthetic peptide"
LLFIDKLSYR

SEQ ID NO: 30883 - protein, 10 aa, Artificial Sequence
  source: /note="Description of Artificial Sequence: Synthetic peptide"
LTLKNNVLLF

SEQ ID NO: 30884 - protein, 10 aa, Artificial Sequence
  source: /note="Description of Artificial Sequence: Synthetic peptide"
KNNVLLFIDK

SEQ ID NO: 30885 - protein, 10 aa, Artificial Sequence
  source: /note="Description of Artificial Sequence: Synthetic peptide"
VLLFIDKLSY

SEQ ID NO: 30886 - protein, 10 aa, Artificial Sequence
  source: /note="Description of Artificial Sequence: Synthetic peptide"
LRLTLKNNVL

SEQ ID NO: 30887 - protein, 10 aa, Artificial Sequence
  source: /note="Description of Artificial Sequence: Synthetic peptide"
RLTLKNNVLL

SEQ ID NO: 30888 - protein, 9 aa, Artificial Sequence
  source: /note="Description of Artificial Sequence: Synthetic peptide"
ETVHESNCI

SEQ ID NO: 30889 - protein, 9 aa, Artificial Sequence
  source: /note="Description of Artificial Sequence: Synthetic peptide"
TVHESNCIF

SEQ ID NO: 30890 - protein, 9 aa, Artificial Sequence
  source: /note="Description of Artificial Sequence: Synthetic peptide"
HESNCIFAF

SEQ ID NO: 30891 - protein, 10 aa, Artificial Sequence
  source: /note="Description of Artificial Sequence: Synthetic peptide"
TVHESNCIFA

SEQ ID NO: 30892 - protein, 10 aa, Artificial Sequence
  source: /note="Description of Artificial Sequence: Synthetic peptide"
ESNCIFAFET

SEQ ID NO: 30893 - protein, 10 aa, Artificial Sequence
  source: /note="Description of Artificial Sequence: Synthetic peptide"
VHESNCIFAF

SEQ ID NO: 30894 - protein, 9 aa, Artificial Sequence
  source: /note="Description of Artificial Sequence: Synthetic peptide"
KMSAFQNHC

SEQ ID NO: 30895 - protein, 9 aa, Artificial Sequence
  source: /note="Description of Artificial Sequence: Synthetic peptide"
SAFQNHCPH

SEQ ID NO: 30896 - protein, 10 aa, Artificial Sequence
  source: /note="Description of Artificial Sequence: Synthetic peptide"
MSAFQNHCPH

SEQ ID NO: 30897 - protein, 10 aa, Artificial Sequence
  source: /note="Description of Artificial Sequence: Synthetic peptide"
SAFQNHCPHL

SEQ ID NO: 30898 - protein, 9 aa, Artificial Sequence
  source: /note="Description of Artificial Sequence: Synthetic peptide"
YSSVSASVI

SEQ ID NO: 30899 - protein, 10 aa, Artificial Sequence
  source: /note="Description of Artificial Sequence: Synthetic peptide"
PYSSVSASVI

SEQ ID NO: 30900 - protein, 10 aa, Artificial Sequence
  source: /note="Description of Artificial Sequence: Synthetic peptide"
SPYSSVSASV

SEQ ID NO: 30901 - protein, 10 aa, Artificial Sequence
  source: /note="Description of Artificial Sequence: Synthetic peptide"
YSSVSASVIA

SEQ ID NO: 30902 - protein, 9 aa, Artificial Sequence
  source: /note="Description of Artificial Sequence: Synthetic peptide"
KAPSLSQLF

SEQ ID NO: 30903 - protein, 9 aa, Artificial Sequence
  source: /note="Description of Artificial Sequence: Synthetic peptide"
PSLSQLFLF

SEQ ID NO: 30904 - protein, 9 aa, Artificial Sequence
  source: /note="Description of Artificial Sequence: Synthetic peptide"
SLSQLFLFF

SEQ ID NO: 30905 - protein, 9 aa, Artificial Sequence
  source: /note="Description of Artificial Sequence: Synthetic peptide"
APSLSQLFL

SEQ ID NO: 30906 - protein, 9 aa, Artificial Sequence
  source: /note="Description of Artificial Sequence: Synthetic peptide"
GKAPSLSQL

SEQ ID NO: 30907 - protein, 10 aa, Artificial Sequence
  source: /note="Description of Artificial Sequence: Synthetic peptide"
SLSQLFLFFA

SEQ ID NO: 30908 - protein, 10 aa, Artificial Sequence
  source: /note="Description of Artificial Sequence: Synthetic peptide"
PSLSQLFLFF

SEQ ID NO: 30909 - protein, 10 aa, Artificial Sequence
  source: /note="Description of Artificial Sequence: Synthetic peptide"
KAPSLSQLFL

SEQ ID NO: 30910 - protein, 10 aa, Artificial Sequence
  source: /note="Description of Artificial Sequence: Synthetic peptide"
LGKAPSLSQL

SEQ ID NO: 30911 - protein, 10 aa, Artificial Sequence
  source: /note="Description of Artificial Sequence: Synthetic peptide"
GKAPSLSQLF

SEQ ID NO: 30912 - protein, 10 aa, Artificial Sequence
  source: /note="Description of Artificial Sequence: Synthetic peptide"
APSLSQLFLF

SEQ ID NO: 30913 - protein, 10 aa, Artificial Sequence
  source: /note="Description of Artificial Sequence: Synthetic peptide"
LSQLFLFFAM

SEQ ID NO: 30914 - protein, 9 aa, Artificial Sequence
  source: /note="Description of Artificial Sequence: Synthetic peptide"
STKKAPPPP

SEQ ID NO: 30915 - protein, 10 aa, Artificial Sequence
  source: /note="Description of Artificial Sequence: Synthetic peptide"
STKKAPPPPD

SEQ ID NO: 30916 - protein, 10 aa, Artificial Sequence
  source: /note="Description of Artificial Sequence: Synthetic peptide"
TIADILREEK

SEQ ID NO: 30917 - protein, 10 aa, Artificial Sequence
  source: /note="Description of Artificial Sequence: Synthetic peptide"
ILREEKKQEK

SEQ ID NO: 30918 - protein, 10 aa, Artificial Sequence
  source: /note="Description of Artificial Sequence: Synthetic peptide"
LLNTIADILR

SEQ ID NO: 30919 - protein, 9 aa, Artificial Sequence
  source: /note="Description of Artificial Sequence: Synthetic peptide"
VLSKWDPVI

SEQ ID NO: 30920 - protein, 10 aa, Artificial Sequence
  source: /note="Description of Artificial Sequence: Synthetic peptide"
VLSKWDPVIL

SEQ ID NO: 30921 - protein, 10 aa, Artificial Sequence
  source: /note="Description of Artificial Sequence: Synthetic peptide"
ILKNRQAEQL

SEQ ID NO: 30922 - protein, 10 aa, Artificial Sequence
  source: /note="Description of Artificial Sequence: Synthetic peptide"
LSKWDPVILK

SEQ ID NO: 30923 - protein, 10 aa, Artificial Sequence
  source: /note="Description of Artificial Sequence: Synthetic peptide"
GEEEEEVLAL

SEQ ID NO: 30924 - protein, 9 aa, Artificial Sequence
  source: /note="Description of Artificial Sequence: Synthetic peptide"
LEPRTARIV

SEQ ID NO: 30925 - protein, 10 aa, Artificial Sequence
  source: /note="Description of Artificial Sequence: Synthetic peptide"
APLEPRTARI

SEQ ID NO: 30926 - protein, 10 aa, Artificial Sequence
  source: /note="Description of Artificial Sequence: Synthetic peptide"
AQYHQAPLEP

SEQ ID NO: 30927 - protein, 10 aa, Artificial Sequence
  source: /note="Description of Artificial Sequence: Synthetic peptide"
HQAPLEPRTA

SEQ ID NO: 30928 - protein, 10 aa, Artificial Sequence
  source: /note="Description of Artificial Sequence: Synthetic peptide"
EPRTARIVNY

SEQ ID NO: 30929 - protein, 9 aa, Artificial Sequence
  source: /note="Description of Artificial Sequence: Synthetic peptide"
LITGGAGFL

SEQ ID NO: 30930 - protein, 10 aa, Artificial Sequence
  source: /note="Description of Artificial Sequence: Synthetic peptide"
ILITGGAGFL

SEQ ID NO: 30931 - protein, 10 aa, Artificial Sequence
  source: /note="Description of Artificial Sequence: Synthetic peptide"
FLGSHLTDKL

SEQ ID NO: 30932 - protein, 9 aa, Artificial Sequence
  source: /note="Description of Artificial Sequence: Synthetic peptide"
TSRTSFPPP

SEQ ID NO: 30933 - protein, 9 aa, Artificial Sequence
  source: /note="Description of Artificial Sequence: Synthetic peptide"
RTSFPPPRL

SEQ ID NO: 30934 - protein, 10 aa, Artificial Sequence
  source: /note="Description of Artificial Sequence: Synthetic peptide"
TSRTSFPPPR

SEQ ID NO: 30935 - protein, 10 aa, Artificial Sequence
  source: /note="Description of Artificial Sequence: Synthetic peptide"
SFPPPRLPAL

SEQ ID NO: 30936 - protein, 10 aa, Artificial Sequence
  source: /note="Description of Artificial Sequence: Synthetic peptide"
TSFPPPRLPA

SEQ ID NO: 30937 - protein, 10 aa, Artificial Sequence
  source: /note="Description of Artificial Sequence: Synthetic peptide"
QPPPTSRTSF

SEQ ID NO: 30938 - protein, 9 aa, Artificial Sequence
  source: /note="Description of Artificial Sequence: Synthetic peptide"
SLSTGVGYL

SEQ ID NO: 30939 - protein, 9 aa, Artificial Sequence
  source: /note="Description of Artificial Sequence: Synthetic peptide"
HLSLSAWKL

SEQ ID NO: 30940 - protein, 9 aa, Artificial Sequence
  source: /note="Description of Artificial Sequence: Synthetic peptide"
LSAWKLCSA

SEQ ID NO: 30941 - protein, 9 aa, Artificial Sequence
  source: /note="Description of Artificial Sequence: Synthetic peptide"
ATSESCSTI

SEQ ID NO: 30942 - protein, 9 aa, Artificial Sequence
  source: /note="Description of Artificial Sequence: Synthetic peptide"
YLWMRPPGK

SEQ ID NO: 30943 - protein, 9 aa, Artificial Sequence
  source: /note="Description of Artificial Sequence: Synthetic peptide"
ITQGHSSLK

SEQ ID NO: 30944 - protein, 9 aa, Artificial Sequence
  source: /note="Description of Artificial Sequence: Synthetic peptide"
VAAAVPLQR

SEQ ID NO: 30945 - protein, 9 aa, Artificial Sequence
  source: /note="Description of Artificial Sequence: Synthetic peptide"
GSGVWRPAK

SEQ ID NO: 30946 - protein, 9 aa, Artificial Sequence
  source: /note="Description of Artificial Sequence: Synthetic peptide"
SVGPQTCPR

SEQ ID NO: 30947 - protein, 9 aa, Artificial Sequence
  source: /note="Description of Artificial Sequence: Synthetic peptide"
QTCPRSPYR

SEQ ID NO: 30948 - protein, 9 aa, Artificial Sequence
  source: /note="Description of Artificial Sequence: Synthetic peptide"
RWLGVAAAV

SEQ ID NO: 30949 - protein, 9 aa, Artificial Sequence
  source: /note="Description of Artificial Sequence: Synthetic peptide"
GGRRWLGVA

SEQ ID NO: 30950 - protein, 9 aa, Artificial Sequence
  source: /note="Description of Artificial Sequence: Synthetic peptide"
AVPLQRPLR

SEQ ID NO: 30951 - protein, 9 aa, Artificial Sequence
  source: /note="Description of Artificial Sequence: Synthetic peptide"
RSQKRKGKR

SEQ ID NO: 30952 - protein, 9 aa, Artificial Sequence
  source: /note="Description of Artificial Sequence: Synthetic peptide"
RWRNGSVGP

SEQ ID NO: 30953 - protein, 9 aa, Artificial Sequence
  source: /note="Description of Artificial Sequence: Synthetic peptide"
RSPYRVCLR

SEQ ID NO: 30954 - protein, 9 aa, Artificial Sequence
  source: /note="Description of Artificial Sequence: Synthetic peptide"
RVCLRSSRL

SEQ ID NO: 30955 - protein, 9 aa, Artificial Sequence
  source: /note="Description of Artificial Sequence: Synthetic peptide"
CLRSSRLHL

SEQ ID NO: 30956 - protein, 9 aa, Artificial Sequence
  source: /note="Description of Artificial Sequence: Synthetic peptide"
RSSRLHLSL

SEQ ID NO: 30957 - protein, 9 aa, Artificial Sequence
  source: /note="Description of Artificial Sequence: Synthetic peptide"
SSRLHLSLS

SEQ ID NO: 30958 - protein, 9 aa, Artificial Sequence
  source: /note="Description of Artificial Sequence: Synthetic peptide"
TGVGYLWMR

SEQ ID NO: 30959 - protein, 9 aa, Artificial Sequence
  source: /note="Description of Artificial Sequence: Synthetic peptide"
NTWPRSTPM

SEQ ID NO: 30960 - protein, 9 aa, Artificial Sequence
  source: /note="Description of Artificial Sequence: Synthetic peptide"
RPLRPPPPL

SEQ ID NO: 30961 - protein, 9 aa, Artificial Sequence
  source: /note="Description of Artificial Sequence: Synthetic peptide"
CPRSPYRVC

SEQ ID NO: 30962 - protein, 9 aa, Artificial Sequence
  source: /note="Description of Artificial Sequence: Synthetic peptide"
ERRWRNGSV

SEQ ID NO: 30963 - protein, 9 aa, Artificial Sequence
  source: /note="Description of Artificial Sequence: Synthetic peptide"
SLKLRRADL

SEQ ID NO: 30964 - protein, 9 aa, Artificial Sequence
  source: /note="Description of Artificial Sequence: Synthetic peptide"
RLHLSLSAW

SEQ ID NO: 30965 - protein, 9 aa, Artificial Sequence
  source: /note="Description of Artificial Sequence: Synthetic peptide"
GRRWLGVAA

SEQ ID NO: 30966 - protein, 9 aa, Artificial Sequence
  source: /note="Description of Artificial Sequence: Synthetic peptide"
RRWLGVAAA

SEQ ID NO: 30967 - protein, 9 aa, Artificial Sequence
  source: /note="Description of Artificial Sequence: Synthetic peptide"
LGVAAAVPL

SEQ ID NO: 30968 - protein, 9 aa, Artificial Sequence
  source: /note="Description of Artificial Sequence: Synthetic peptide"
AAVPLQRPL

SEQ ID NO: 30969 - protein, 9 aa, Artificial Sequence
  source: /note="Description of Artificial Sequence: Synthetic peptide"
LQRPLRPPP

SEQ ID NO: 30970 - protein, 9 aa, Artificial Sequence
  source: /note="Description of Artificial Sequence: Synthetic peptide"
AKEPQPREM

SEQ ID NO: 30971 - protein, 9 aa, Artificial Sequence
  source: /note="Description of Artificial Sequence: Synthetic peptide"
CETEASPSL

SEQ ID NO: 30972 - protein, 9 aa, Artificial Sequence
  source: /note="Description of Artificial Sequence: Synthetic peptide"
LSTGVGYLW

SEQ ID NO: 30973 - protein, 9 aa, Artificial Sequence
  source: /note="Description of Artificial Sequence: Synthetic peptide"
RSTPMERRW

SEQ ID NO: 30974 - protein, 9 aa, Artificial Sequence
  source: /note="Description of Artificial Sequence: Synthetic peptide"
RRWRNGSVG

SEQ ID NO: 30975 - protein, 9 aa, Artificial Sequence
  source: /note="Description of Artificial Sequence: Synthetic peptide"
PQTCPRSPY

SEQ ID NO: 30976 - protein, 9 aa, Artificial Sequence
  source: /note="Description of Artificial Sequence: Synthetic peptide"
SRLHLSLSA

SEQ ID NO: 30977 - protein, 9 aa, Artificial Sequence
  source: /note="Description of Artificial Sequence: Synthetic peptide"
TQGHSSLKL

SEQ ID NO: 30978 - protein, 9 aa, Artificial Sequence
  source: /note="Description of Artificial Sequence: Synthetic peptide"
TEASPSLST

SEQ ID NO: 30979 - protein, 10 aa, Artificial Sequence
  source: /note="Description of Artificial Sequence: Synthetic peptide"
WLGVAAAVPL

SEQ ID NO: 30980 - protein, 10 aa, Artificial Sequence
  source: /note="Description of Artificial Sequence: Synthetic peptide"
SLSAWKLCSA

SEQ ID NO: 30981 - protein, 10 aa, Artificial Sequence
  source: /note="Description of Artificial Sequence: Synthetic peptide"
RLHLSLSAWK

SEQ ID NO: 30982 - protein, 10 aa, Artificial Sequence
  source: /note="Description of Artificial Sequence: Synthetic peptide"
TITQGHSSLK

SEQ ID NO: 30983 - protein, 10 aa, Artificial Sequence
  source: /note="Description of Artificial Sequence: Synthetic peptide"
GVAAAVPLQR

SEQ ID NO: 30984 - protein, 10 aa, Artificial Sequence
  source: /note="Description of Artificial Sequence: Synthetic peptide"
STGVGYLWMR

SEQ ID NO: 30985 - protein, 10 aa, Artificial Sequence
  source: /note="Description of Artificial Sequence: Synthetic peptide"
GSVGPQTCPR

SEQ ID NO: 30986 - protein, 10 aa, Artificial Sequence
  source: /note="Description of Artificial Sequence: Synthetic peptide"
GGRRWLGVAA

SEQ ID NO: 30987 - protein, 10 aa, Artificial Sequence
  source: /note="Description of Artificial Sequence: Synthetic peptide"
LGSGVWRPAK

SEQ ID NO: 30988 - protein, 10 aa, Artificial Sequence
  source: /note="Description of Artificial Sequence: Synthetic peptide"
EMRSQKRKGK

SEQ ID NO: 30989 - protein, 10 aa, Artificial Sequence
  source: /note="Description of Artificial Sequence: Synthetic peptide"
KGKRTCETEA

SEQ ID NO: 30990 - protein, 10 aa, Artificial Sequence
  source: /note="Description of Artificial Sequence: Synthetic peptide"
GYLWMRPPGK

SEQ ID NO: 30991 - protein, 10 aa, Artificial Sequence
  source: /note="Description of Artificial Sequence: Synthetic peptide"
RSTPMERRWR

SEQ ID NO: 30992 - protein, 10 aa, Artificial Sequence
  source: /note="Description of Artificial Sequence: Synthetic peptide"
RWRNGSVGPQ

SEQ ID NO: 30993 - protein, 10 aa, Artificial Sequence
  source: /note="Description of Artificial Sequence: Synthetic peptide"
RVCLRSSRLH

SEQ ID NO: 30994 - protein, 10 aa, Artificial Sequence
  source: /note="Description of Artificial Sequence: Synthetic peptide"
CLRSSRLHLS

SEQ ID NO: 30995 - protein, 10 aa, Artificial Sequence
  source: /note="Description of Artificial Sequence: Synthetic peptide"
RSSRLHLSLS

SEQ ID NO: 30996 - protein, 10 aa, Artificial Sequence
  source: /note="Description of Artificial Sequence: Synthetic peptide"
SSRLHLSLSA

SEQ ID NO: 30997 - protein, 10 aa, Artificial Sequence
  source: /note="Description of Artificial Sequence: Synthetic peptide"
TWPRSTPMER

SEQ ID NO: 30998 - protein, 10 aa, Artificial Sequence
  source: /note="Description of Artificial Sequence: Synthetic peptide"
EASPSLSTGV

SEQ ID NO: 30999 - protein, 10 aa, Artificial Sequence
  source: /note="Description of Artificial Sequence: Synthetic peptide"
QTCPRSPYRV

SEQ ID NO: 31000 - protein, 10 aa, Artificial Sequence
  source: /note="Description of Artificial Sequence: Synthetic peptide"
STITQGHSSL

SEQ ID NO: 31001 - protein, 10 aa, Artificial Sequence
  source: /note="Description of Artificial Sequence: Synthetic peptide"
MPGGRRWLGV

SEQ ID NO: 31002 - protein, 10 aa, Artificial Sequence
  source: /note="Description of Artificial Sequence: Synthetic peptide"
RPPPPLGSGV

SEQ ID NO: 31003 - protein, 10 aa, Artificial Sequence
  source: /note="Description of Artificial Sequence: Synthetic peptide"
CPRSPYRVCL

SEQ ID NO: 31004 - protein, 10 aa, Artificial Sequence
  source: /note="Description of Artificial Sequence: Synthetic peptide"
MERRWRNGSV

SEQ ID NO: 31005 - protein, 10 aa, Artificial Sequence
  source: /note="Description of Artificial Sequence: Synthetic peptide"
SPSLSTGVGY

SEQ ID NO: 31006 - protein, 10 aa, Artificial Sequence
  source: /note="Description of Artificial Sequence: Synthetic peptide"
RRWLGVAAAV

SEQ ID NO: 31007 - protein, 10 aa, Artificial Sequence
  source: /note="Description of Artificial Sequence: Synthetic peptide"
AAAVPLQRPL

SEQ ID NO: 31008 - protein, 10 aa, Artificial Sequence
  source: /note="Description of Artificial Sequence: Synthetic peptide"
LQRPLRPPPP

SEQ ID NO: 31009 - protein, 10 aa, Artificial Sequence
  source: /note="Description of Artificial Sequence: Synthetic peptide"
SLSTGVGYLW

SEQ ID NO: 31010 - protein, 10 aa, Artificial Sequence
  source: /note="Description of Artificial Sequence: Synthetic peptide"
LSTGVGYLWM

SEQ ID NO: 31011 - protein, 10 aa, Artificial Sequence
  source: /note="Description of Artificial Sequence: Synthetic peptide"
GNTWPRSTPM

SEQ ID NO: 31012 - protein, 10 aa, Artificial Sequence
  source: /note="Description of Artificial Sequence: Synthetic peptide"
GPQTCPRSPY

SEQ ID NO: 31013 - protein, 10 aa, Artificial Sequence
  source: /note="Description of Artificial Sequence: Synthetic peptide"
YRVCLRSSRL

SEQ ID NO: 31014 - protein, 10 aa, Artificial Sequence
  source: /note="Description of Artificial Sequence: Synthetic peptide"
LRSSRLHLSL

SEQ ID NO: 31015 - protein, 10 aa, Artificial Sequence
  source: /note="Description of Artificial Sequence: Synthetic peptide"
SRLHLSLSAW

SEQ ID NO: 31016 - protein, 10 aa, Artificial Sequence
  source: /note="Description of Artificial Sequence: Synthetic peptide"
LHLSLSAWKL

SEQ ID NO: 31017 - protein, 10 aa, Artificial Sequence
  source: /note="Description of Artificial Sequence: Synthetic peptide"
SATSESCSTI

SEQ ID NO: 31018 - protein, 9 aa, Artificial Sequence
  source: /note="Description of Artificial Sequence: Synthetic peptide"
RLQAETKLI

SEQ ID NO: 31019 - protein, 9 aa, Artificial Sequence
  source: /note="Description of Artificial Sequence: Synthetic peptide"
KLINRVNST

SEQ ID NO: 31020 - protein, 9 aa, Artificial Sequence
  source: /note="Description of Artificial Sequence: Synthetic peptide"
AETKLINRV

SEQ ID NO: 31021 - protein, 10 aa, Artificial Sequence
  source: /note="Description of Artificial Sequence: Synthetic peptide"
KLINRVNSTY

SEQ ID NO: 31022 - protein, 10 aa, Artificial Sequence
  source: /note="Description of Artificial Sequence: Synthetic peptide"
AMERLQAETK

SEQ ID NO: 31023 - protein, 10 aa, Artificial Sequence
  source: /note="Description of Artificial Sequence: Synthetic peptide"
MERLQAETKL

SEQ ID NO: 31024 - protein, 9 aa, Artificial Sequence
  source: /note="Description of Artificial Sequence: Synthetic peptide"
TLTPHIGPK

SEQ ID NO: 31025 - protein, 9 aa, Artificial Sequence
  source: /note="Description of Artificial Sequence: Synthetic peptide"
EVVTLTPHI

SEQ ID NO: 31026 - protein, 9 aa, Artificial Sequence
  source: /note="Description of Artificial Sequence: Synthetic peptide"
LTPHIGPKV

SEQ ID NO: 31027 - protein, 9 aa, Artificial Sequence
  source: /note="Description of Artificial Sequence: Synthetic peptide"
DEVVTLTPH

SEQ ID NO: 31028 - protein, 10 aa, Artificial Sequence
  source: /note="Description of Artificial Sequence: Synthetic peptide"
TLTPHIGPKV

SEQ ID NO: 31029 - protein, 10 aa, Artificial Sequence
  source: /note="Description of Artificial Sequence: Synthetic peptide"
VTLTPHIGPK

SEQ ID NO: 31030 - protein, 10 aa, Artificial Sequence
  source: /note="Description of Artificial Sequence: Synthetic peptide"
TPHIGPKVSL

SEQ ID NO: 31031 - protein, 10 aa, Artificial Sequence
  source: /note="Description of Artificial Sequence: Synthetic peptide"
DEVVTLTPHI

SEQ ID NO: 31032 - protein, 9 aa, Artificial Sequence
  source: /note="Description of Artificial Sequence: Synthetic peptide"
ALCTPQPPA

SEQ ID NO: 31033 - protein, 10 aa, Artificial Sequence
  source: /note="Description of Artificial Sequence: Synthetic peptide"
CTPQPPASTK

SEQ ID NO: 31034 - protein, 10 aa, Artificial Sequence
  source: /note="Description of Artificial Sequence: Synthetic peptide"
KEAFGPQALC

SEQ ID NO: 31035 - protein, 9 aa, Artificial Sequence
  source: /note="Description of Artificial Sequence: Synthetic peptide"
HNVTSWPGK

SEQ ID NO: 31036 - protein, 9 aa, Artificial Sequence
  source: /note="Description of Artificial Sequence: Synthetic peptide"
QQQQQHNVT

SEQ ID NO: 31037 - protein, 9 aa, Artificial Sequence
  source: /note="Description of Artificial Sequence: Synthetic peptide"
QQQQHNVTS

SEQ ID NO: 31038 - protein, 9 aa, Artificial Sequence
  source: /note="Description of Artificial Sequence: Synthetic peptide"
QQQHNVTSW

SEQ ID NO: 31039 - protein, 10 aa, Artificial Sequence
  source: /note="Description of Artificial Sequence: Synthetic peptide"
NVTSWPGKQV

SEQ ID NO: 31040 - protein, 10 aa, Artificial Sequence
  source: /note="Description of Artificial Sequence: Synthetic peptide"
QQQQQQQHNV

SEQ ID NO: 31041 - protein, 10 aa, Artificial Sequence
  source: /note="Description of Artificial Sequence: Synthetic peptide"
QQQQQQHNVT

SEQ ID NO: 31042 - protein, 10 aa, Artificial Sequence
  source: /note="Description of Artificial Sequence: Synthetic peptide"
QQQQHNVTSW

SEQ ID NO: 31043 - protein, 10 aa, Artificial Sequence
  source: /note="Description of Artificial Sequence: Synthetic peptide"
QQHNVTSWPG

SEQ ID NO: 31044 - protein, 10 aa, Artificial Sequence
  source: /note="Description of Artificial Sequence: Synthetic peptide"
SPEESGPEEL

SEQ ID NO: 31045 - protein, 9 aa, Artificial Sequence
  source: /note="Description of Artificial Sequence: Synthetic peptide"
PEESGLEEL

SEQ ID NO: 31046 - protein, 10 aa, Artificial Sequence
  source: /note="Description of Artificial Sequence: Synthetic peptide"
LEELGAEEEM

SEQ ID NO: 31047 - protein, 10 aa, Artificial Sequence
  source: /note="Description of Artificial Sequence: Synthetic peptide"
EESGPEESGL

SEQ ID NO: 31048 - protein, 9 aa, Artificial Sequence
  source: /note="Description of Artificial Sequence: Synthetic peptide"
RPRPVLRLV

SEQ ID NO: 31049 - protein, 9 aa, Artificial Sequence
  source: /note="Description of Artificial Sequence: Synthetic peptide"
PVLRLVNSR

SEQ ID NO: 31050 - protein, 10 aa, Artificial Sequence
  source: /note="Description of Artificial Sequence: Synthetic peptide"
LVNSREPSQV

SEQ ID NO: 31051 - protein, 10 aa, Artificial Sequence
  source: /note="Description of Artificial Sequence: Synthetic peptide"
AGRPRPVLRL

SEQ ID NO: 31052 - protein, 10 aa, Artificial Sequence
  source: /note="Description of Artificial Sequence: Synthetic peptide"
RPRPVLRLVN

SEQ ID NO: 31053 - protein, 9 aa, Artificial Sequence
  source: /note="Description of Artificial Sequence: Synthetic peptide"
PSQDIFCNR

SEQ ID NO: 31054 - protein, 9 aa, Artificial Sequence
  source: /note="Description of Artificial Sequence: Synthetic peptide"
DIFCNRSPR

SEQ ID NO: 31055 - protein, 9 aa, Artificial Sequence
  source: /note="Description of Artificial Sequence: Synthetic peptide"
SREPSQDIF

SEQ ID NO: 31056 - protein, 10 aa, Artificial Sequence
  source: /note="Description of Artificial Sequence: Synthetic peptide"
DIFCNRSPRV

SEQ ID NO: 31057 - protein, 10 aa, Artificial Sequence
  source: /note="Description of Artificial Sequence: Synthetic peptide"
NSREPSQDIF

SEQ ID NO: 31058 - protein, 9 aa, Artificial Sequence
  source: /note="Description of Artificial Sequence: Synthetic peptide"
VIFCDRSPR

SEQ ID NO: 31059 - protein, 10 aa, Artificial Sequence
  source: /note="Description of Artificial Sequence: Synthetic peptide"
VIFCDRSPRV

SEQ ID NO: 31060 - protein, 10 aa, Artificial Sequence
  source: /note="Description of Artificial Sequence: Synthetic peptide"
QVIFCDRSPR

SEQ ID NO: 31061 - protein, 9 aa, Artificial Sequence
  source: /note="Description of Artificial Sequence: Synthetic peptide"
VIFCNPSPR

SEQ ID NO: 31062 - protein, 9 aa, Artificial Sequence
  source: /note="Description of Artificial Sequence: Synthetic peptide"
SQVIFCNPS

SEQ ID NO: 31063 - protein, 10 aa, Artificial Sequence
  source: /note="Description of Artificial Sequence: Synthetic peptide"
VIFCNPSPRV

SEQ ID NO: 31064 - protein, 10 aa, Artificial Sequence
  source: /note="Description of Artificial Sequence: Synthetic peptide"
QVIFCNPSPR

SEQ ID NO: 31065 - protein, 10 aa, Artificial Sequence
  source: /note="Description of Artificial Sequence: Synthetic peptide"
NPSPRVVLPV

SEQ ID NO: 31066 - protein, 10 aa, Artificial Sequence
  source: /note="Description of Artificial Sequence: Synthetic peptide"
SQVIFCNPSP

SEQ ID NO: 31067 - protein, 10 aa, Artificial Sequence
  source: /note="Description of Artificial Sequence: Synthetic peptide"
FCNPSPRVVL

SEQ ID NO: 31068 - protein, 9 aa, Artificial Sequence
  source: /note="Description of Artificial Sequence: Synthetic peptide"
RSPPVVLPV

SEQ ID NO: 31069 - protein, 9 aa, Artificial Sequence
  source: /note="Description of Artificial Sequence: Synthetic peptide"
SPPVVLPVW

SEQ ID NO: 31070 - protein, 10 aa, Artificial Sequence
  source: /note="Description of Artificial Sequence: Synthetic peptide"
VIFCNRSPPV

SEQ ID NO: 31071 - protein, 10 aa, Artificial Sequence
  source: /note="Description of Artificial Sequence: Synthetic peptide"
RSPPVVLPVW

SEQ ID NO: 31072 - protein, 9 aa, Artificial Sequence
  source: /note="Description of Artificial Sequence: Synthetic peptide"
VVLPVLLNF

SEQ ID NO: 31073 - protein, 9 aa, Artificial Sequence
  source: /note="Description of Artificial Sequence: Synthetic peptide"
SPRVVLPVL

SEQ ID NO: 31074 - protein, 10 aa, Artificial Sequence
  source: /note="Description of Artificial Sequence: Synthetic peptide"
RVVLPVLLNF

SEQ ID NO: 31075 - protein, 10 aa, Artificial Sequence
  source: /note="Description of Artificial Sequence: Synthetic peptide"
SPRVVLPVLL

SEQ ID NO: 31076 - protein, 10 aa, Artificial Sequence
  source: /note="Description of Artificial Sequence: Synthetic peptide"
RSPRVVLPVL

SEQ ID NO: 31077 - protein, 9 aa, Artificial Sequence
  source: /note="Description of Artificial Sequence: Synthetic peptide"
VVLPVWHNF

SEQ ID NO: 31078 - protein, 10 aa, Artificial Sequence
  source: /note="Description of Artificial Sequence: Synthetic peptide"
RVVLPVWHNF

SEQ ID NO: 31079 - protein, 10 aa, Artificial Sequence
  source: /note="Description of Artificial Sequence: Synthetic peptide"
HNFDGEPQPY

SEQ ID NO: 31080 - protein, 9 aa, Artificial Sequence
  source: /note="Description of Artificial Sequence: Synthetic peptide"
VVLPVWPNF

SEQ ID NO: 31081 - protein, 9 aa, Artificial Sequence
  source: /note="Description of Artificial Sequence: Synthetic peptide"
WPNFDGEPQ

SEQ ID NO: 31082 - protein, 10 aa, Artificial Sequence
  source: /note="Description of Artificial Sequence: Synthetic peptide"
RVVLPVWPNF

SEQ ID NO: 31083 - protein, 9 aa, Artificial Sequence
  source: /note="Description of Artificial Sequence: Synthetic peptide"
GTGPRIHSY

SEQ ID NO: 31084 - protein, 9 aa, Artificial Sequence
  source: /note="Description of Artificial Sequence: Synthetic peptide"
TLPPGTGPR

SEQ ID NO: 31085 - protein, 9 aa, Artificial Sequence
  source: /note="Description of Artificial Sequence: Synthetic peptide"
TGPRIHSYR

SEQ ID NO: 31086 - protein, 9 aa, Artificial Sequence
  source: /note="Description of Artificial Sequence: Synthetic peptide"
LPPGTGPRI

SEQ ID NO: 31087 - protein, 10 aa, Artificial Sequence
  source: /note="Description of Artificial Sequence: Synthetic peptide"
TLPPGTGPRI

SEQ ID NO: 31088 - protein, 10 aa, Artificial Sequence
  source: /note="Description of Artificial Sequence: Synthetic peptide"
GTGPRIHSYR

SEQ ID NO: 31089 - protein, 9 aa, Artificial Sequence
  source: /note="Description of Artificial Sequence: Synthetic peptide"
NYRGHLWLF

SEQ ID NO: 31090 - protein, 9 aa, Artificial Sequence
  source: /note="Description of Artificial Sequence: Synthetic peptide"
TGRRIHNYR

SEQ ID NO: 31091 - protein, 9 aa, Artificial Sequence
  source: /note="Description of Artificial Sequence: Synthetic peptide"
RIHNYRGHL

SEQ ID NO: 31092 - protein, 9 aa, Artificial Sequence
  source: /note="Description of Artificial Sequence: Synthetic peptide"
GTGRRIHNY

SEQ ID NO: 31093 - protein, 9 aa, Artificial Sequence
  source: /note="Description of Artificial Sequence: Synthetic peptide"
IHNYRGHLW

SEQ ID NO: 31094 - protein, 9 aa, Artificial Sequence
  source: /note="Description of Artificial Sequence: Synthetic peptide"
HNYRGHLWL

SEQ ID NO: 31095 - protein, 10 aa, Artificial Sequence
  source: /note="Description of Artificial Sequence: Synthetic peptide"
GTGRRIHNYR

SEQ ID NO: 31096 - protein, 10 aa, Artificial Sequence
  source: /note="Description of Artificial Sequence: Synthetic peptide"
HNYRGHLWLF

SEQ ID NO: 31097 - protein, 10 aa, Artificial Sequence
  source: /note="Description of Artificial Sequence: Synthetic peptide"
RIHNYRGHLW

SEQ ID NO: 31098 - protein, 10 aa, Artificial Sequence
  source: /note="Description of Artificial Sequence: Synthetic peptide"
NYRGHLWLFR

SEQ ID NO: 31099 - protein, 10 aa, Artificial Sequence
  source: /note="Description of Artificial Sequence: Synthetic peptide"
RRIHNYRGHL

SEQ ID NO: 31100 - protein, 10 aa, Artificial Sequence
  source: /note="Description of Artificial Sequence: Synthetic peptide"
IHNYRGHLWL

SEQ ID NO: 31101 - protein, 9 aa, Artificial Sequence
  source: /note="Description of Artificial Sequence: Synthetic peptide"
RYRGHLWLF

SEQ ID NO: 31102 - protein, 9 aa, Artificial Sequence
  source: /note="Description of Artificial Sequence: Synthetic peptide"
TGRRIHRYR

SEQ ID NO: 31103 - protein, 9 aa, Artificial Sequence
  source: /note="Description of Artificial Sequence: Synthetic peptide"
RIHRYRGHL

SEQ ID NO: 31104 - protein, 9 aa, Artificial Sequence
  source: /note="Description of Artificial Sequence: Synthetic peptide"
GTGRRIHRY

SEQ ID NO: 31105 - protein, 9 aa, Artificial Sequence
  source: /note="Description of Artificial Sequence: Synthetic peptide"
IHRYRGHLW

SEQ ID NO: 31106 - protein, 9 aa, Artificial Sequence
  source: /note="Description of Artificial Sequence: Synthetic peptide"
HRYRGHLWL

SEQ ID NO: 31107 - protein, 10 aa, Artificial Sequence
  source: /note="Description of Artificial Sequence: Synthetic peptide"
GTGRRIHRYR

SEQ ID NO: 31108 - protein, 10 aa, Artificial Sequence
  source: /note="Description of Artificial Sequence: Synthetic peptide"
HRYRGHLWLF

SEQ ID NO: 31109 - protein, 10 aa, Artificial Sequence
  source: /note="Description of Artificial Sequence: Synthetic peptide"
RIHRYRGHLW

SEQ ID NO: 31110 - protein, 10 aa, Artificial Sequence
  source: /note="Description of Artificial Sequence: Synthetic peptide"
RYRGHLWLFR

SEQ ID NO: 31111 - protein, 10 aa, Artificial Sequence
  source: /note="Description of Artificial Sequence: Synthetic peptide"
RRIHRYRGHL

SEQ ID NO: 31112 - protein, 10 aa, Artificial Sequence
  source: /note="Description of Artificial Sequence: Synthetic peptide"
IHRYRGHLWL

SEQ ID NO: 31113 - protein, 9 aa, Artificial Sequence
  source: /note="Description of Artificial Sequence: Synthetic peptide"
SYRGNLWLF

SEQ ID NO: 31114 - protein, 9 aa, Artificial Sequence
  source: /note="Description of Artificial Sequence: Synthetic peptide"
RIHSYRGNL

SEQ ID NO: 31115 - protein, 9 aa, Artificial Sequence
  source: /note="Description of Artificial Sequence: Synthetic peptide"
HSYRGNLWL

SEQ ID NO: 31116 - protein, 9 aa, Artificial Sequence
  source: /note="Description of Artificial Sequence: Synthetic peptide"
IHSYRGNLW

SEQ ID NO: 31117 - protein, 10 aa, Artificial Sequence
  source: /note="Description of Artificial Sequence: Synthetic peptide"
HSYRGNLWLF

SEQ ID NO: 31118 - protein, 10 aa, Artificial Sequence
  source: /note="Description of Artificial Sequence: Synthetic peptide"
RIHSYRGNLW

SEQ ID NO: 31119 - protein, 10 aa, Artificial Sequence
  source: /note="Description of Artificial Sequence: Synthetic peptide"
SYRGNLWLFR

SEQ ID NO: 31120 - protein, 10 aa, Artificial Sequence
  source: /note="Description of Artificial Sequence: Synthetic peptide"
RRIHSYRGNL

SEQ ID NO: 31121 - protein, 10 aa, Artificial Sequence
  source: /note="Description of Artificial Sequence: Synthetic peptide"
IHSYRGNLWL

SEQ ID NO: 31122 - protein, 9 aa, Artificial Sequence
  source: /note="Description of Artificial Sequence: Synthetic peptide"
LTDSLFLPI

SEQ ID NO: 31123 - protein, 9 aa, Artificial Sequence
  source: /note="Description of Artificial Sequence: Synthetic peptide"
TMGFWLTKL

SEQ ID NO: 31124 - protein, 9 aa, Artificial Sequence
  source: /note="Description of Artificial Sequence: Synthetic peptide"
YLCHLSMLT

SEQ ID NO: 31125 - protein, 9 aa, Artificial Sequence
  source: /note="Description of Artificial Sequence: Synthetic peptide"
SMLTDSLFL

SEQ ID NO: 31126 - protein, 9 aa, Artificial Sequence
  source: /note="Description of Artificial Sequence: Synthetic peptide"
HLSMLTDSL

SEQ ID NO: 31127 - protein, 9 aa, Artificial Sequence
  source: /note="Description of Artificial Sequence: Synthetic peptide"
SLFLPISHC

SEQ ID NO: 31128 - protein, 9 aa, Artificial Sequence
  source: /note="Description of Artificial Sequence: Synthetic peptide"
FLPISHCQC

SEQ ID NO: 31129 - protein, 9 aa, Artificial Sequence
  source: /note="Description of Artificial Sequence: Synthetic peptide"
HTMGFWLTK

SEQ ID NO: 31130 - protein, 9 aa, Artificial Sequence
  source: /note="Description of Artificial Sequence: Synthetic peptide"
FWLTKLNYL

SEQ ID NO: 31131 - protein, 9 aa, Artificial Sequence
  source: /note="Description of Artificial Sequence: Synthetic peptide"
NYLCHLSML

SEQ ID NO: 31132 - protein, 9 aa, Artificial Sequence
  source: /note="Description of Artificial Sequence: Synthetic peptide"
RGHLGSSEM

SEQ ID NO: 31133 - protein, 9 aa, Artificial Sequence
  source: /note="Description of Artificial Sequence: Synthetic peptide"
GFWLTKLNY

SEQ ID NO: 31134 - protein, 9 aa, Artificial Sequence
  source: /note="Description of Artificial Sequence: Synthetic peptide"
EMQGHTMGF

SEQ ID NO: 31135 - protein, 9 aa, Artificial Sequence
  source: /note="Description of Artificial Sequence: Synthetic peptide"
LSMLTDSLF

SEQ ID NO: 31136 - protein, 9 aa, Artificial Sequence
  source: /note="Description of Artificial Sequence: Synthetic peptide"
LNYLCHLSM

SEQ ID NO: 31137 - protein, 9 aa, Artificial Sequence
  source: /note="Description of Artificial Sequence: Synthetic peptide"
SSEMQGHTM

SEQ ID NO: 31138 - protein, 9 aa, Artificial Sequence
  source: /note="Description of Artificial Sequence: Synthetic peptide"
SEMQGHTMG

SEQ ID NO: 31139 - protein, 9 aa, Artificial Sequence
  source: /note="Description of Artificial Sequence: Synthetic peptide"
MQGHTMGFW

SEQ ID NO: 31140 - protein, 9 aa, Artificial Sequence
  source: /note="Description of Artificial Sequence: Synthetic peptide"
TKLNYLCHL

SEQ ID NO: 31141 - protein, 9 aa, Artificial Sequence
  source: /note="Description of Artificial Sequence: Synthetic peptide"
LPISHCQCI

SEQ ID NO: 31142 - protein, 10 aa, Artificial Sequence
  source: /note="Description of Artificial Sequence: Synthetic peptide"
KLNYLCHLSM

SEQ ID NO: 31143 - protein, 10 aa, Artificial Sequence
  source: /note="Description of Artificial Sequence: Synthetic peptide"
MLTDSLFLPI

SEQ ID NO: 31144 - protein, 10 aa, Artificial Sequence
  source: /note="Description of Artificial Sequence: Synthetic peptide"
FLPISHCQCI

SEQ ID NO: 31145 - protein, 10 aa, Artificial Sequence
  source: /note="Description of Artificial Sequence: Synthetic peptide"
HTMGFWLTKL

SEQ ID NO: 31146 - protein, 10 aa, Artificial Sequence
  source: /note="Description of Artificial Sequence: Synthetic peptide"
GFWLTKLNYL

SEQ ID NO: 31147 - protein, 10 aa, Artificial Sequence
  source: /note="Description of Artificial Sequence: Synthetic peptide"
RIHSYRGHLG

SEQ ID NO: 31148 - protein, 10 aa, Artificial Sequence
  source: /note="Description of Artificial Sequence: Synthetic peptide"
LTKLNYLCHL

SEQ ID NO: 31149 - protein, 10 aa, Artificial Sequence
  source: /note="Description of Artificial Sequence: Synthetic peptide"
MGFWLTKLNY

SEQ ID NO: 31150 - protein, 10 aa, Artificial Sequence
  source: /note="Description of Artificial Sequence: Synthetic peptide"
LPISHCQCIL

SEQ ID NO: 31151 - protein, 10 aa, Artificial Sequence
  source: /note="Description of Artificial Sequence: Synthetic peptide"
SEMQGHTMGF

SEQ ID NO: 31152 - protein, 10 aa, Artificial Sequence
  source: /note="Description of Artificial Sequence: Synthetic peptide"
HLSMLTDSLF

SEQ ID NO: 31153 - protein, 10 aa, Artificial Sequence
  source: /note="Description of Artificial Sequence: Synthetic peptide"
HSYRGHLGSS

SEQ ID NO: 31154 - protein, 10 aa, Artificial Sequence
  source: /note="Description of Artificial Sequence: Synthetic peptide"
YRGHLGSSEM

SEQ ID NO: 31155 - protein, 10 aa, Artificial Sequence
  source: /note="Description of Artificial Sequence: Synthetic peptide"
GSSEMQGHTM

SEQ ID NO: 31156 - protein, 10 aa, Artificial Sequence
  source: /note="Description of Artificial Sequence: Synthetic peptide"
MQGHTMGFWL

SEQ ID NO: 31157 - protein, 10 aa, Artificial Sequence
  source: /note="Description of Artificial Sequence: Synthetic peptide"
LNYLCHLSML

SEQ ID NO: 31158 - protein, 10 aa, Artificial Sequence
  source: /note="Description of Artificial Sequence: Synthetic peptide"
CHLSMLTDSL

SEQ ID NO: 31159 - protein, 10 aa, Artificial Sequence
  source: /note="Description of Artificial Sequence: Synthetic peptide"
LSMLTDSLFL

SEQ ID NO: 31160 - protein, 9 aa, Artificial Sequence
  source: /note="Description of Artificial Sequence: Synthetic peptide"
RYAGTHDGL

SEQ ID NO: 31161 - protein, 9 aa, Artificial Sequence
  source: /note="Description of Artificial Sequence: Synthetic peptide"
RGHLWLFRY

SEQ ID NO: 31162 - protein, 9 aa, Artificial Sequence
  source: /note="Description of Artificial Sequence: Synthetic peptide"
WLFRYAGTH

SEQ ID NO: 31163 - protein, 10 aa, Artificial Sequence
  source: /note="Description of Artificial Sequence: Synthetic peptide"
RYAGTHDGLL

SEQ ID NO: 31164 - protein, 10 aa, Artificial Sequence
  source: /note="Description of Artificial Sequence: Synthetic peptide"
RGHLWLFRYA

SEQ ID NO: 31165 - protein, 10 aa, Artificial Sequence
  source: /note="Description of Artificial Sequence: Synthetic peptide"
YRGHLWLFRY

SEQ ID NO: 31166 - protein, 10 aa, Artificial Sequence
  source: /note="Description of Artificial Sequence: Synthetic peptide"
FRYAGTHDGL

SEQ ID NO: 31167 - protein, 9 aa, Artificial Sequence
  source: /note="Description of Artificial Sequence: Synthetic peptide"
LTDSLFLPI

SEQ ID NO: 31168 - protein, 9 aa, Artificial Sequence
  source: /note="Description of Artificial Sequence: Synthetic peptide"
TMGFWLTKL

SEQ ID NO: 31169 - protein, 9 aa, Artificial Sequence
  source: /note="Description of Artificial Sequence: Synthetic peptide"
YLCHLSMLT

SEQ ID NO: 31170 - protein, 9 aa, Artificial Sequence
  source: /note="Description of Artificial Sequence: Synthetic peptide"
SMLTDSLFL

SEQ ID NO: 31171 - protein, 9 aa, Artificial Sequence
  source: /note="Description of Artificial Sequence: Synthetic peptide"
WLFRDAGHT

SEQ ID NO: 31172 - protein, 9 aa, Artificial Sequence
  source: /note="Description of Artificial Sequence: Synthetic peptide"
HLSMLTDSL

SEQ ID NO: 31173 - protein, 9 aa, Artificial Sequence
  source: /note="Description of Artificial Sequence: Synthetic peptide"
SLFLPISHC

SEQ ID NO: 31174 - protein, 9 aa, Artificial Sequence
  source: /note="Description of Artificial Sequence: Synthetic peptide"
FLPISHCQC

SEQ ID NO: 31175 - protein, 9 aa, Artificial Sequence
  source: /note="Description of Artificial Sequence: Synthetic peptide"
HTMGFWLTK

SEQ ID NO: 31176 - protein, 9 aa, Artificial Sequence
  source: /note="Description of Artificial Sequence: Synthetic peptide"
FWLTKLNYL

SEQ ID NO: 31177 - protein, 9 aa, Artificial Sequence
  source: /note="Description of Artificial Sequence: Synthetic peptide"
NYLCHLSML

SEQ ID NO: 31178 - protein, 9 aa, Artificial Sequence
  source: /note="Description of Artificial Sequence: Synthetic peptide"
GFWLTKLNY

SEQ ID NO: 31179 - protein, 9 aa, Artificial Sequence
  source: /note="Description of Artificial Sequence: Synthetic peptide"
LSMLTDSLF

SEQ ID NO: 31180 - protein, 9 aa, Artificial Sequence
  source: /note="Description of Artificial Sequence: Synthetic peptide"
LFRDAGHTM

SEQ ID NO: 31181 - protein, 9 aa, Artificial Sequence
  source: /note="Description of Artificial Sequence: Synthetic peptide"
LNYLCHLSM

SEQ ID NO: 31182 - protein, 9 aa, Artificial Sequence
  source: /note="Description of Artificial Sequence: Synthetic peptide"
RDAGHTMGF

SEQ ID NO: 31183 - protein, 9 aa, Artificial Sequence
  source: /note="Description of Artificial Sequence: Synthetic peptide"
TKLNYLCHL

SEQ ID NO: 31184 - protein, 9 aa, Artificial Sequence
  source: /note="Description of Artificial Sequence: Synthetic peptide"
LPISHCQCI

SEQ ID NO: 31185 - protein, 10 aa, Artificial Sequence
  source: /note="Description of Artificial Sequence: Synthetic peptide"
WLFRDAGHTM

SEQ ID NO: 31186 - protein, 10 aa, Artificial Sequence
  source: /note="Description of Artificial Sequence: Synthetic peptide"
KLNYLCHLSM

SEQ ID NO: 31187 - protein, 10 aa, Artificial Sequence
  source: /note="Description of Artificial Sequence: Synthetic peptide"
MLTDSLFLPI

SEQ ID NO: 31188 - protein, 10 aa, Artificial Sequence
  source: /note="Description of Artificial Sequence: Synthetic peptide"
FLPISHCQCI

SEQ ID NO: 31189 - protein, 10 aa, Artificial Sequence
  source: /note="Description of Artificial Sequence: Synthetic peptide"
HTMGFWLTKL

SEQ ID NO: 31190 - protein, 10 aa, Artificial Sequence
  source: /note="Description of Artificial Sequence: Synthetic peptide"
GFWLTKLNYL

SEQ ID NO: 31191 - protein, 10 aa, Artificial Sequence
  source: /note="Description of Artificial Sequence: Synthetic peptide"
LTKLNYLCHL

SEQ ID NO: 31192 - protein, 10 aa, Artificial Sequence
  source: /note="Description of Artificial Sequence: Synthetic peptide"
MGFWLTKLNY

SEQ ID NO: 31193 - protein, 10 aa, Artificial Sequence
  source: /note="Description of Artificial Sequence: Synthetic peptide"
LPISHCQCIL

SEQ ID NO: 31194 - protein, 10 aa, Artificial Sequence
  source: /note="Description of Artificial Sequence: Synthetic peptide"
HLSMLTDSLF

SEQ ID NO: 31195 - protein, 10 aa, Artificial Sequence
  source: /note="Description of Artificial Sequence: Synthetic peptide"
FRDAGHTMGF

SEQ ID NO: 31196 - protein, 10 aa, Artificial Sequence
  source: /note="Description of Artificial Sequence: Synthetic peptide"
RDAGHTMGFW

SEQ ID NO: 31197 - protein, 10 aa, Artificial Sequence
  source: /note="Description of Artificial Sequence: Synthetic peptide"
LNYLCHLSML

SEQ ID NO: 31198 - protein, 10 aa, Artificial Sequence
  source: /note="Description of Artificial Sequence: Synthetic peptide"
CHLSMLTDSL

SEQ ID NO: 31199 - protein, 10 aa, Artificial Sequence
  source: /note="Description of Artificial Sequence: Synthetic peptide"
LSMLTDSLFL

SEQ ID NO: 31200 - protein, 9 aa, Artificial Sequence
  source: /note="Description of Artificial Sequence: Synthetic peptide"
HLVNQTELF

SEQ ID NO: 31201 - protein, 9 aa, Artificial Sequence
  source: /note="Description of Artificial Sequence: Synthetic peptide"
GHLVNQTEL

SEQ ID NO: 31202 - protein, 10 aa, Artificial Sequence
  source: /note="Description of Artificial Sequence: Synthetic peptide"
HLVNQTELFV

SEQ ID NO: 31203 - protein, 10 aa, Artificial Sequence
  source: /note="Description of Artificial Sequence: Synthetic peptide"
GHLVNQTELF

SEQ ID NO: 31204 - protein, 9 aa, Artificial Sequence
  source: /note="Description of Artificial Sequence: Synthetic peptide"
LVNQTEFFV

SEQ ID NO: 31205 - protein, 9 aa, Artificial Sequence
  source: /note="Description of Artificial Sequence: Synthetic peptide"
EFFVPSLNV

SEQ ID NO: 31206 - protein, 9 aa, Artificial Sequence
  source: /note="Description of Artificial Sequence: Synthetic peptide"
GLLVNQTEF

SEQ ID NO: 31207 - protein, 9 aa, Artificial Sequence
  source: /note="Description of Artificial Sequence: Synthetic peptide"
LLVNQTEFF

SEQ ID NO: 31208 - protein, 9 aa, Artificial Sequence
  source: /note="Description of Artificial Sequence: Synthetic peptide"
NQTEFFVPS

SEQ ID NO: 31209 - protein, 10 aa, Artificial Sequence
  source: /note="Description of Artificial Sequence: Synthetic peptide"
LLVNQTEFFV

SEQ ID NO: 31210 - protein, 10 aa, Artificial Sequence
  source: /note="Description of Artificial Sequence: Synthetic peptide"
NQTEFFVPSL

SEQ ID NO: 31211 - protein, 10 aa, Artificial Sequence
  source: /note="Description of Artificial Sequence: Synthetic peptide"
GLLVNQTEFF

SEQ ID NO: 31212 - protein, 10 aa, Artificial Sequence
  source: /note="Description of Artificial Sequence: Synthetic peptide"
TEFFVPSLNV

SEQ ID NO: 31213 - protein, 9 aa, Artificial Sequence
  source: /note="Description of Artificial Sequence: Synthetic peptide"
FANTTLPVY

SEQ ID NO: 31214 - protein, 9 aa, Artificial Sequence
  source: /note="Description of Artificial Sequence: Synthetic peptide"
TTLPVYTLK

SEQ ID NO: 31215 - protein, 9 aa, Artificial Sequence
  source: /note="Description of Artificial Sequence: Synthetic peptide"
IFANTTLPV

SEQ ID NO: 31216 - protein, 9 aa, Artificial Sequence
  source: /note="Description of Artificial Sequence: Synthetic peptide"
NTTLPVYTL

SEQ ID NO: 31217 - protein, 9 aa, Artificial Sequence
  source: /note="Description of Artificial Sequence: Synthetic peptide"
QPIFANTTL

SEQ ID NO: 31218 - protein, 10 aa, Artificial Sequence
  source: /note="Description of Artificial Sequence: Synthetic peptide"
PIFANTTLPV

SEQ ID NO: 31219 - protein, 10 aa, Artificial Sequence
  source: /note="Description of Artificial Sequence: Synthetic peptide"
NTTLPVYTLK

SEQ ID NO: 31220 - protein, 10 aa, Artificial Sequence
  source: /note="Description of Artificial Sequence: Synthetic peptide"
IFANTTLPVY

SEQ ID NO: 31221 - protein, 10 aa, Artificial Sequence
  source: /note="Description of Artificial Sequence: Synthetic peptide"
GQPIFANTTL

SEQ ID NO: 31222 - protein, 9 aa, Artificial Sequence
  source: /note="Description of Artificial Sequence: Synthetic peptide"
IFANITPPV

SEQ ID NO: 31223 - protein, 9 aa, Artificial Sequence
  source: /note="Description of Artificial Sequence: Synthetic peptide"
ITPPVYTLK

SEQ ID NO: 31224 - protein, 9 aa, Artificial Sequence
  source: /note="Description of Artificial Sequence: Synthetic peptide"
FANITPPVY

SEQ ID NO: 31225 - protein, 9 aa, Artificial Sequence
  source: /note="Description of Artificial Sequence: Synthetic peptide"
NITPPVYTL

SEQ ID NO: 31226 - protein, 10 aa, Artificial Sequence
  source: /note="Description of Artificial Sequence: Synthetic peptide"
PIFANITPPV

SEQ ID NO: 31227 - protein, 10 aa, Artificial Sequence
  source: /note="Description of Artificial Sequence: Synthetic peptide"
NITPPVYTLK

SEQ ID NO: 31228 - protein, 10 aa, Artificial Sequence
  source: /note="Description of Artificial Sequence: Synthetic peptide"
IFANITPPVY

SEQ ID NO: 31229 - protein, 10 aa, Artificial Sequence
  source: /note="Description of Artificial Sequence: Synthetic peptide"
ANITPPVYTL

SEQ ID NO: 31230 - protein, 9 aa, Artificial Sequence
  source: /note="Description of Artificial Sequence: Synthetic peptide"
NITLPVYTV

SEQ ID NO: 31231 - protein, 9 aa, Artificial Sequence
  source: /note="Description of Artificial Sequence: Synthetic peptide"
ITLPVYTVK

SEQ ID NO: 31232 - protein, 9 aa, Artificial Sequence
  source: /note="Description of Artificial Sequence: Synthetic peptide"
TVKERCLQV

SEQ ID NO: 31233 - protein, 10 aa, Artificial Sequence
  source: /note="Description of Artificial Sequence: Synthetic peptide"
YTVKERCLQV

SEQ ID NO: 31234 - protein, 10 aa, Artificial Sequence
  source: /note="Description of Artificial Sequence: Synthetic peptide"
NITLPVYTVK

SEQ ID NO: 31235 - protein, 10 aa, Artificial Sequence
  source: /note="Description of Artificial Sequence: Synthetic peptide"
TVKERCLQVV

SEQ ID NO: 31236 - protein, 9 aa, Artificial Sequence
  source: /note="Description of Artificial Sequence: Synthetic peptide"
ITLPVYTPK

SEQ ID NO: 31237 - protein, 9 aa, Artificial Sequence
  source: /note="Description of Artificial Sequence: Synthetic peptide"
TPKERCLQV

SEQ ID NO: 31238 - protein, 10 aa, Artificial Sequence
  source: /note="Description of Artificial Sequence: Synthetic peptide"
NITLPVYTPK

SEQ ID NO: 31239 - protein, 10 aa, Artificial Sequence
  source: /note="Description of Artificial Sequence: Synthetic peptide"
YTPKERCLQV

SEQ ID NO: 31240 - protein, 10 aa, Artificial Sequence
  source: /note="Description of Artificial Sequence: Synthetic peptide"
TPKERCLQVV

SEQ ID NO: 31241 - protein, 9 aa, Artificial Sequence
  source: /note="Description of Artificial Sequence: Synthetic peptide"
TLKERCLQL

SEQ ID NO: 31242 - protein, 10 aa, Artificial Sequence
  source: /note="Description of Artificial Sequence: Synthetic peptide"
KERCLQLSGA

SEQ ID NO: 31243 - protein, 9 aa, Artificial Sequence
  source: /note="Description of Artificial Sequence: Synthetic peptide"
CLQVVRSPV

SEQ ID NO: 31244 - protein, 9 aa, Artificial Sequence
  source: /note="Description of Artificial Sequence: Synthetic peptide"
LQVVRSPVK

SEQ ID NO: 31245 - protein, 9 aa, Artificial Sequence
  source: /note="Description of Artificial Sequence: Synthetic peptide"
RSPVKPENY

SEQ ID NO: 31246 - protein, 9 aa, Artificial Sequence
  source: /note="Description of Artificial Sequence: Synthetic peptide"
PVKPENYRR

SEQ ID NO: 31247 - protein, 10 aa, Artificial Sequence
  source: /note="Description of Artificial Sequence: Synthetic peptide"
CLQVVRSPVK

SEQ ID NO: 31248 - protein, 10 aa, Artificial Sequence
  source: /note="Description of Artificial Sequence: Synthetic peptide"
VRSPVKPENY

SEQ ID NO: 31249 - protein, 9 aa, Artificial Sequence
  source: /note="Description of Artificial Sequence: Synthetic peptide"
RLDIVRSPY

SEQ ID NO: 31250 - protein, 9 aa, Artificial Sequence
  source: /note="Description of Artificial Sequence: Synthetic peptide"
SPYEDLEDH

SEQ ID NO: 31251 - protein, 10 aa, Artificial Sequence
  source: /note="Description of Artificial Sequence: Synthetic peptide"
RRLDIVRSPY

SEQ ID NO: 31252 - protein, 10 aa, Artificial Sequence
  source: /note="Description of Artificial Sequence: Synthetic peptide"
YEDPEDHPNV

SEQ ID NO: 31253 - protein, 9 aa, Artificial Sequence
  source: /note="Description of Artificial Sequence: Synthetic peptide"
LEQCGHQPV

SEQ ID NO: 31254 - protein, 9 aa, Artificial Sequence
  source: /note="Description of Artificial Sequence: Synthetic peptide"
EQCGHQPVI

SEQ ID NO: 31255 - protein, 10 aa, Artificial Sequence
  source: /note="Description of Artificial Sequence: Synthetic peptide"
SLEQCGHQPV

SEQ ID NO: 31256 - protein, 10 aa, Artificial Sequence
  source: /note="Description of Artificial Sequence: Synthetic peptide"
CGHQPVIHTK

SEQ ID NO: 31257 - protein, 10 aa, Artificial Sequence
  source: /note="Description of Artificial Sequence: Synthetic peptide"
LEQCGHQPVI

SEQ ID NO: 31258 - protein, 9 aa, Artificial Sequence
  source: /note="Description of Artificial Sequence: Synthetic peptide"
WLSWMFQKL

SEQ ID NO: 31259 - protein, 9 aa, Artificial Sequence
  source: /note="Description of Artificial Sequence: Synthetic peptide"
WMFQKLVVV

SEQ ID NO: 31260 - protein, 9 aa, Artificial Sequence
  source: /note="Description of Artificial Sequence: Synthetic peptide"
FQKLVVVMV

SEQ ID NO: 31261 - protein, 9 aa, Artificial Sequence
  source: /note="Description of Artificial Sequence: Synthetic peptide"
NWLSWMFQK

SEQ ID NO: 31262 - protein, 9 aa, Artificial Sequence
  source: /note="Description of Artificial Sequence: Synthetic peptide"
SWMFQKLVV

SEQ ID NO: 31263 - protein, 9 aa, Artificial Sequence
  source: /note="Description of Artificial Sequence: Synthetic peptide"
MFQKLVVVM

SEQ ID NO: 31264 - protein, 10 aa, Artificial Sequence
  source: /note="Description of Artificial Sequence: Synthetic peptide"
WLSWMFQKLV

SEQ ID NO: 31265 - protein, 10 aa, Artificial Sequence
  source: /note="Description of Artificial Sequence: Synthetic peptide"
WMFQKLVVVM

SEQ ID NO: 31266 - protein, 10 aa, Artificial Sequence
  source: /note="Description of Artificial Sequence: Synthetic peptide"
NWLSWMFQKL

SEQ ID NO: 31267 - protein, 10 aa, Artificial Sequence
  source: /note="Description of Artificial Sequence: Synthetic peptide"
SWMFQKLVVV

SEQ ID NO: 31268 - protein, 10 aa, Artificial Sequence
  source: /note="Description of Artificial Sequence: Synthetic peptide"
MFQKLVVVMV

SEQ ID NO: 31269 - protein, 10 aa, Artificial Sequence
  source: /note="Description of Artificial Sequence: Synthetic peptide"
ENWLSWMFQK

SEQ ID NO: 31270 - protein, 10 aa, Artificial Sequence
  source: /note="Description of Artificial Sequence: Synthetic peptide"
LSWMFQKLVV

SEQ ID NO: 31271 - protein, 10 aa, Artificial Sequence
  source: /note="Description of Artificial Sequence: Synthetic peptide"
QKLVVVMVCY

SEQ ID NO: 31272 - protein, 9 aa, Artificial Sequence
  source: /note="Description of Artificial Sequence: Synthetic peptide"
LLLLIQNHL

SEQ ID NO: 31273 - protein, 9 aa, Artificial Sequence
  source: /note="Description of Artificial Sequence: Synthetic peptide"
LLLIQNHLI

SEQ ID NO: 31274 - protein, 9 aa, Artificial Sequence
  source: /note="Description of Artificial Sequence: Synthetic peptide"
LIQNHLISK

SEQ ID NO: 31275 - protein, 9 aa, Artificial Sequence
  source: /note="Description of Artificial Sequence: Synthetic peptide"
KELLLLIQN

SEQ ID NO: 31276 - protein, 10 aa, Artificial Sequence
  source: /note="Description of Artificial Sequence: Synthetic peptide"
LLLLIQNHLI

SEQ ID NO: 31277 - protein, 10 aa, Artificial Sequence
  source: /note="Description of Artificial Sequence: Synthetic peptide"
IQNHLISKGL

SEQ ID NO: 31278 - protein, 10 aa, Artificial Sequence
  source: /note="Description of Artificial Sequence: Synthetic peptide"
LLIQNHLISK

SEQ ID NO: 31279 - protein, 9 aa, Artificial Sequence
  source: /note="Description of Artificial Sequence: Synthetic peptide"
WTDIFLPHL

SEQ ID NO: 31280 - protein, 9 aa, Artificial Sequence
  source: /note="Description of Artificial Sequence: Synthetic peptide"
FLPHLRWTV

SEQ ID NO: 31281 - protein, 9 aa, Artificial Sequence
  source: /note="Description of Artificial Sequence: Synthetic peptide"
AIKNSWTDI

SEQ ID NO: 31282 - protein, 9 aa, Artificial Sequence
  source: /note="Description of Artificial Sequence: Synthetic peptide"
SWTDIFLPH

SEQ ID NO: 31283 - protein, 9 aa, Artificial Sequence
  source: /note="Description of Artificial Sequence: Synthetic peptide"
IKNSWTDIF

SEQ ID NO: 31284 - protein, 10 aa, Artificial Sequence
  source: /note="Description of Artificial Sequence: Synthetic peptide"
WTDIFLPHLR

SEQ ID NO: 31285 - protein, 10 aa, Artificial Sequence
  source: /note="Description of Artificial Sequence: Synthetic peptide"
SWTDIFLPHL

SEQ ID NO: 31286 - protein, 10 aa, Artificial Sequence
  source: /note="Description of Artificial Sequence: Synthetic peptide"
IFLPHLRWTV

SEQ ID NO: 31287 - protein, 10 aa, Artificial Sequence
  source: /note="Description of Artificial Sequence: Synthetic peptide"
AIKNSWTDIF

SEQ ID NO: 31288 - protein, 10 aa, Artificial Sequence
  source: /note="Description of Artificial Sequence: Synthetic peptide"
SQSPAIKNSW

SEQ ID NO: 31289 - protein, 10 aa, Artificial Sequence
  source: /note="Description of Artificial Sequence: Synthetic peptide"
IKNSWTDIFL

SEQ ID NO: 31290 - protein, 9 aa, Artificial Sequence
  source: /note="Description of Artificial Sequence: Synthetic peptide"
NLTREPSRV

SEQ ID NO: 31291 - protein, 9 aa, Artificial Sequence
  source: /note="Description of Artificial Sequence: Synthetic peptide"
LTREPSRVL

SEQ ID NO: 31292 - protein, 9 aa, Artificial Sequence
  source: /note="Description of Artificial Sequence: Synthetic peptide"
EAFFMNLTR

SEQ ID NO: 31293 - protein, 9 aa, Artificial Sequence
  source: /note="Description of Artificial Sequence: Synthetic peptide"
MNLTREPSR

SEQ ID NO: 31294 - protein, 9 aa, Artificial Sequence
  source: /note="Description of Artificial Sequence: Synthetic peptide"
EPSRVLKSL

SEQ ID NO: 31295 - protein, 9 aa, Artificial Sequence
  source: /note="Description of Artificial Sequence: Synthetic peptide"
SEGVEAFFM

SEQ ID NO: 31296 - protein, 9 aa, Artificial Sequence
  source: /note="Description of Artificial Sequence: Synthetic peptide"
FMNLTREPS

SEQ ID NO: 31297 - protein, 9 aa, Artificial Sequence
  source: /note="Description of Artificial Sequence: Synthetic peptide"
VLKSLWKEW

SEQ ID NO: 31298 - protein, 9 aa, Artificial Sequence
  source: /note="Description of Artificial Sequence: Synthetic peptide"
VEAFFMNLT

SEQ ID NO: 31299 - protein, 10 aa, Artificial Sequence
  source: /note="Description of Artificial Sequence: Synthetic peptide"
FSEGVEAFFM

SEQ ID NO: 31300 - protein, 10 aa, Artificial Sequence
  source: /note="Description of Artificial Sequence: Synthetic peptide"
LTREPSRVLK

SEQ ID NO: 31301 - protein, 10 aa, Artificial Sequence
  source: /note="Description of Artificial Sequence: Synthetic peptide"
RVLKSLWKEW

SEQ ID NO: 31302 - protein, 10 aa, Artificial Sequence
  source: /note="Description of Artificial Sequence: Synthetic peptide"
PSRVLKSLWK

SEQ ID NO: 31303 - protein, 10 aa, Artificial Sequence
  source: /note="Description of Artificial Sequence: Synthetic peptide"
FMNLTREPSR

SEQ ID NO: 31304 - protein, 10 aa, Artificial Sequence
  source: /note="Description of Artificial Sequence: Synthetic peptide"
EGVEAFFMNL

SEQ ID NO: 31305 - protein, 10 aa, Artificial Sequence
  source: /note="Description of Artificial Sequence: Synthetic peptide"
REPSRVLKSL

SEQ ID NO: 31306 - protein, 10 aa, Artificial Sequence
  source: /note="Description of Artificial Sequence: Synthetic peptide"
EPSRVLKSLW

SEQ ID NO: 31307 - protein, 9 aa, Artificial Sequence
  source: /note="Description of Artificial Sequence: Synthetic peptide"
RPLPSIQIL

SEQ ID NO: 31308 - protein, 10 aa, Artificial Sequence
  source: /note="Description of Artificial Sequence: Synthetic peptide"
SLRPLPSIQI

SEQ ID NO: 31309 - protein, 10 aa, Artificial Sequence
  source: /note="Description of Artificial Sequence: Synthetic peptide"
RPLPSIQILV

SEQ ID NO: 31310 - protein, 10 aa, Artificial Sequence
  source: /note="Description of Artificial Sequence: Synthetic peptide"
IQILVDKINL

SEQ ID NO: 31311 - protein, 9 aa, Artificial Sequence
  source: /note="Description of Artificial Sequence: Synthetic peptide"
FSIFWQMAV

SEQ ID NO: 31312 - protein, 9 aa, Artificial Sequence
  source: /note="Description of Artificial Sequence: Synthetic peptide"
WQMAVSSDV

SEQ ID NO: 31313 - protein, 9 aa, Artificial Sequence
  source: /note="Description of Artificial Sequence: Synthetic peptide"
KPFSIFWQM

SEQ ID NO: 31314 - protein, 10 aa, Artificial Sequence
  source: /note="Description of Artificial Sequence: Synthetic peptide"
WQMAVSSDVV

SEQ ID NO: 31315 - protein, 10 aa, Artificial Sequence
  source: /note="Description of Artificial Sequence: Synthetic peptide"
FSIFWQMAVS

SEQ ID NO: 31316 - protein, 10 aa, Artificial Sequence
  source: /note="Description of Artificial Sequence: Synthetic peptide"
VKPFSIFWQM

SEQ ID NO: 31317 - protein, 10 aa, Artificial Sequence
  source: /note="Description of Artificial Sequence: Synthetic peptide"
KPFSIFWQMA

SEQ ID NO: 31318 - protein, 9 aa, Artificial Sequence
  source: /note="Description of Artificial Sequence: Synthetic peptide"
SLNQEYLNL

SEQ ID NO: 31319 - protein, 9 aa, Artificial Sequence
  source: /note="Description of Artificial Sequence: Synthetic peptide"
YLNLLFRIL

SEQ ID NO: 31320 - protein, 9 aa, Artificial Sequence
  source: /note="Description of Artificial Sequence: Synthetic peptide"
EYLNLLFRI

SEQ ID NO: 31321 - protein, 9 aa, Artificial Sequence
  source: /note="Description of Artificial Sequence: Synthetic peptide"
MNVSLNQEY

SEQ ID NO: 31322 - protein, 9 aa, Artificial Sequence
  source: /note="Description of Artificial Sequence: Synthetic peptide"
NVSLNQEYL

SEQ ID NO: 31323 - protein, 9 aa, Artificial Sequence
  source: /note="Description of Artificial Sequence: Synthetic peptide"
NQEYLNLLF

SEQ ID NO: 31324 - protein, 10 aa, Artificial Sequence
  source: /note="Description of Artificial Sequence: Synthetic peptide"
SLNQEYLNLL

SEQ ID NO: 31325 - protein, 10 aa, Artificial Sequence
  source: /note="Description of Artificial Sequence: Synthetic peptide"
YLNLLFRILT

SEQ ID NO: 31326 - protein, 10 aa, Artificial Sequence
  source: /note="Description of Artificial Sequence: Synthetic peptide"
EYLNLLFRIL

SEQ ID NO: 31327 - protein, 10 aa, Artificial Sequence
  source: /note="Description of Artificial Sequence: Synthetic peptide"
SMNVSLNQEY

SEQ ID NO: 31328 - protein, 10 aa, Artificial Sequence
  source: /note="Description of Artificial Sequence: Synthetic peptide"
MNVSLNQEYL

SEQ ID NO: 31329 - protein, 10 aa, Artificial Sequence
  source: /note="Description of Artificial Sequence: Synthetic peptide"
LNQEYLNLLF

SEQ ID NO: 31330 - protein, 10 aa, Artificial Sequence
  source: /note="Description of Artificial Sequence: Synthetic peptide"
QEYLNLLFRI

SEQ ID NO: 31331 - protein, 9 aa, Artificial Sequence
  source: /note="Description of Artificial Sequence: Synthetic peptide"
DDYQCLCPL

SEQ ID NO: 31332 - protein, 10 aa, Artificial Sequence
  source: /note="Description of Artificial Sequence: Synthetic peptide"
DYQCLCPLAF

SEQ ID NO: 31333 - protein, 9 aa, Artificial Sequence
  source: /note="Description of Artificial Sequence: Synthetic peptide"
RLFGTILES

SEQ ID NO: 31334 - protein, 9 aa, Artificial Sequence
  source: /note="Description of Artificial Sequence: Synthetic peptide"
ILESKVCIL

SEQ ID NO: 31335 - protein, 9 aa, Artificial Sequence
  source: /note="Description of Artificial Sequence: Synthetic peptide"
GSRRLFGTI

SEQ ID NO: 31336 - protein, 9 aa, Artificial Sequence
  source: /note="Description of Artificial Sequence: Synthetic peptide"
SRRLFGTIL

SEQ ID NO: 31337 - protein, 10 aa, Artificial Sequence
  source: /note="Description of Artificial Sequence: Synthetic peptide"
ILESKVCILL

SEQ ID NO: 31338 - protein, 10 aa, Artificial Sequence
  source: /note="Description of Artificial Sequence: Synthetic peptide"
RLFGTILESK

SEQ ID NO: 31339 - protein, 10 aa, Artificial Sequence
  source: /note="Description of Artificial Sequence: Synthetic peptide"
GSRRLFGTIL

SEQ ID NO: 31340 - protein, 9 aa, Artificial Sequence
  source: /note="Description of Artificial Sequence: Synthetic peptide"
QAVAWLEQL

SEQ ID NO: 31341 - protein, 10 aa, Artificial Sequence
  source: /note="Description of Artificial Sequence: Synthetic peptide"
VAWLEQLAEV

SEQ ID NO: 31342 - protein, 10 aa, Artificial Sequence
  source: /note="Description of Artificial Sequence: Synthetic peptide"
GQAVAWLEQL

SEQ ID NO: 31343 - protein, 10 aa, Artificial Sequence
  source: /note="Description of Artificial Sequence: Synthetic peptide"
RLWLEGPDSA

SEQ ID NO: 31344 - protein, 9 aa, Artificial Sequence
  source: /note="Description of Artificial Sequence: Synthetic peptide"
FAKAFISNA

SEQ ID NO: 31345 - protein, 9 aa, Artificial Sequence
  source: /note="Description of Artificial Sequence: Synthetic peptide"
ISNANIGPR

SEQ ID NO: 31346 - protein, 9 aa, Artificial Sequence
  source: /note="Description of Artificial Sequence: Synthetic peptide"
KAFISNANI

SEQ ID NO: 31347 - protein, 10 aa, Artificial Sequence
  source: /note="Description of Artificial Sequence: Synthetic peptide"
KSFAKAFISN

SEQ ID NO: 31348 - protein, 10 aa, Artificial Sequence
  source: /note="Description of Artificial Sequence: Synthetic peptide"
SFAKAFISNA

SEQ ID NO: 31349 - protein, 10 aa, Artificial Sequence
  source: /note="Description of Artificial Sequence: Synthetic peptide"
FISNANIGPR

SEQ ID NO: 31350 - protein, 10 aa, Artificial Sequence
  source: /note="Description of Artificial Sequence: Synthetic peptide"
AKAFISNANI

SEQ ID NO: 31351 - protein, 10 aa, Artificial Sequence
  source: /note="Description of Artificial Sequence: Synthetic peptide"
ISNANIGPRL

SEQ ID NO: 31352 - protein, 9 aa, Artificial Sequence
  source: /note="Description of Artificial Sequence: Synthetic peptide"
MIIPRTVSL

SEQ ID NO: 31353 - protein, 9 aa, Artificial Sequence
  source: /note="Description of Artificial Sequence: Synthetic peptide"
IIPRTVSLV

SEQ ID NO: 31354 - protein, 9 aa, Artificial Sequence
  source: /note="Description of Artificial Sequence: Synthetic peptide"
LTMQRTCLV

SEQ ID NO: 31355 - protein, 9 aa, Artificial Sequence
  source: /note="Description of Artificial Sequence: Synthetic peptide"
QLHHPPCSL

SEQ ID NO: 31356 - protein, 9 aa, Artificial Sequence
  source: /note="Description of Artificial Sequence: Synthetic peptide"
SLPQKAMII

SEQ ID NO: 31357 - protein, 9 aa, Artificial Sequence
  source: /note="Description of Artificial Sequence: Synthetic peptide"
MQRTCLVCL

SEQ ID NO: 31358 - protein, 9 aa, Artificial Sequence
  source: /note="Description of Artificial Sequence: Synthetic peptide"
VSLVLTMQR

SEQ ID NO: 31359 - protein, 9 aa, Artificial Sequence
  source: /note="Description of Artificial Sequence: Synthetic peptide"
KAMIIPRTV

SEQ ID NO: 31360 - protein, 9 aa, Artificial Sequence
  source: /note="Description of Artificial Sequence: Synthetic peptide"
RTVSLVLTM

SEQ ID NO: 31361 - protein, 9 aa, Artificial Sequence
  source: /note="Description of Artificial Sequence: Synthetic peptide"
IPRTVSLVL

SEQ ID NO: 31362 - protein, 10 aa, Artificial Sequence
  source: /note="Description of Artificial Sequence: Synthetic peptide"
KQLHHPPCSL

SEQ ID NO: 31363 - protein, 10 aa, Artificial Sequence
  source: /note="Description of Artificial Sequence: Synthetic peptide"
AMIIPRTVSL

SEQ ID NO: 31364 - protein, 10 aa, Artificial Sequence
  source: /note="Description of Artificial Sequence: Synthetic peptide"
MIIPRTVSLV

SEQ ID NO: 31365 - protein, 10 aa, Artificial Sequence
  source: /note="Description of Artificial Sequence: Synthetic peptide"
VLTMQRTCLV

SEQ ID NO: 31366 - protein, 10 aa, Artificial Sequence
  source: /note="Description of Artificial Sequence: Synthetic peptide"
MQRTCLVCLK

SEQ ID NO: 31367 - protein, 10 aa, Artificial Sequence
  source: /note="Description of Artificial Sequence: Synthetic peptide"
TVSLVLTMQR

SEQ ID NO: 31368 - protein, 10 aa, Artificial Sequence
  source: /note="Description of Artificial Sequence: Synthetic peptide"
VERKTSKKEL

SEQ ID NO: 31369 - protein, 10 aa, Artificial Sequence
  source: /note="Description of Artificial Sequence: Synthetic peptide"
TMQRTCLVCL

SEQ ID NO: 31370 - protein, 10 aa, Artificial Sequence
  source: /note="Description of Artificial Sequence: Synthetic peptide"
KELKQLHHPP

SEQ ID NO: 31371 - protein, 9 aa, Artificial Sequence
  source: /note="Description of Artificial Sequence: Synthetic peptide"
SSRLRDAPS

SEQ ID NO: 31372 - protein, 9 aa, Artificial Sequence
  source: /note="Description of Artificial Sequence: Synthetic peptide"
RPQQPPPPA

SEQ ID NO: 31373 - protein, 10 aa, Artificial Sequence
  source: /note="Description of Artificial Sequence: Synthetic peptide"
GLCTDGSSRL

SEQ ID NO: 31374 - protein, 10 aa, Artificial Sequence
  source: /note="Description of Artificial Sequence: Synthetic peptide"
SSRLRDAPSA

SEQ ID NO: 31375 - protein, 10 aa, Artificial Sequence
  source: /note="Description of Artificial Sequence: Synthetic peptide"
RPQQPPPPAS

SEQ ID NO: 31376 - protein, 10 aa, Artificial Sequence
  source: /note="Description of Artificial Sequence: Synthetic peptide"
SPSGPRGVPG

SEQ ID NO: 31377 - protein, 9 aa, Artificial Sequence
  source: /note="Description of Artificial Sequence: Synthetic peptide"
RQAGGISKA

SEQ ID NO: 31378 - protein, 9 aa, Artificial Sequence
  source: /note="Description of Artificial Sequence: Synthetic peptide"
ISKAKLRSM

SEQ ID NO: 31379 - protein, 10 aa, Artificial Sequence
  source: /note="Description of Artificial Sequence: Synthetic peptide"
SIRQAGGISK

SEQ ID NO: 31380 - protein, 10 aa, Artificial Sequence
  source: /note="Description of Artificial Sequence: Synthetic peptide"
RQAGGISKAK

SEQ ID NO: 31381 - protein, 10 aa, Artificial Sequence
  source: /note="Description of Artificial Sequence: Synthetic peptide"
ISKAKLRSMK

SEQ ID NO: 31382 - protein, 9 aa, Artificial Sequence
  source: /note="Description of Artificial Sequence: Synthetic peptide"
SMKERKVEK

SEQ ID NO: 31383 - protein, 10 aa, Artificial Sequence
  source: /note="Description of Artificial Sequence: Synthetic peptide"
RSMKERKVEK

SEQ ID NO: 31384 - protein, 10 aa, Artificial Sequence
  source: /note="Description of Artificial Sequence: Synthetic peptide"
SMKERKVEKK

SEQ ID NO: 31385 - protein, 10 aa, Artificial Sequence
  source: /note="Description of Artificial Sequence: Synthetic peptide"
KLRSMKERKV

SEQ ID NO: 31386 - protein, 9 aa, Artificial Sequence
  source: /note="Description of Artificial Sequence: Synthetic peptide"
LYCGPRPPL

SEQ ID NO: 31387 - protein, 9 aa, Artificial Sequence
  source: /note="Description of Artificial Sequence: Synthetic peptide"
RPGTPPPPL

SEQ ID NO: 31388 - protein, 9 aa, Artificial Sequence
  source: /note="Description of Artificial Sequence: Synthetic peptide"
GPRPPLDCF

SEQ ID NO: 31389 - protein, 9 aa, Artificial Sequence
  source: /note="Description of Artificial Sequence: Synthetic peptide"
REGLICARI

SEQ ID NO: 31390 - protein, 10 aa, Artificial Sequence
  source: /note="Description of Artificial Sequence: Synthetic peptide"
LICARIEGWK

SEQ ID NO: 31391 - protein, 9 aa, Artificial Sequence
  source: /note="Description of Artificial Sequence: Synthetic peptide"
CTEAVFYYW

SEQ ID NO: 31392 - protein, 9 aa, Artificial Sequence
  source: /note="Description of Artificial Sequence: Synthetic peptide"
YYWECSAAC

SEQ ID NO: 31393 - protein, 9 aa, Artificial Sequence
  source: /note="Description of Artificial Sequence: Synthetic peptide"
EAVFYYWEC

SEQ ID NO: 31394 - protein, 9 aa, Artificial Sequence
  source: /note="Description of Artificial Sequence: Synthetic peptide"
FYYWECSAA

SEQ ID NO: 31395 - protein, 10 aa, Artificial Sequence
  source: /note="Description of Artificial Sequence: Synthetic peptide"
AVFYYWECSA

SEQ ID NO: 31396 - protein, 10 aa, Artificial Sequence
  source: /note="Description of Artificial Sequence: Synthetic peptide"
HNVCTEAVFY

SEQ ID NO: 31397 - protein, 10 aa, Artificial Sequence
  source: /note="Description of Artificial Sequence: Synthetic peptide"
TEAVFYYWEC

SEQ ID NO: 31398 - protein, 9 aa, Artificial Sequence
  source: /note="Description of Artificial Sequence: Synthetic peptide"
AWVSSAPGM

SEQ ID NO: 31399 - protein, 9 aa, Artificial Sequence
  source: /note="Description of Artificial Sequence: Synthetic peptide"
WVSSAPGMF

SEQ ID NO: 31400 - protein, 10 aa, Artificial Sequence
  source: /note="Description of Artificial Sequence: Synthetic peptide"
WVSSAPGMFI

SEQ ID NO: 31401 - protein, 10 aa, Artificial Sequence
  source: /note="Description of Artificial Sequence: Synthetic peptide"
AWVSSAPGMF

SEQ ID NO: 31402 - protein, 10 aa, Artificial Sequence
  source: /note="Description of Artificial Sequence: Synthetic peptide"
LAWVSSAPGM

SEQ ID NO: 31403 - protein, 10 aa, Artificial Sequence
  source: /note="Description of Artificial Sequence: Synthetic peptide"
VQCLAWVSSA

SEQ ID NO: 31404 - protein, 9 aa, Artificial Sequence
  source: /note="Description of Artificial Sequence: Synthetic peptide"
KLFNKFIQL

SEQ ID NO: 31405 - protein, 10 aa, Artificial Sequence
  source: /note="Description of Artificial Sequence: Synthetic peptide"
LKLFNKFIQL

SEQ ID NO: 31406 - protein, 9 aa, Artificial Sequence
  source: /note="Description of Artificial Sequence: Synthetic peptide"
GETKSCQTA

SEQ ID NO: 31407 - protein, 10 aa, Artificial Sequence
  source: /note="Description of Artificial Sequence: Synthetic peptide"
AVQGIRGETK

SEQ ID NO: 31408 - protein, 10 aa, Artificial Sequence
  source: /note="Description of Artificial Sequence: Synthetic peptide"
TLIDDDNPPC

SEQ ID NO: 31409 - protein, 9 aa, Artificial Sequence
  source: /note="Description of Artificial Sequence: Synthetic peptide"
LTYSDPSER

SEQ ID NO: 31410 - protein, 9 aa, Artificial Sequence
  source: /note="Description of Artificial Sequence: Synthetic peptide"
KMLTALPPA

SEQ ID NO: 31411 - protein, 9 aa, Artificial Sequence
  source: /note="Description of Artificial Sequence: Synthetic peptide"
MLTALPPAM

SEQ ID NO: 31412 - protein, 9 aa, Artificial Sequence
  source: /note="Description of Artificial Sequence: Synthetic peptide"
ALPPAMTAM

SEQ ID NO: 31413 - protein, 9 aa, Artificial Sequence
  source: /note="Description of Artificial Sequence: Synthetic peptide"
KWNKKMLTA

SEQ ID NO: 31414 - protein, 9 aa, Artificial Sequence
  source: /note="Description of Artificial Sequence: Synthetic peptide"
PAMTAMCGY

SEQ ID NO: 31415 - protein, 9 aa, Artificial Sequence
  source: /note="Description of Artificial Sequence: Synthetic peptide"
TAMCGYGIR

SEQ ID NO: 31416 - protein, 9 aa, Artificial Sequence
  source: /note="Description of Artificial Sequence: Synthetic peptide"
MTAMCGYGI

SEQ ID NO: 31417 - protein, 9 aa, Artificial Sequence
  source: /note="Description of Artificial Sequence: Synthetic peptide"
WNKKMLTAL

SEQ ID NO: 31418 - protein, 9 aa, Artificial Sequence
  source: /note="Description of Artificial Sequence: Synthetic peptide"
SQVKWNKKM

SEQ ID NO: 31419 - protein, 9 aa, Artificial Sequence
  source: /note="Description of Artificial Sequence: Synthetic peptide"
KKMLTALPP

SEQ ID NO: 31420 - protein, 10 aa, Artificial Sequence
  source: /note="Description of Artificial Sequence: Synthetic peptide"
KMLTALPPAM

SEQ ID NO: 31421 - protein, 10 aa, Artificial Sequence
  source: /note="Description of Artificial Sequence: Synthetic peptide"
AMTAMCGYGI

SEQ ID NO: 31422 - protein, 10 aa, Artificial Sequence
  source: /note="Description of Artificial Sequence: Synthetic peptide"
MLTALPPAMT

SEQ ID NO: 31423 - protein, 10 aa, Artificial Sequence
  source: /note="Description of Artificial Sequence: Synthetic peptide"
ALPPAMTAMC

SEQ ID NO: 31424 - protein, 10 aa, Artificial Sequence
  source: /note="Description of Artificial Sequence: Synthetic peptide"
MTAMCGYGIR

SEQ ID NO: 31425 - protein, 10 aa, Artificial Sequence
  source: /note="Description of Artificial Sequence: Synthetic peptide"
KWNKKMLTAL

SEQ ID NO: 31426 - protein, 10 aa, Artificial Sequence
  source: /note="Description of Artificial Sequence: Synthetic peptide"
LTALPPAMTA

SEQ ID NO: 31427 - protein, 10 aa, Artificial Sequence
  source: /note="Description of Artificial Sequence: Synthetic peptide"
TALPPAMTAM

SEQ ID NO: 31428 - protein, 10 aa, Artificial Sequence
  source: /note="Description of Artificial Sequence: Synthetic peptide"
SQVKWNKKML

SEQ ID NO: 31429 - protein, 10 aa, Artificial Sequence
  source: /note="Description of Artificial Sequence: Synthetic peptide"
VKWNKKMLTA

SEQ ID NO: 31430 - protein, 10 aa, Artificial Sequence
  source: /note="Description of Artificial Sequence: Synthetic peptide"
KKMLTALPPA

SEQ ID NO: 31431 - protein, 10 aa, Artificial Sequence
  source: /note="Description of Artificial Sequence: Synthetic peptide"
PPAMTAMCGY

SEQ ID NO: 31432 - protein, 9 aa, Artificial Sequence
  source: /note="Description of Artificial Sequence: Synthetic peptide"
LLMQKMKGL

SEQ ID NO: 31433 - protein, 9 aa, Artificial Sequence
  source: /note="Description of Artificial Sequence: Synthetic peptide"
KMKGLASYL

SEQ ID NO: 31434 - protein, 9 aa, Artificial Sequence
  source: /note="Description of Artificial Sequence: Synthetic peptide"
KYKKFKELL

SEQ ID NO: 31435 - protein, 9 aa, Artificial Sequence
  source: /note="Description of Artificial Sequence: Synthetic peptide"
LAQKRKYKK

SEQ ID NO: 31436 - protein, 9 aa, Artificial Sequence
  source: /note="Description of Artificial Sequence: Synthetic peptide"
KFKELLMQK

SEQ ID NO: 31437 - protein, 9 aa, Artificial Sequence
  source: /note="Description of Artificial Sequence: Synthetic peptide"
QKMKGLASY

SEQ ID NO: 31438 - protein, 9 aa, Artificial Sequence
  source: /note="Description of Artificial Sequence: Synthetic peptide"
RKYKKFKEL

SEQ ID NO: 31439 - protein, 9 aa, Artificial Sequence
  source: /note="Description of Artificial Sequence: Synthetic peptide"
MQKMKGLAS

SEQ ID NO: 31440 - protein, 9 aa, Artificial Sequence
  source: /note="Description of Artificial Sequence: Synthetic peptide"
AQKRKYKKF

SEQ ID NO: 31441 - protein, 9 aa, Artificial Sequence
  source: /note="Description of Artificial Sequence: Synthetic peptide"
YKKFKELLM

SEQ ID NO: 31442 - protein, 9 aa, Artificial Sequence
  source: /note="Description of Artificial Sequence: Synthetic peptide"
FKELLMQKM

SEQ ID NO: 31443 - protein, 9 aa, Artificial Sequence
  source: /note="Description of Artificial Sequence: Synthetic peptide"
LPLAQKRKY

SEQ ID NO: 31444 - protein, 10 aa, Artificial Sequence
  source: /note="Description of Artificial Sequence: Synthetic peptide"
LLMQKMKGLA

SEQ ID NO: 31445 - protein, 10 aa, Artificial Sequence
  source: /note="Description of Artificial Sequence: Synthetic peptide"
KYKKFKELLM

SEQ ID NO: 31446 - protein, 10 aa, Artificial Sequence
  source: /note="Description of Artificial Sequence: Synthetic peptide"
AQKRKYKKFK

SEQ ID NO: 31447 - protein, 10 aa, Artificial Sequence
  source: /note="Description of Artificial Sequence: Synthetic peptide"
KFKELLMQKM

SEQ ID NO: 31448 - protein, 10 aa, Artificial Sequence
  source: /note="Description of Artificial Sequence: Synthetic peptide"
MQKMKGLASY

SEQ ID NO: 31449 - protein, 10 aa, Artificial Sequence
  source: /note="Description of Artificial Sequence: Synthetic peptide"
LAQKRKYKKF

SEQ ID NO: 31450 - protein, 10 aa, Artificial Sequence
  source: /note="Description of Artificial Sequence: Synthetic peptide"
RKYKKFKELL

SEQ ID NO: 31451 - protein, 10 aa, Artificial Sequence
  source: /note="Description of Artificial Sequence: Synthetic peptide"
QKMKGLASYL

SEQ ID NO: 31452 - protein, 9 aa, Artificial Sequence
  source: /note="Description of Artificial Sequence: Synthetic peptide"
FTNYLPVAF

SEQ ID NO: 31453 - protein, 9 aa, Artificial Sequence
  source: /note="Description of Artificial Sequence: Synthetic peptide"
VIFTNYLPV

SEQ ID NO: 31454 - protein, 9 aa, Artificial Sequence
  source: /note="Description of Artificial Sequence: Synthetic peptide"
YLPVAFQLV

SEQ ID NO: 31455 - protein, 9 aa, Artificial Sequence
  source: /note="Description of Artificial Sequence: Synthetic peptide"
FQLVIHSAV

SEQ ID NO: 31456 - protein, 9 aa, Artificial Sequence
  source: /note="Description of Artificial Sequence: Synthetic peptide"
VMWGRQLKI

SEQ ID NO: 31457 - protein, 9 aa, Artificial Sequence
  source: /note="Description of Artificial Sequence: Synthetic peptide"
QIKSSFGQK

SEQ ID NO: 31458 - protein, 9 aa, Artificial Sequence
  source: /note="Description of Artificial Sequence: Synthetic peptide"
SSFGQKMGK

SEQ ID NO: 31459 - protein, 9 aa, Artificial Sequence
  source: /note="Description of Artificial Sequence: Synthetic peptide"
AVMWGRQLK

SEQ ID NO: 31460 - protein, 9 aa, Artificial Sequence
  source: /note="Description of Artificial Sequence: Synthetic peptide"
NYLPVAFQL

SEQ ID NO: 31461 - protein, 9 aa, Artificial Sequence
  source: /note="Description of Artificial Sequence: Synthetic peptide"
MGKVIFTNY

SEQ ID NO: 31462 - protein, 9 aa, Artificial Sequence
  source: /note="Description of Artificial Sequence: Synthetic peptide"
LPVAFQLVI

SEQ ID NO: 31463 - protein, 9 aa, Artificial Sequence
  source: /note="Description of Artificial Sequence: Synthetic peptide"
LSHQIKSSF

SEQ ID NO: 31464 - protein, 9 aa, Artificial Sequence
  source: /note="Description of Artificial Sequence: Synthetic peptide"
QLVIHSAVM

SEQ ID NO: 31465 - protein, 9 aa, Artificial Sequence
  source: /note="Description of Artificial Sequence: Synthetic peptide"
GQTWTGGTL

SEQ ID NO: 31466 - protein, 9 aa, Artificial Sequence
  source: /note="Description of Artificial Sequence: Synthetic peptide"
HQIKSSFGQ

SEQ ID NO: 31467 - protein, 9 aa, Artificial Sequence
  source: /note="Description of Artificial Sequence: Synthetic peptide"
IKSSFGQKM

SEQ ID NO: 31468 - protein, 9 aa, Artificial Sequence
  source: /note="Description of Artificial Sequence: Synthetic peptide"
GQKMGKVIF

SEQ ID NO: 31469 - protein, 9 aa, Artificial Sequence
  source: /note="Description of Artificial Sequence: Synthetic peptide"
GKVIFTNYL

SEQ ID NO: 31470 - protein, 9 aa, Artificial Sequence
  source: /note="Description of Artificial Sequence: Synthetic peptide"
LVIHSAVMW

SEQ ID NO: 31471 - protein, 9 aa, Artificial Sequence
  source: /note="Description of Artificial Sequence: Synthetic peptide"
SAVMWGRQL

SEQ ID NO: 31472 - protein, 10 aa, Artificial Sequence
  source: /note="Description of Artificial Sequence: Synthetic peptide"
KVIFTNYLPV

SEQ ID NO: 31473 - protein, 10 aa, Artificial Sequence
  source: /note="Description of Artificial Sequence: Synthetic peptide"
VIFTNYLPVA

SEQ ID NO: 31474 - protein, 10 aa, Artificial Sequence
  source: /note="Description of Artificial Sequence: Synthetic peptide"
YLPVAFQLVI

SEQ ID NO: 31475 - protein, 10 aa, Artificial Sequence
  source: /note="Description of Artificial Sequence: Synthetic peptide"
HQIKSSFGQK

SEQ ID NO: 31476 - protein, 10 aa, Artificial Sequence
  source: /note="Description of Artificial Sequence: Synthetic peptide"
KSSFGQKMGK

SEQ ID NO: 31477 - protein, 10 aa, Artificial Sequence
  source: /note="Description of Artificial Sequence: Synthetic peptide"
KMGKVIFTNY

SEQ ID NO: 31478 - protein, 10 aa, Artificial Sequence
  source: /note="Description of Artificial Sequence: Synthetic peptide"
VIHSAVMWGR

SEQ ID NO: 31479 - protein, 10 aa, Artificial Sequence
  source: /note="Description of Artificial Sequence: Synthetic peptide"
SAVMWGRQLK

SEQ ID NO: 31480 - protein, 10 aa, Artificial Sequence
  source: /note="Description of Artificial Sequence: Synthetic peptide"
IFTNYLPVAF

SEQ ID NO: 31481 - protein, 10 aa, Artificial Sequence
  source: /note="Description of Artificial Sequence: Synthetic peptide"
NYLPVAFQLV

SEQ ID NO: 31482 - protein, 10 aa, Artificial Sequence
  source: /note="Description of Artificial Sequence: Synthetic peptide"
MGKVIFTNYL

SEQ ID NO: 31483 - protein, 10 aa, Artificial Sequence
  source: /note="Description of Artificial Sequence: Synthetic peptide"
AVMWGRQLKI

SEQ ID NO: 31484 - protein, 10 aa, Artificial Sequence
  source: /note="Description of Artificial Sequence: Synthetic peptide"
WTGGTLSHQI

SEQ ID NO: 31485 - protein, 10 aa, Artificial Sequence
  source: /note="Description of Artificial Sequence: Synthetic peptide"
SSFGQKMGKV

SEQ ID NO: 31486 - protein, 10 aa, Artificial Sequence
  source: /note="Description of Artificial Sequence: Synthetic peptide"
TLSHQIKSSF

SEQ ID NO: 31487 - protein, 10 aa, Artificial Sequence
  source: /note="Description of Artificial Sequence: Synthetic peptide"
FQLVIHSAVM

SEQ ID NO: 31488 - protein, 10 aa, Artificial Sequence
  source: /note="Description of Artificial Sequence: Synthetic peptide"
FGQKMGKVIF

SEQ ID NO: 31489 - protein, 10 aa, Artificial Sequence
  source: /note="Description of Artificial Sequence: Synthetic peptide"
VAFQLVIHSA

SEQ ID NO: 31490 - protein, 10 aa, Artificial Sequence
  source: /note="Description of Artificial Sequence: Synthetic peptide"
HSAVMWGRQL

SEQ ID NO: 31491 - protein, 10 aa, Artificial Sequence
  source: /note="Description of Artificial Sequence: Synthetic peptide"
LPVAFQLVIH

SEQ ID NO: 31492 - protein, 10 aa, Artificial Sequence
  source: /note="Description of Artificial Sequence: Synthetic peptide"
TSWDGTRSQV

SEQ ID NO: 31493 - protein, 9 aa, Artificial Sequence
  source: /note="Description of Artificial Sequence: Synthetic peptide"
FLQRLGATI

SEQ ID NO: 31494 - protein, 9 aa, Artificial Sequence
  source: /note="Description of Artificial Sequence: Synthetic peptide"
KEFLQRLGA

SEQ ID NO: 31495 - protein, 10 aa, Artificial Sequence
  source: /note="Description of Artificial Sequence: Synthetic peptide"
EFLQRLGATI

SEQ ID NO: 31496 - protein, 10 aa, Artificial Sequence
  source: /note="Description of Artificial Sequence: Synthetic peptide"
KEFLQRLGAT

SEQ ID NO: 31497 - protein, 10 aa, Artificial Sequence
  source: /note="Description of Artificial Sequence: Synthetic peptide"
LQRLGATIEH

SEQ ID NO: 31498 - protein, 9 aa, Artificial Sequence
  source: /note="Description of Artificial Sequence: Synthetic peptide"
KTVEKPNPK

SEQ ID NO: 31499 - protein, 9 aa, Artificial Sequence
  source: /note="Description of Artificial Sequence: Synthetic peptide"
KIKTTQVFD

SEQ ID NO: 31500 - protein, 9 aa, Artificial Sequence
  source: /note="Description of Artificial Sequence: Synthetic peptide"
NPKIKTTQV

SEQ ID NO: 31501 - protein, 9 aa, Artificial Sequence
  source: /note="Description of Artificial Sequence: Synthetic peptide"
PKIKTTQVF

SEQ ID NO: 31502 - protein, 10 aa, Artificial Sequence
  source: /note="Description of Artificial Sequence: Synthetic peptide"
KIKTTQVFDI

SEQ ID NO: 31503 - protein, 10 aa, Artificial Sequence
  source: /note="Description of Artificial Sequence: Synthetic peptide"
NPKIKTTQVF

SEQ ID NO: 31504 - protein, 9 aa, Artificial Sequence
  source: /note="Description of Artificial Sequence: Synthetic peptide"
KILSWHEHA

SEQ ID NO: 31505 - protein, 9 aa, Artificial Sequence
  source: /note="Description of Artificial Sequence: Synthetic peptide"
ILSWHEHAV

SEQ ID NO: 31506 - protein, 9 aa, Artificial Sequence
  source: /note="Description of Artificial Sequence: Synthetic peptide"
KIPFKILSW

SEQ ID NO: 31507 - protein, 9 aa, Artificial Sequence
  source: /note="Description of Artificial Sequence: Synthetic peptide"
FKILSWHEH

SEQ ID NO: 31508 - protein, 10 aa, Artificial Sequence
  source: /note="Description of Artificial Sequence: Synthetic peptide"
KILSWHEHAV

SEQ ID NO: 31509 - protein, 10 aa, Artificial Sequence
  source: /note="Description of Artificial Sequence: Synthetic peptide"
SKIPFKILSW

SEQ ID NO: 31510 - protein, 10 aa, Artificial Sequence
  source: /note="Description of Artificial Sequence: Synthetic peptide"
FKILSWHEHA

SEQ ID NO: 31511 - protein, 9 aa, Artificial Sequence
  source: /note="Description of Artificial Sequence: Synthetic peptide"
NMGGGTGLF

SEQ ID NO: 31512 - protein, 9 aa, Artificial Sequence
  source: /note="Description of Artificial Sequence: Synthetic peptide"
VNMGGGTGL

SEQ ID NO: 31513 - protein, 10 aa, Artificial Sequence
  source: /note="Description of Artificial Sequence: Synthetic peptide"
NMGGGTGLFV

SEQ ID NO: 31514 - protein, 10 aa, Artificial Sequence
  source: /note="Description of Artificial Sequence: Synthetic peptide"
VNMGGGTGLF

SEQ ID NO: 31515 - protein, 9 aa, Artificial Sequence
  source: /note="Description of Artificial Sequence: Synthetic peptide"
PTTKICAEY

SEQ ID NO: 31516 - protein, 9 aa, Artificial Sequence
  source: /note="Description of Artificial Sequence: Synthetic peptide"
KICAEYSAR

SEQ ID NO: 31517 - protein, 9 aa, Artificial Sequence
  source: /note="Description of Artificial Sequence: Synthetic peptide"
RGGGLLTLK

SEQ ID NO: 31518 - protein, 9 aa, Artificial Sequence
  source: /note="Description of Artificial Sequence: Synthetic peptide"
GGGLLTLKY

SEQ ID NO: 31519 - protein, 9 aa, Artificial Sequence
  source: /note="Description of Artificial Sequence: Synthetic peptide"
CRGGGLLTL

SEQ ID NO: 31520 - protein, 10 aa, Artificial Sequence
  source: /note="Description of Artificial Sequence: Synthetic peptide"
TTKICAEYSA

SEQ ID NO: 31521 - protein, 10 aa, Artificial Sequence
  source: /note="Description of Artificial Sequence: Synthetic peptide"
RGGGLLTLKY

SEQ ID NO: 31522 - protein, 10 aa, Artificial Sequence
  source: /note="Description of Artificial Sequence: Synthetic peptide"
EYSARTDQCR

SEQ ID NO: 31523 - protein, 10 aa, Artificial Sequence
  source: /note="Description of Artificial Sequence: Synthetic peptide"
NPTTKICAEY

SEQ ID NO: 31524 - protein, 10 aa, Artificial Sequence
  source: /note="Description of Artificial Sequence: Synthetic peptide"
AEYSARTDQC

SEQ ID NO: 31525 - protein, 9 aa, Artificial Sequence
  source: /note="Description of Artificial Sequence: Synthetic peptide"
RLLPYPFHV

SEQ ID NO: 31526 - protein, 9 aa, Artificial Sequence
  source: /note="Description of Artificial Sequence: Synthetic peptide"
LLPYPFHVL

SEQ ID NO: 31527 - protein, 9 aa, Artificial Sequence
  source: /note="Description of Artificial Sequence: Synthetic peptide"
AMPQMQLQA

SEQ ID NO: 31528 - protein, 9 aa, Artificial Sequence
  source: /note="Description of Artificial Sequence: Synthetic peptide"
AMWEKGWDK

SEQ ID NO: 31529 - protein, 9 aa, Artificial Sequence
  source: /note="Description of Artificial Sequence: Synthetic peptide"
SACPRLLPY

SEQ ID NO: 31530 - protein, 9 aa, Artificial Sequence
  source: /note="Description of Artificial Sequence: Synthetic peptide"
LQALAMWEK

SEQ ID NO: 31531 - protein, 9 aa, Artificial Sequence
  source: /note="Description of Artificial Sequence: Synthetic peptide"
PYPFHVLAL

SEQ ID NO: 31532 - protein, 9 aa, Artificial Sequence
  source: /note="Description of Artificial Sequence: Synthetic peptide"
HVLALEVTF

SEQ ID NO: 31533 - protein, 9 aa, Artificial Sequence
  source: /note="Description of Artificial Sequence: Synthetic peptide"
MQLQALAMW

SEQ ID NO: 31534 - protein, 9 aa, Artificial Sequence
  source: /note="Description of Artificial Sequence: Synthetic peptide"
EVTFPPGTA

SEQ ID NO: 31535 - protein, 9 aa, Artificial Sequence
  source: /note="Description of Artificial Sequence: Synthetic peptide"
SPISACPRL

SEQ ID NO: 31536 - protein, 9 aa, Artificial Sequence
  source: /note="Description of Artificial Sequence: Synthetic peptide"
CPRLLPYPF

SEQ ID NO: 31537 - protein, 9 aa, Artificial Sequence
  source: /note="Description of Artificial Sequence: Synthetic peptide"
MPQMQLQAL

SEQ ID NO: 31538 - protein, 9 aa, Artificial Sequence
  source: /note="Description of Artificial Sequence: Synthetic peptide"
VTFPPGTAM

SEQ ID NO: 31539 - protein, 9 aa, Artificial Sequence
  source: /note="Description of Artificial Sequence: Synthetic peptide"
QMQLQALAM

SEQ ID NO: 31540 - protein, 9 aa, Artificial Sequence
  source: /note="Description of Artificial Sequence: Synthetic peptide"
HPAWLSPIS

SEQ ID NO: 31541 - protein, 9 aa, Artificial Sequence
  source: /note="Description of Artificial Sequence: Synthetic peptide"
LPYPFHVLA

SEQ ID NO: 31542 - protein, 9 aa, Artificial Sequence
  source: /note="Description of Artificial Sequence: Synthetic peptide"
LEVTFPPGT

SEQ ID NO: 31543 - protein, 10 aa, Artificial Sequence
  source: /note="Description of Artificial Sequence: Synthetic peptide"
ISACPRLLPY

SEQ ID NO: 31544 - protein, 10 aa, Artificial Sequence
  source: /note="Description of Artificial Sequence: Synthetic peptide"
RLLPYPFHVL

SEQ ID NO: 31545 - protein, 10 aa, Artificial Sequence
  source: /note="Description of Artificial Sequence: Synthetic peptide"
LLPYPFHVLA

SEQ ID NO: 31546 - protein, 10 aa, Artificial Sequence
  source: /note="Description of Artificial Sequence: Synthetic peptide"
AMPQMQLQAL

SEQ ID NO: 31547 - protein, 10 aa, Artificial Sequence
  source: /note="Description of Artificial Sequence: Synthetic peptide"
QLQALAMWEK

SEQ ID NO: 31548 - protein, 10 aa, Artificial Sequence
  source: /note="Description of Artificial Sequence: Synthetic peptide"
LAMWEKGWDK

SEQ ID NO: 31549 - protein, 10 aa, Artificial Sequence
  source: /note="Description of Artificial Sequence: Synthetic peptide"
WLSPISACPR

SEQ ID NO: 31550 - protein, 10 aa, Artificial Sequence
  source: /note="Description of Artificial Sequence: Synthetic peptide"
YPFHVLALEV

SEQ ID NO: 31551 - protein, 10 aa, Artificial Sequence
  source: /note="Description of Artificial Sequence: Synthetic peptide"
EVTFPPGTAM

SEQ ID NO: 31552 - protein, 10 aa, Artificial Sequence
  source: /note="Description of Artificial Sequence: Synthetic peptide"
HPAWLSPISA

SEQ ID NO: 31553 - protein, 10 aa, Artificial Sequence
  source: /note="Description of Artificial Sequence: Synthetic peptide"
SPISACPRLL

SEQ ID NO: 31554 - protein, 10 aa, Artificial Sequence
  source: /note="Description of Artificial Sequence: Synthetic peptide"
LPYPFHVLAL

SEQ ID NO: 31555 - protein, 10 aa, Artificial Sequence
  source: /note="Description of Artificial Sequence: Synthetic peptide"
FPPGTAMPQM

SEQ ID NO: 31556 - protein, 10 aa, Artificial Sequence
  source: /note="Description of Artificial Sequence: Synthetic peptide"
MPQMQLQALA

SEQ ID NO: 31557 - protein, 10 aa, Artificial Sequence
  source: /note="Description of Artificial Sequence: Synthetic peptide"
LQPPGGCHPA

SEQ ID NO: 31558 - protein, 10 aa, Artificial Sequence
  source: /note="Description of Artificial Sequence: Synthetic peptide"
FHVLALEVTF

SEQ ID NO: 31559 - protein, 10 aa, Artificial Sequence
  source: /note="Description of Artificial Sequence: Synthetic peptide"
LEVTFPPGTA

SEQ ID NO: 31560 - protein, 10 aa, Artificial Sequence
  source: /note="Description of Artificial Sequence: Synthetic peptide"
PQMQLQALAM

SEQ ID NO: 31561 - protein, 10 aa, Artificial Sequence
  source: /note="Description of Artificial Sequence: Synthetic peptide"
QMQLQALAMW

SEQ ID NO: 31562 - protein, 10 aa, Artificial Sequence
  source: /note="Description of Artificial Sequence: Synthetic peptide"
QPPGGCHPAW

SEQ ID NO: 31563 - protein, 10 aa, Artificial Sequence
  source: /note="Description of Artificial Sequence: Synthetic peptide"
QALAMWEKGW

SEQ ID NO: 31564 - protein, 9 aa, Artificial Sequence
  source: /note="Description of Artificial Sequence: Synthetic peptide"
TLTSAASSA

SEQ ID NO: 31565 - protein, 9 aa, Artificial Sequence
  source: /note="Description of Artificial Sequence: Synthetic peptide"
GPDWHWGAA

SEQ ID NO: 31566 - protein, 9 aa, Artificial Sequence
  source: /note="Description of Artificial Sequence: Synthetic peptide"
WHWGAAATT

SEQ ID NO: 31567 - protein, 9 aa, Artificial Sequence
  source: /note="Description of Artificial Sequence: Synthetic peptide"
HWGAAATTL

SEQ ID NO: 31568 - protein, 9 aa, Artificial Sequence
  source: /note="Description of Artificial Sequence: Synthetic peptide"
AASSAGSSW

SEQ ID NO: 31569 - protein, 10 aa, Artificial Sequence
  source: /note="Description of Artificial Sequence: Synthetic peptide"
SAGSSWTPGR

SEQ ID NO: 31570 - protein, 10 aa, Artificial Sequence
  source: /note="Description of Artificial Sequence: Synthetic peptide"
TTLTSAASSA

SEQ ID NO: 31571 - protein, 10 aa, Artificial Sequence
  source: /note="Description of Artificial Sequence: Synthetic peptide"
GPDWHWGAAA

SEQ ID NO: 31572 - protein, 10 aa, Artificial Sequence
  source: /note="Description of Artificial Sequence: Synthetic peptide"
SAASSAGSSW

SEQ ID NO: 31573 - protein, 10 aa, Artificial Sequence
  source: /note="Description of Artificial Sequence: Synthetic peptide"
WHWGAAATTL

SEQ ID NO: 31574 - protein, 10 aa, Artificial Sequence
  source: /note="Description of Artificial Sequence: Synthetic peptide"
AAATTLTSAA

SEQ ID NO: 31575 - protein, 9 aa, Artificial Sequence
  source: /note="Description of Artificial Sequence: Synthetic peptide"
CCYVTCRRY

SEQ ID NO: 31576 - protein, 9 aa, Artificial Sequence
  source: /note="Description of Artificial Sequence: Synthetic peptide"
RYERTVERY

SEQ ID NO: 31577 - protein, 9 aa, Artificial Sequence
  source: /note="Description of Artificial Sequence: Synthetic peptide"
YVTCRRYER

SEQ ID NO: 31578 - protein, 9 aa, Artificial Sequence
  source: /note="Description of Artificial Sequence: Synthetic peptide"
YERTVERYV

SEQ ID NO: 31579 - protein, 10 aa, Artificial Sequence
  source: /note="Description of Artificial Sequence: Synthetic peptide"
RRYERTVERY

SEQ ID NO: 31580 - protein, 10 aa, Artificial Sequence
  source: /note="Description of Artificial Sequence: Synthetic peptide"
CYVTCRRYER

SEQ ID NO: 31581 - protein, 10 aa, Artificial Sequence
  source: /note="Description of Artificial Sequence: Synthetic peptide"
YERTVERYVC

SEQ ID NO: 31582 - protein, 9 aa, Artificial Sequence
  source: /note="Description of Artificial Sequence: Synthetic peptide"
MMSSMACGS

SEQ ID NO: 31583 - protein, 9 aa, Artificial Sequence
  source: /note="Description of Artificial Sequence: Synthetic peptide"
SMACGSAES

SEQ ID NO: 31584 - protein, 9 aa, Artificial Sequence
  source: /note="Description of Artificial Sequence: Synthetic peptide"
MSSMACGSA

SEQ ID NO: 31585 - protein, 9 aa, Artificial Sequence
  source: /note="Description of Artificial Sequence: Synthetic peptide"
APMMSSMAC

SEQ ID NO: 31586 - protein, 9 aa, Artificial Sequence
  source: /note="Description of Artificial Sequence: Synthetic peptide"
GAAPMMSSM

SEQ ID NO: 31587 - protein, 9 aa, Artificial Sequence
  source: /note="Description of Artificial Sequence: Synthetic peptide"
SEGWHWGAA

SEQ ID NO: 31588 - protein, 9 aa, Artificial Sequence
  source: /note="Description of Artificial Sequence: Synthetic peptide"
GWHWGAAPM

SEQ ID NO: 31589 - protein, 9 aa, Artificial Sequence
  source: /note="Description of Artificial Sequence: Synthetic peptide"
WHWGAAPMM

SEQ ID NO: 31590 - protein, 10 aa, Artificial Sequence
  source: /note="Description of Artificial Sequence: Synthetic peptide"
MMSSMACGSA

SEQ ID NO: 31591 - protein, 10 aa, Artificial Sequence
  source: /note="Description of Artificial Sequence: Synthetic peptide"
SASEGWHWGA

SEQ ID NO: 31592 - protein, 10 aa, Artificial Sequence
  source: /note="Description of Artificial Sequence: Synthetic peptide"
EGWHWGAAPM

SEQ ID NO: 31593 - protein, 10 aa, Artificial Sequence
  source: /note="Description of Artificial Sequence: Synthetic peptide"
WGAAPMMSSM

SEQ ID NO: 31594 - protein, 10 aa, Artificial Sequence
  source: /note="Description of Artificial Sequence: Synthetic peptide"
GWHWGAAPMM

SEQ ID NO: 31595 - protein, 10 aa, Artificial Sequence
  source: /note="Description of Artificial Sequence: Synthetic peptide"
SMACGSAESS

SEQ ID NO: 31596 - protein, 9 aa, Artificial Sequence
  source: /note="Description of Artificial Sequence: Synthetic peptide"
RGYNQFESV

SEQ ID NO: 31597 - protein, 9 aa, Artificial Sequence
  source: /note="Description of Artificial Sequence: Synthetic peptide"
QFESVQVER

SEQ ID NO: 31598 - protein, 9 aa, Artificial Sequence
  source: /note="Description of Artificial Sequence: Synthetic peptide"
NQFESVQVE

SEQ ID NO: 31599 - protein, 10 aa, Artificial Sequence
  source: /note="Description of Artificial Sequence: Synthetic peptide"
NQFESVQVER

SEQ ID NO: 31600 - protein, 9 aa, Artificial Sequence
  source: /note="Description of Artificial Sequence: Synthetic peptide"
TLVRNHTSV

SEQ ID NO: 31601 - protein, 9 aa, Artificial Sequence
  source: /note="Description of Artificial Sequence: Synthetic peptide"
CTAGSTLVR

SEQ ID NO: 31602 - protein, 9 aa, Artificial Sequence
  source: /note="Description of Artificial Sequence: Synthetic peptide"
LVRSGRHLR

SEQ ID NO: 31603 - protein, 9 aa, Artificial Sequence
  source: /note="Description of Artificial Sequence: Synthetic peptide"
RSGRHLRPV

SEQ ID NO: 31604 - protein, 9 aa, Artificial Sequence
  source: /note="Description of Artificial Sequence: Synthetic peptide"
SGRHLRPVR

SEQ ID NO: 31605 - protein, 9 aa, Artificial Sequence
  source: /note="Description of Artificial Sequence: Synthetic peptide"
LVRNHTSVT

SEQ ID NO: 31606 - protein, 9 aa, Artificial Sequence
  source: /note="Description of Artificial Sequence: Synthetic peptide"
RNHTSVTSR

SEQ ID NO: 31607 - protein, 9 aa, Artificial Sequence
  source: /note="Description of Artificial Sequence: Synthetic peptide"
HTSVTSRTV

SEQ ID NO: 31608 - protein, 9 aa, Artificial Sequence
  source: /note="Description of Artificial Sequence: Synthetic peptide"
GFLVQTSSK

SEQ ID NO: 31609 - protein, 9 aa, Artificial Sequence
  source: /note="Description of Artificial Sequence: Synthetic peptide"
RDILSCPTY

SEQ ID NO: 31610 - protein, 9 aa, Artificial Sequence
  source: /note="Description of Artificial Sequence: Synthetic peptide"
CVLTQAAIR

SEQ ID NO: 31611 - protein, 9 aa, Artificial Sequence
  source: /note="Description of Artificial Sequence: Synthetic peptide"
DILSCPTYR

SEQ ID NO: 31612 - protein, 9 aa, Artificial Sequence
  source: /note="Description of Artificial Sequence: Synthetic peptide"
RPVRNAPSC

SEQ ID NO: 31613 - protein, 9 aa, Artificial Sequence
  source: /note="Description of Artificial Sequence: Synthetic peptide"
TLVRSGRHL

SEQ ID NO: 31614 - protein, 9 aa, Artificial Sequence
  source: /note="Description of Artificial Sequence: Synthetic peptide"
VRNAPSCVL

SEQ ID NO: 31615 - protein, 9 aa, Artificial Sequence
  source: /note="Description of Artificial Sequence: Synthetic peptide"
TQAAIRDIL

SEQ ID NO: 31616 - protein, 9 aa, Artificial Sequence
  source: /note="Description of Artificial Sequence: Synthetic peptide"
YRCTAGSTL

SEQ ID NO: 31617 - protein, 9 aa, Artificial Sequence
  source: /note="Description of Artificial Sequence: Synthetic peptide"
TSRTVNEGF

SEQ ID NO: 31618 - protein, 10 aa, Artificial Sequence
  source: /note="Description of Artificial Sequence: Synthetic peptide"
LVQTSSKDTK

SEQ ID NO: 31619 - protein, 10 aa, Artificial Sequence
  source: /note="Description of Artificial Sequence: Synthetic peptide"
TYRCTAGSTL

SEQ ID NO: 31620 - protein, 10 aa, Artificial Sequence
  source: /note="Description of Artificial Sequence: Synthetic peptide"
RSGRHLRPVR

SEQ ID NO: 31621 - protein, 10 aa, Artificial Sequence
  source: /note="Description of Artificial Sequence: Synthetic peptide"
HLRPVRNAPS

SEQ ID NO: 31622 - protein, 10 aa, Artificial Sequence
  source: /note="Description of Artificial Sequence: Synthetic peptide"
STLVRNHTSV

SEQ ID NO: 31623 - protein, 10 aa, Artificial Sequence
  source: /note="Description of Artificial Sequence: Synthetic peptide"
TSRTVNEGFL

SEQ ID NO: 31624 - protein, 10 aa, Artificial Sequence
  source: /note="Description of Artificial Sequence: Synthetic peptide"
TLVRSGRHLR

SEQ ID NO: 31625 - protein, 10 aa, Artificial Sequence
  source: /note="Description of Artificial Sequence: Synthetic peptide"
RPVRNAPSCV

SEQ ID NO: 31626 - protein, 10 aa, Artificial Sequence
  source: /note="Description of Artificial Sequence: Synthetic peptide"
APSCVLTQAA

SEQ ID NO: 31627 - protein, 10 aa, Artificial Sequence
  source: /note="Description of Artificial Sequence: Synthetic peptide"
IRDILSCPTY

SEQ ID NO: 31628 - protein, 10 aa, Artificial Sequence
  source: /note="Description of Artificial Sequence: Synthetic peptide"
VTSRTVNEGF

SEQ ID NO: 31629 - protein, 9 aa, Artificial Sequence
  source: /note="Description of Artificial Sequence: Synthetic peptide"
EMKYTSEAV

SEQ ID NO: 31630 - protein, 9 aa, Artificial Sequence
  source: /note="Description of Artificial Sequence: Synthetic peptide"
KYTSEAVRY

SEQ ID NO: 31631 - protein, 9 aa, Artificial Sequence
  source: /note="Description of Artificial Sequence: Synthetic peptide"
YTSEAVRYF

SEQ ID NO: 31632 - protein, 9 aa, Artificial Sequence
  source: /note="Description of Artificial Sequence: Synthetic peptide"
TSEAVRYFV

SEQ ID NO: 31633 - protein, 9 aa, Artificial Sequence
  source: /note="Description of Artificial Sequence: Synthetic peptide"
WEMKYTSEA

SEQ ID NO: 31634 - protein, 10 aa, Artificial Sequence
  source: /note="Description of Artificial Sequence: Synthetic peptide"
YTSEAVRYFV

SEQ ID NO: 31635 - protein, 10 aa, Artificial Sequence
  source: /note="Description of Artificial Sequence: Synthetic peptide"
KYTSEAVRYF

SEQ ID NO: 31636 - protein, 10 aa, Artificial Sequence
  source: /note="Description of Artificial Sequence: Synthetic peptide"
MKYTSEAVRY

SEQ ID NO: 31637 - protein, 10 aa, Artificial Sequence
  source: /note="Description of Artificial Sequence: Synthetic peptide"
EMKYTSEAVR

SEQ ID NO: 31638 - protein, 10 aa, Artificial Sequence
  source: /note="Description of Artificial Sequence: Synthetic peptide"
WEMKYTSEAV

SEQ ID NO: 31639 - protein, 10 aa, Artificial Sequence
  source: /note="Description of Artificial Sequence: Synthetic peptide"
SEAVRYFVDH

SEQ ID NO: 31640 - protein, 9 aa, Artificial Sequence
  source: /note="Description of Artificial Sequence: Synthetic peptide"
EQLAAKAER

SEQ ID NO: 31641 - protein, 9 aa, Artificial Sequence
  source: /note="Description of Artificial Sequence: Synthetic peptide"
AKAERDQPL

SEQ ID NO: 31642 - protein, 10 aa, Artificial Sequence
  source: /note="Description of Artificial Sequence: Synthetic peptide"
EQRAEQLAAK

SEQ ID NO: 31643 - protein, 9 aa, Artificial Sequence
  source: /note="Description of Artificial Sequence: Synthetic peptide"
ISYSREGEY

SEQ ID NO: 31644 - protein, 9 aa, Artificial Sequence
  source: /note="Description of Artificial Sequence: Synthetic peptide"
LSIEISYSR

SEQ ID NO: 31645 - protein, 9 aa, Artificial Sequence
  source: /note="Description of Artificial Sequence: Synthetic peptide"
SYSREGEYF

SEQ ID NO: 31646 - protein, 9 aa, Artificial Sequence
  source: /note="Description of Artificial Sequence: Synthetic peptide"
ILLSIEISY

SEQ ID NO: 31647 - protein, 9 aa, Artificial Sequence
  source: /note="Description of Artificial Sequence: Synthetic peptide"
IEISYSREG

SEQ ID NO: 31648 - protein, 10 aa, Artificial Sequence
  source: /note="Description of Artificial Sequence: Synthetic peptide"
ISYSREGEYF

SEQ ID NO: 31649 - protein, 10 aa, Artificial Sequence
  source: /note="Description of Artificial Sequence: Synthetic peptide"
LLSIEISYSR

SEQ ID NO: 31650 - protein, 10 aa, Artificial Sequence
  source: /note="Description of Artificial Sequence: Synthetic peptide"
EILLSIEISY

SEQ ID NO: 31651 - protein, 10 aa, Artificial Sequence
  source: /note="Description of Artificial Sequence: Synthetic peptide"
EEILLSIEIS

SEQ ID NO: 31652 - protein, 10 aa, Artificial Sequence
  source: /note="Description of Artificial Sequence: Synthetic peptide"
KDNKNNFSPK

SEQ ID NO: 31653 - protein, 10 aa, Artificial Sequence
  source: /note="Description of Artificial Sequence: Synthetic peptide"
KHIKDNKNNF

SEQ ID NO: 31654 - protein, 9 aa, Artificial Sequence
  source: /note="Description of Artificial Sequence: Synthetic peptide"
KEKEEITHI

SEQ ID NO: 31655 - protein, 10 aa, Artificial Sequence
  source: /note="Description of Artificial Sequence: Synthetic peptide"
MYLGIQSQQR

SEQ ID NO: 31656 - protein, 10 aa, Artificial Sequence
  source: /note="Description of Artificial Sequence: Synthetic peptide"
QQRKEHQRRF

SEQ ID NO: 31657 - protein, 9 aa, Artificial Sequence
  source: /note="Description of Artificial Sequence: Synthetic peptide"
KLFEFMHKT

SEQ ID NO: 31658 - protein, 9 aa, Artificial Sequence
  source: /note="Description of Artificial Sequence: Synthetic peptide"
FMHKTHDGV

SEQ ID NO: 31659 - protein, 9 aa, Artificial Sequence
  source: /note="Description of Artificial Sequence: Synthetic peptide"
KTHDGVQDM

SEQ ID NO: 31660 - protein, 10 aa, Artificial Sequence
  source: /note="Description of Artificial Sequence: Synthetic peptide"
KLFEFMHKTH

SEQ ID NO: 31661 - protein, 10 aa, Artificial Sequence
  source: /note="Description of Artificial Sequence: Synthetic peptide"
VNKLFEFMHK

SEQ ID NO: 31662 - protein, 10 aa, Artificial Sequence
  source: /note="Description of Artificial Sequence: Synthetic peptide"
KTHDGVQDMA

SEQ ID NO: 31663 - protein, 10 aa, Artificial Sequence
  source: /note="Description of Artificial Sequence: Synthetic peptide"
EFMHKTHDGV

SEQ ID NO: 31664 - protein, 10 aa, Artificial Sequence
  source: /note="Description of Artificial Sequence: Synthetic peptide"
FMHKTHDGVQ

SEQ ID NO: 31665 - protein, 10 aa, Artificial Sequence
  source: /note="Description of Artificial Sequence: Synthetic peptide"
HKTHDGVQDM

SEQ ID NO: 31666 - protein, 9 aa, Artificial Sequence
  source: /note="Description of Artificial Sequence: Synthetic peptide"
KVWSRTAYL

SEQ ID NO: 31667 - protein, 9 aa, Artificial Sequence
  source: /note="Description of Artificial Sequence: Synthetic peptide"
HSSAKVWSR

SEQ ID NO: 31668 - protein, 9 aa, Artificial Sequence
  source: /note="Description of Artificial Sequence: Synthetic peptide"
VWSRTAYLF

SEQ ID NO: 31669 - protein, 9 aa, Artificial Sequence
  source: /note="Description of Artificial Sequence: Synthetic peptide"
SAKVWSRTA

SEQ ID NO: 31670 - protein, 9 aa, Artificial Sequence
  source: /note="Description of Artificial Sequence: Synthetic peptide"
WSRTAYLFS

SEQ ID NO: 31671 - protein, 9 aa, Artificial Sequence
  source: /note="Description of Artificial Sequence: Synthetic peptide"
AKVWSRTAY

SEQ ID NO: 31672 - protein, 9 aa, Artificial Sequence
  source: /note="Description of Artificial Sequence: Synthetic peptide"
LRHSSAKVW

SEQ ID NO: 31673 - protein, 10 aa, Artificial Sequence
  source: /note="Description of Artificial Sequence: Synthetic peptide"
KVWSRTAYLF

SEQ ID NO: 31674 - protein, 10 aa, Artificial Sequence
  source: /note="Description of Artificial Sequence: Synthetic peptide"
SAKVWSRTAY

SEQ ID NO: 31675 - protein, 10 aa, Artificial Sequence
  source: /note="Description of Artificial Sequence: Synthetic peptide"
WSRTAYLFSR

SEQ ID NO: 31676 - protein, 10 aa, Artificial Sequence
  source: /note="Description of Artificial Sequence: Synthetic peptide"
GLRHSSAKVW

SEQ ID NO: 31677 - protein, 10 aa, Artificial Sequence
  source: /note="Description of Artificial Sequence: Synthetic peptide"
AKVWSRTAYL

SEQ ID NO: 31678 - protein, 9 aa, Artificial Sequence
  source: /note="Description of Artificial Sequence: Synthetic peptide"
FQVLALSGA

SEQ ID NO: 31679 - protein, 9 aa, Artificial Sequence
  source: /note="Description of Artificial Sequence: Synthetic peptide"
MKASGFDFF

SEQ ID NO: 31680 - protein, 9 aa, Artificial Sequence
  source: /note="Description of Artificial Sequence: Synthetic peptide"
SGFDFFQVL

SEQ ID NO: 31681 - protein, 9 aa, Artificial Sequence
  source: /note="Description of Artificial Sequence: Synthetic peptide"
FDFFQVLAL

SEQ ID NO: 31682 - protein, 10 aa, Artificial Sequence
  source: /note="Description of Artificial Sequence: Synthetic peptide"
KASGFDFFQV

SEQ ID NO: 31683 - protein, 10 aa, Artificial Sequence
  source: /note="Description of Artificial Sequence: Synthetic peptide"
KMKASGFDFF

SEQ ID NO: 31684 - protein, 10 aa, Artificial Sequence
  source: /note="Description of Artificial Sequence: Synthetic peptide"
FQVLALSGAG

SEQ ID NO: 31685 - protein, 9 aa, Artificial Sequence
  source: /note="Description of Artificial Sequence: Synthetic peptide"
HLYGSYPPA

SEQ ID NO: 31686 - protein, 9 aa, Artificial Sequence
  source: /note="Description of Artificial Sequence: Synthetic peptide"
RLMAPVGSV

SEQ ID NO: 31687 - protein, 9 aa, Artificial Sequence
  source: /note="Description of Artificial Sequence: Synthetic peptide"
SLLTQPSPA

SEQ ID NO: 31688 - protein, 9 aa, Artificial Sequence
  source: /note="Description of Artificial Sequence: Synthetic peptide"
LMAPVGSVM

SEQ ID NO: 31689 - protein, 9 aa, Artificial Sequence
  source: /note="Description of Artificial Sequence: Synthetic peptide"
CISMTTISR

SEQ ID NO: 31690 - protein, 9 aa, Artificial Sequence
  source: /note="Description of Artificial Sequence: Synthetic peptide"
RTPTTRLMA

SEQ ID NO: 31691 - protein, 9 aa, Artificial Sequence
  source: /note="Description of Artificial Sequence: Synthetic peptide"
TTRLMAPVG

SEQ ID NO: 31692 - protein, 9 aa, Artificial Sequence
  source: /note="Description of Artificial Sequence: Synthetic peptide"
ASACTMPPL

SEQ ID NO: 31693 - protein, 9 aa, Artificial Sequence
  source: /note="Description of Artificial Sequence: Synthetic peptide"
ISMTTISRA

SEQ ID NO: 31694 - protein, 9 aa, Artificial Sequence
  source: /note="Description of Artificial Sequence: Synthetic peptide"
LYGSYPPAR

SEQ ID NO: 31695 - protein, 9 aa, Artificial Sequence
  source: /note="Description of Artificial Sequence: Synthetic peptide"
PTTRLMAPV

SEQ ID NO: 31696 - protein, 9 aa, Artificial Sequence
  source: /note="Description of Artificial Sequence: Synthetic peptide"
HSAGLSPGA

SEQ ID NO: 31697 - protein, 9 aa, Artificial Sequence
  source: /note="Description of Artificial Sequence: Synthetic peptide"
RPTGRTPTT

SEQ ID NO: 31698 - protein, 9 aa, Artificial Sequence
  source: /note="Description of Artificial Sequence: Synthetic peptide"
HPQWAPHSA

SEQ ID NO: 31699 - protein, 9 aa, Artificial Sequence
  source: /note="Description of Artificial Sequence: Synthetic peptide"
SPGACRPAC

SEQ ID NO: 31700 - protein, 9 aa, Artificial Sequence
  source: /note="Description of Artificial Sequence: Synthetic peptide"
RPACTCISM

SEQ ID NO: 31701 - protein, 9 aa, Artificial Sequence
  source: /note="Description of Artificial Sequence: Synthetic peptide"
LLHPQWAPH

SEQ ID NO: 31702 - protein, 9 aa, Artificial Sequence
  source: /note="Description of Artificial Sequence: Synthetic peptide"
GSVMSCSLL

SEQ ID NO: 31703 - protein, 9 aa, Artificial Sequence
  source: /note="Description of Artificial Sequence: Synthetic peptide"
MTTISRATW

SEQ ID NO: 31704 - protein, 9 aa, Artificial Sequence
  source: /note="Description of Artificial Sequence: Synthetic peptide"
MPPLLHPQW

SEQ ID NO: 31705 - protein, 10 aa, Artificial Sequence
  source: /note="Description of Artificial Sequence: Synthetic peptide"
RLMAPVGSVM

SEQ ID NO: 31706 - protein, 10 aa, Artificial Sequence
  source: /note="Description of Artificial Sequence: Synthetic peptide"
LLTQPSPASA

SEQ ID NO: 31707 - protein, 10 aa, Artificial Sequence
  source: /note="Description of Artificial Sequence: Synthetic peptide"
GLSPGACRPA

SEQ ID NO: 31708 - protein, 10 aa, Artificial Sequence
  source: /note="Description of Artificial Sequence: Synthetic peptide"
HLYGSYPPAR

SEQ ID NO: 31709 - protein, 10 aa, Artificial Sequence
  source: /note="Description of Artificial Sequence: Synthetic peptide"
TMPPLLHPQW

SEQ ID NO: 31710 - protein, 10 aa, Artificial Sequence
  source: /note="Description of Artificial Sequence: Synthetic peptide"
TGRTPTTRLM

SEQ ID NO: 31711 - protein, 10 aa, Artificial Sequence
  source: /note="Description of Artificial Sequence: Synthetic peptide"
ASACTMPPLL

SEQ ID NO: 31712 - protein, 10 aa, Artificial Sequence
  source: /note="Description of Artificial Sequence: Synthetic peptide"
SYPPARQPSR

SEQ ID NO: 31713 - protein, 10 aa, Artificial Sequence
  source: /note="Description of Artificial Sequence: Synthetic peptide"
TCISMTTISR

SEQ ID NO: 31714 - protein, 10 aa, Artificial Sequence
  source: /note="Description of Artificial Sequence: Synthetic peptide"
TPTTRLMAPV

SEQ ID NO: 31715 - protein, 10 aa, Artificial Sequence
  source: /note="Description of Artificial Sequence: Synthetic peptide"
QPSPASACTM

SEQ ID NO: 31716 - protein, 10 aa, Artificial Sequence
  source: /note="Description of Artificial Sequence: Synthetic peptide"
HPQWAPHSAG

SEQ ID NO: 31717 - protein, 10 aa, Artificial Sequence
  source: /note="Description of Artificial Sequence: Synthetic peptide"
APHSAGLSPG

SEQ ID NO: 31718 - protein, 10 aa, Artificial Sequence
  source: /note="Description of Artificial Sequence: Synthetic peptide"
RPACTCISMT

SEQ ID NO: 31719 - protein, 10 aa, Artificial Sequence
  source: /note="Description of Artificial Sequence: Synthetic peptide"
FHLYGSYPPA

SEQ ID NO: 31720 - protein, 10 aa, Artificial Sequence
  source: /note="Description of Artificial Sequence: Synthetic peptide"
PQWAPHSAGL

SEQ ID NO: 31721 - protein, 10 aa, Artificial Sequence
  source: /note="Description of Artificial Sequence: Synthetic peptide"
SMTTISRATW

SEQ ID NO: 31722 - protein, 10 aa, Artificial Sequence
  source: /note="Description of Artificial Sequence: Synthetic peptide"
MPPLLHPQWA

SEQ ID NO: 31723 - protein, 9 aa, Artificial Sequence
  source: /note="Description of Artificial Sequence: Synthetic peptide"
RFRRGPLRQ

SEQ ID NO: 31724 - protein, 9 aa, Artificial Sequence
  source: /note="Description of Artificial Sequence: Synthetic peptide"
RPRFRRGPL

SEQ ID NO: 31725 - protein, 10 aa, Artificial Sequence
  source: /note="Description of Artificial Sequence: Synthetic peptide"
RPRFRRGPLR

SEQ ID NO: 31726 - protein, 10 aa, Artificial Sequence
  source: /note="Description of Artificial Sequence: Synthetic peptide"
RFRRGPLRQR

SEQ ID NO: 31727 - protein, 9 aa, Artificial Sequence
  source: /note="Description of Artificial Sequence: Synthetic peptide"
RWCPHPSST

SEQ ID NO: 31728 - protein, 9 aa, Artificial Sequence
  source: /note="Description of Artificial Sequence: Synthetic peptide"
HPSSTDGGL

SEQ ID NO: 31729 - protein, 9 aa, Artificial Sequence
  source: /note="Description of Artificial Sequence: Synthetic peptide"
CEAPGLPTS

SEQ ID NO: 31730 - protein, 10 aa, Artificial Sequence
  source: /note="Description of Artificial Sequence: Synthetic peptide"
GQRPRRWCPH

SEQ ID NO: 31731 - protein, 10 aa, Artificial Sequence
  source: /note="Description of Artificial Sequence: Synthetic peptide"
RPRRWCPHPS

SEQ ID NO: 31732 - protein, 10 aa, Artificial Sequence
  source: /note="Description of Artificial Sequence: Synthetic peptide"
APGLPTSSSL

SEQ ID NO: 31733 - protein, 10 aa, Artificial Sequence
  source: /note="Description of Artificial Sequence: Synthetic peptide"
RRWCPHPSST

SEQ ID NO: 31734 - protein, 10 aa, Artificial Sequence
  source: /note="Description of Artificial Sequence: Synthetic peptide"
CEAPGLPTSS

SEQ ID NO: 31735 - protein, 9 aa, Artificial Sequence
  source: /note="Description of Artificial Sequence: Synthetic peptide"
KTSTPLTSI

SEQ ID NO: 31736 - protein, 9 aa, Artificial Sequence
  source: /note="Description of Artificial Sequence: Synthetic peptide"
SISPRWPSL

SEQ ID NO: 31737 - protein, 9 aa, Artificial Sequence
  source: /note="Description of Artificial Sequence: Synthetic peptide"
LGWHWAFRK

SEQ ID NO: 31738 - protein, 9 aa, Artificial Sequence
  source: /note="Description of Artificial Sequence: Synthetic peptide"
WLGWHWAFR

SEQ ID NO: 31739 - protein, 9 aa, Artificial Sequence
  source: /note="Description of Artificial Sequence: Synthetic peptide"
ISPRWPSLL

SEQ ID NO: 31740 - protein, 9 aa, Artificial Sequence
  source: /note="Description of Artificial Sequence: Synthetic peptide"
SWLGWHWAF

SEQ ID NO: 31741 - protein, 9 aa, Artificial Sequence
  source: /note="Description of Artificial Sequence: Synthetic peptide"
AFRKGSPRR

SEQ ID NO: 31742 - protein, 9 aa, Artificial Sequence
  source: /note="Description of Artificial Sequence: Synthetic peptide"
KGSPRRCWA

SEQ ID NO: 31743 - protein, 9 aa, Artificial Sequence
  source: /note="Description of Artificial Sequence: Synthetic peptide"
TPLTSISPR

SEQ ID NO: 31744 - protein, 9 aa, Artificial Sequence
  source: /note="Description of Artificial Sequence: Synthetic peptide"
WAFRKGSPR

SEQ ID NO: 31745 - protein, 9 aa, Artificial Sequence
  source: /note="Description of Artificial Sequence: Synthetic peptide"
CWACVQAQR

SEQ ID NO: 31746 - protein, 9 aa, Artificial Sequence
  source: /note="Description of Artificial Sequence: Synthetic peptide"
PPGKTSTPL

SEQ ID NO: 31747 - protein, 9 aa, Artificial Sequence
  source: /note="Description of Artificial Sequence: Synthetic peptide"
SPRWPSLLT

SEQ ID NO: 31748 - protein, 9 aa, Artificial Sequence
  source: /note="Description of Artificial Sequence: Synthetic peptide"
SPRRCWACV

SEQ ID NO: 31749 - protein, 9 aa, Artificial Sequence
  source: /note="Description of Artificial Sequence: Synthetic peptide"
LLTCSWLGW

SEQ ID NO: 31750 - protein, 9 aa, Artificial Sequence
  source: /note="Description of Artificial Sequence: Synthetic peptide"
RKGSPRRCW

SEQ ID NO: 31751 - protein, 9 aa, Artificial Sequence
  source: /note="Description of Artificial Sequence: Synthetic peptide"
VQAQRWCGW

SEQ ID NO: 31752 - protein, 9 aa, Artificial Sequence
  source: /note="Description of Artificial Sequence: Synthetic peptide"
WPSLLTCSW

SEQ ID NO: 31753 - protein, 9 aa, Artificial Sequence
  source: /note="Description of Artificial Sequence: Synthetic peptide"
WACVQAQRW

SEQ ID NO: 31754 - protein, 10 aa, Artificial Sequence
  source: /note="Description of Artificial Sequence: Synthetic peptide"
SISPRWPSLL

SEQ ID NO: 31755 - protein, 10 aa, Artificial Sequence
  source: /note="Description of Artificial Sequence: Synthetic peptide"
WLGWHWAFRK

SEQ ID NO: 31756 - protein, 10 aa, Artificial Sequence
  source: /note="Description of Artificial Sequence: Synthetic peptide"
STPLTSISPR

SEQ ID NO: 31757 - protein, 10 aa, Artificial Sequence
  source: /note="Description of Artificial Sequence: Synthetic peptide"
SWLGWHWAFR

SEQ ID NO: 31758 - protein, 10 aa, Artificial Sequence
  source: /note="Description of Artificial Sequence: Synthetic peptide"
RWPSLLTCSW

SEQ ID NO: 31759 - protein, 10 aa, Artificial Sequence
  source: /note="Description of Artificial Sequence: Synthetic peptide"
SLLTCSWLGW

SEQ ID NO: 31760 - protein, 10 aa, Artificial Sequence
  source: /note="Description of Artificial Sequence: Synthetic peptide"
CSWLGWHWAF

SEQ ID NO: 31761 - protein, 10 aa, Artificial Sequence
  source: /note="Description of Artificial Sequence: Synthetic peptide"
CWACVQAQRW

SEQ ID NO: 31762 - protein, 10 aa, Artificial Sequence
  source: /note="Description of Artificial Sequence: Synthetic peptide"
TSISPRWPSL

SEQ ID NO: 31763 - protein, 10 aa, Artificial Sequence
  source: /note="Description of Artificial Sequence: Synthetic peptide"
HWAFRKGSPR

SEQ ID NO: 31764 - protein, 10 aa, Artificial Sequence
  source: /note="Description of Artificial Sequence: Synthetic peptide"
WAFRKGSPRR

SEQ ID NO: 31765 - protein, 10 aa, Artificial Sequence
  source: /note="Description of Artificial Sequence: Synthetic peptide"
APLPPGKTST

SEQ ID NO: 31766 - protein, 10 aa, Artificial Sequence
  source: /note="Description of Artificial Sequence: Synthetic peptide"
LPPGKTSTPL

SEQ ID NO: 31767 - protein, 10 aa, Artificial Sequence
  source: /note="Description of Artificial Sequence: Synthetic peptide"
SPRWPSLLTC

SEQ ID NO: 31768 - protein, 10 aa, Artificial Sequence
  source: /note="Description of Artificial Sequence: Synthetic peptide"
WPSLLTCSWL

SEQ ID NO: 31769 - protein, 10 aa, Artificial Sequence
  source: /note="Description of Artificial Sequence: Synthetic peptide"
GKTSTPLTSI

SEQ ID NO: 31770 - protein, 10 aa, Artificial Sequence
  source: /note="Description of Artificial Sequence: Synthetic peptide"
TPLTSISPRW

SEQ ID NO: 31771 - protein, 9 aa, Artificial Sequence
  source: /note="Description of Artificial Sequence: Synthetic peptide"
LGLHGTMEK

SEQ ID NO: 31772 - protein, 9 aa, Artificial Sequence
  source: /note="Description of Artificial Sequence: Synthetic peptide"
TMEKSEGMK

SEQ ID NO: 31773 - protein, 9 aa, Artificial Sequence
  source: /note="Description of Artificial Sequence: Synthetic peptide"
CIHITGMSL

SEQ ID NO: 31774 - protein, 9 aa, Artificial Sequence
  source: /note="Description of Artificial Sequence: Synthetic peptide"
IHITGMSLL

SEQ ID NO: 31775 - protein, 9 aa, Artificial Sequence
  source: /note="Description of Artificial Sequence: Synthetic peptide"
SLLGLHGTM

SEQ ID NO: 31776 - protein, 9 aa, Artificial Sequence
  source: /note="Description of Artificial Sequence: Synthetic peptide"
EKSEGMKSF

SEQ ID NO: 31777 - protein, 10 aa, Artificial Sequence
  source: /note="Description of Artificial Sequence: Synthetic peptide"
CIHITGMSLL

SEQ ID NO: 31778 - protein, 10 aa, Artificial Sequence
  source: /note="Description of Artificial Sequence: Synthetic peptide"
HITGMSLLGL

SEQ ID NO: 31779 - protein, 10 aa, Artificial Sequence
  source: /note="Description of Artificial Sequence: Synthetic peptide"
GMSLLGLHGT

SEQ ID NO: 31780 - protein, 10 aa, Artificial Sequence
  source: /note="Description of Artificial Sequence: Synthetic peptide"
LLGLHGTMEK

SEQ ID NO: 31781 - protein, 10 aa, Artificial Sequence
  source: /note="Description of Artificial Sequence: Synthetic peptide"
GTMEKSEGMK

SEQ ID NO: 31782 - protein, 10 aa, Artificial Sequence
  source: /note="Description of Artificial Sequence: Synthetic peptide"
MEKSEGMKSF

SEQ ID NO: 31783 - protein, 10 aa, Artificial Sequence
  source: /note="Description of Artificial Sequence: Synthetic peptide"
MSLLGLHGTM

SEQ ID NO: 31784 - protein, 10 aa, Artificial Sequence
  source: /note="Description of Artificial Sequence: Synthetic peptide"
GEKCIHITGM

SEQ ID NO: 31785 - protein, 10 aa, Artificial Sequence
  source: /note="Description of Artificial Sequence: Synthetic peptide"
KCIHITGMSL

SEQ ID NO: 31786 - protein, 9 aa, Artificial Sequence
  source: /note="Description of Artificial Sequence: Synthetic peptide"
FLPGYDKIV

SEQ ID NO: 31787 - protein, 9 aa, Artificial Sequence
  source: /note="Description of Artificial Sequence: Synthetic peptide"
LIFLPGYDK

SEQ ID NO: 31788 - protein, 9 aa, Artificial Sequence
  source: /note="Description of Artificial Sequence: Synthetic peptide"
IFLPGYDKI

SEQ ID NO: 31789 - protein, 10 aa, Artificial Sequence
  source: /note="Description of Artificial Sequence: Synthetic peptide"
VLIFLPGYDK

SEQ ID NO: 31790 - protein, 10 aa, Artificial Sequence
  source: /note="Description of Artificial Sequence: Synthetic peptide"
LPGYDKIVGL

SEQ ID NO: 31791 - protein, 9 aa, Artificial Sequence
  source: /note="Description of Artificial Sequence: Synthetic peptide"
RGESKFDSF

SEQ ID NO: 31792 - protein, 10 aa, Artificial Sequence
  source: /note="Description of Artificial Sequence: Synthetic peptide"
IPVKRGESKF

SEQ ID NO: 31793 - protein, 10 aa, Artificial Sequence
  source: /note="Description of Artificial Sequence: Synthetic peptide"
KRGESKFDSF

SEQ ID NO: 31794 - protein, 10 aa, Artificial Sequence
  source: /note="Description of Artificial Sequence: Synthetic peptide"
SKFDSFRQSL

SEQ ID NO: 31795 - protein, 9 aa, Artificial Sequence
  source: /note="Description of Artificial Sequence: Synthetic peptide"
WQHRGRGCL

SEQ ID NO: 31796 - protein, 10 aa, Artificial Sequence
  source: /note="Description of Artificial Sequence: Synthetic peptide"
WQHRGRGCLP

SEQ ID NO: 31797 - protein, 9 aa, Artificial Sequence
  source: /note="Description of Artificial Sequence: Synthetic peptide"
YQGLEIFFI

SEQ ID NO: 31798 - protein, 9 aa, Artificial Sequence
  source: /note="Description of Artificial Sequence: Synthetic peptide"
KQYQGLEIF

SEQ ID NO: 31799 - protein, 9 aa, Artificial Sequence
  source: /note="Description of Artificial Sequence: Synthetic peptide"
QYQGLEIFF

SEQ ID NO: 31800 - protein, 9 aa, Artificial Sequence
  source: /note="Description of Artificial Sequence: Synthetic peptide"
QGLEIFFIF

SEQ ID NO: 31801 - protein, 9 aa, Artificial Sequence
  source: /note="Description of Artificial Sequence: Synthetic peptide"
TKQYQGLEI

SEQ ID NO: 31802 - protein, 9 aa, Artificial Sequence
  source: /note="Description of Artificial Sequence: Synthetic peptide"
LEIFFIFDT

SEQ ID NO: 31803 - protein, 10 aa, Artificial Sequence
  source: /note="Description of Artificial Sequence: Synthetic peptide"
KQYQGLEIFF

SEQ ID NO: 31804 - protein, 10 aa, Artificial Sequence
  source: /note="Description of Artificial Sequence: Synthetic peptide"
QYQGLEIFFI

SEQ ID NO: 31805 - protein, 10 aa, Artificial Sequence
  source: /note="Description of Artificial Sequence: Synthetic peptide"
YQGLEIFFIF

SEQ ID NO: 31806 - protein, 10 aa, Artificial Sequence
  source: /note="Description of Artificial Sequence: Synthetic peptide"
ITKQYQGLEI

SEQ ID NO: 31807 - protein, 10 aa, Artificial Sequence
  source: /note="Description of Artificial Sequence: Synthetic peptide"
IFFIFDTNER

SEQ ID NO: 31808 - protein, 10 aa, Artificial Sequence
  source: /note="Description of Artificial Sequence: Synthetic peptide"
TKQYQGLEIF

SEQ ID NO: 31809 - protein, 9 aa, Artificial Sequence
  source: /note="Description of Artificial Sequence: Synthetic peptide"
LVCLECGDY

SEQ ID NO: 31810 - protein, 10 aa, Artificial Sequence
  source: /note="Description of Artificial Sequence: Synthetic peptide"
LLVCLECGDY

SEQ ID NO: 31811 - protein, 9 aa, Artificial Sequence
  source: /note="Description of Artificial Sequence: Synthetic peptide"
RESPLASSS

SEQ ID NO: 31812 - protein, 10 aa, Artificial Sequence
  source: /note="Description of Artificial Sequence: Synthetic peptide"
RESPLASSSP

SEQ ID NO: 31813 - protein, 9 aa, Artificial Sequence
  source: /note="Description of Artificial Sequence: Synthetic peptide"
APQAWWPAR

SEQ ID NO: 31814 - protein, 9 aa, Artificial Sequence
  source: /note="Description of Artificial Sequence: Synthetic peptide"
HSASNGTPL

SEQ ID NO: 31815 - protein, 9 aa, Artificial Sequence
  source: /note="Description of Artificial Sequence: Synthetic peptide"
LAPQAWWPA

SEQ ID NO: 31816 - protein, 9 aa, Artificial Sequence
  source: /note="Description of Artificial Sequence: Synthetic peptide"
TPLQAHPQV

SEQ ID NO: 31817 - protein, 9 aa, Artificial Sequence
  source: /note="Description of Artificial Sequence: Synthetic peptide"
WPARRGPLT

SEQ ID NO: 31818 - protein, 9 aa, Artificial Sequence
  source: /note="Description of Artificial Sequence: Synthetic peptide"
WWPARRGPL

SEQ ID NO: 31819 - protein, 9 aa, Artificial Sequence
  source: /note="Description of Artificial Sequence: Synthetic peptide"
LQAHPQVPA

SEQ ID NO: 31820 - protein, 9 aa, Artificial Sequence
  source: /note="Description of Artificial Sequence: Synthetic peptide"
QAHPQVPAL

SEQ ID NO: 31821 - protein, 9 aa, Artificial Sequence
  source: /note="Description of Artificial Sequence: Synthetic peptide"
VPALAPQAW

SEQ ID NO: 31822 - protein, 10 aa, Artificial Sequence
  source: /note="Description of Artificial Sequence: Synthetic peptide"
LQAHPQVPAL

SEQ ID NO: 31823 - protein, 10 aa, Artificial Sequence
  source: /note="Description of Artificial Sequence: Synthetic peptide"
ALAPQAWWPA

SEQ ID NO: 31824 - protein, 10 aa, Artificial Sequence
  source: /note="Description of Artificial Sequence: Synthetic peptide"
AWWPARRGPL

SEQ ID NO: 31825 - protein, 10 aa, Artificial Sequence
  source: /note="Description of Artificial Sequence: Synthetic peptide"
LAPQAWWPAR

SEQ ID NO: 31826 - protein, 10 aa, Artificial Sequence
  source: /note="Description of Artificial Sequence: Synthetic peptide"
APQAWWPARR

SEQ ID NO: 31827 - protein, 10 aa, Artificial Sequence
  source: /note="Description of Artificial Sequence: Synthetic peptide"
WPARRGPLTS

SEQ ID NO: 31828 - protein, 10 aa, Artificial Sequence
  source: /note="Description of Artificial Sequence: Synthetic peptide"
LHSASNGTPL

SEQ ID NO: 31829 - protein, 10 aa, Artificial Sequence
  source: /note="Description of Artificial Sequence: Synthetic peptide"
TSAPSAQQSL

SEQ ID NO: 31830 - protein, 10 aa, Artificial Sequence
  source: /note="Description of Artificial Sequence: Synthetic peptide"
AQQSLTKSSS

SEQ ID NO: 31831 - protein, 10 aa, Artificial Sequence
  source: /note="Description of Artificial Sequence: Synthetic peptide"
VPALAPQAWW

SEQ ID NO: 31832 - protein, 9 aa, Artificial Sequence
  source: /note="Description of Artificial Sequence: Synthetic peptide"
QLQNLIISA

SEQ ID NO: 31833 - protein, 9 aa, Artificial Sequence
  source: /note="Description of Artificial Sequence: Synthetic peptide"
LQNLIISAQ

SEQ ID NO: 31834 - protein, 10 aa, Artificial Sequence
  source: /note="Description of Artificial Sequence: Synthetic peptide"
EQLQNLIISA

SEQ ID NO: 31835 - protein, 10 aa, Artificial Sequence
  source: /note="Description of Artificial Sequence: Synthetic peptide"
QPEQLQNLII

SEQ ID NO: 31836 - protein, 9 aa, Artificial Sequence
  source: /note="Description of Artificial Sequence: Synthetic peptide"
VLKKTRNVF

SEQ ID NO: 31837 - protein, 10 aa, Artificial Sequence
  source: /note="Description of Artificial Sequence: Synthetic peptide"
VLKKTRNVFR

SEQ ID NO: 31838 - protein, 10 aa, Artificial Sequence
  source: /note="Description of Artificial Sequence: Synthetic peptide"
VTQDVLKKTR

SEQ ID NO: 31839 - protein, 9 aa, Artificial Sequence
  source: /note="Description of Artificial Sequence: Synthetic peptide"
VLLQELHAL

SEQ ID NO: 31840 - protein, 9 aa, Artificial Sequence
  source: /note="Description of Artificial Sequence: Synthetic peptide"
HLRGPLHQA

SEQ ID NO: 31841 - protein, 9 aa, Artificial Sequence
  source: /note="Description of Artificial Sequence: Synthetic peptide"
RLRCLSQLP

SEQ ID NO: 31842 - protein, 9 aa, Artificial Sequence
  source: /note="Description of Artificial Sequence: Synthetic peptide"
HVHHLRGPL

SEQ ID NO: 31843 - protein, 9 aa, Artificial Sequence
  source: /note="Description of Artificial Sequence: Synthetic peptide"
QLRPQEPHA

SEQ ID NO: 31844 - protein, 9 aa, Artificial Sequence
  source: /note="Description of Artificial Sequence: Synthetic peptide"
HAHPHGRAA

SEQ ID NO: 31845 - protein, 9 aa, Artificial Sequence
  source: /note="Description of Artificial Sequence: Synthetic peptide"
HGRAALPVR

SEQ ID NO: 31846 - protein, 9 aa, Artificial Sequence
  source: /note="Description of Artificial Sequence: Synthetic peptide"
AALPVRVLL

SEQ ID NO: 31847 - protein, 9 aa, Artificial Sequence
  source: /note="Description of Artificial Sequence: Synthetic peptide"
RVLLQELHA

SEQ ID NO: 31848 - protein, 9 aa, Artificial Sequence
  source: /note="Description of Artificial Sequence: Synthetic peptide"
AAAAHEDPY

SEQ ID NO: 31849 - protein, 9 aa, Artificial Sequence
  source: /note="Description of Artificial Sequence: Synthetic peptide"
EAIHVHHLR

SEQ ID NO: 31850 - protein, 9 aa, Artificial Sequence
  source: /note="Description of Artificial Sequence: Synthetic peptide"
HPPGRPLPT

SEQ ID NO: 31851 - protein, 9 aa, Artificial Sequence
  source: /note="Description of Artificial Sequence: Synthetic peptide"
RPLPTLAPG

SEQ ID NO: 31852 - protein, 9 aa, Artificial Sequence
  source: /note="Description of Artificial Sequence: Synthetic peptide"
HAEAHRGAA

SEQ ID NO: 31853 - protein, 9 aa, Artificial Sequence
  source: /note="Description of Artificial Sequence: Synthetic peptide"
HPLQRQVRA

SEQ ID NO: 31854 - protein, 9 aa, Artificial Sequence
  source: /note="Description of Artificial Sequence: Synthetic peptide"
LQRQVRAQL

SEQ ID NO: 31855 - protein, 9 aa, Artificial Sequence
  source: /note="Description of Artificial Sequence: Synthetic peptide"
RAALPVRVL

SEQ ID NO: 31856 - protein, 9 aa, Artificial Sequence
  source: /note="Description of Artificial Sequence: Synthetic peptide"
SQLPECHPP

SEQ ID NO: 31857 - protein, 9 aa, Artificial Sequence
  source: /note="Description of Artificial Sequence: Synthetic peptide"
RAQAEAQGL

SEQ ID NO: 31858 - protein, 9 aa, Artificial Sequence
  source: /note="Description of Artificial Sequence: Synthetic peptide"
AEAQGLSAV

SEQ ID NO: 31859 - protein, 9 aa, Artificial Sequence
  source: /note="Description of Artificial Sequence: Synthetic peptide"
AQGLSAVPH

SEQ ID NO: 31860 - protein, 9 aa, Artificial Sequence
  source: /note="Description of Artificial Sequence: Synthetic peptide"
SHHGGREAA

SEQ ID NO: 31861 - protein, 9 aa, Artificial Sequence
  source: /note="Description of Artificial Sequence: Synthetic peptide"
GEAIHVHHL

SEQ ID NO: 31862 - protein, 9 aa, Artificial Sequence
  source: /note="Description of Artificial Sequence: Synthetic peptide"
AENPHAEAH

SEQ ID NO: 31863 - protein, 9 aa, Artificial Sequence
  source: /note="Description of Artificial Sequence: Synthetic peptide"
AEAHRGAAL

SEQ ID NO: 31864 - protein, 9 aa, Artificial Sequence
  source: /note="Description of Artificial Sequence: Synthetic peptide"
AHRGAALPV

SEQ ID NO: 31865 - protein, 9 aa, Artificial Sequence
  source: /note="Description of Artificial Sequence: Synthetic peptide"
GAALPVHPL

SEQ ID NO: 31866 - protein, 9 aa, Artificial Sequence
  source: /note="Description of Artificial Sequence: Synthetic peptide"
RQVRAQLRP

SEQ ID NO: 31867 - protein, 9 aa, Artificial Sequence
  source: /note="Description of Artificial Sequence: Synthetic peptide"
AQLRPQEPH

SEQ ID NO: 31868 - protein, 9 aa, Artificial Sequence
  source: /note="Description of Artificial Sequence: Synthetic peptide"
FPDLPGGAS

SEQ ID NO: 31869 - protein, 9 aa, Artificial Sequence
  source: /note="Description of Artificial Sequence: Synthetic peptide"
DPYRGEAIH

SEQ ID NO: 31870 - protein, 10 aa, Artificial Sequence
  source: /note="Description of Artificial Sequence: Synthetic peptide"
DMFPDLPGGA

SEQ ID NO: 31871 - protein, 10 aa, Artificial Sequence
  source: /note="Description of Artificial Sequence: Synthetic peptide"
TLAPGRRAQA

SEQ ID NO: 31872 - protein, 10 aa, Artificial Sequence
  source: /note="Description of Artificial Sequence: Synthetic peptide"
AQAEAQGLSA

SEQ ID NO: 31873 - protein, 10 aa, Artificial Sequence
  source: /note="Description of Artificial Sequence: Synthetic peptide"
GQAENPHAEA

SEQ ID NO: 31874 - protein, 10 aa, Artificial Sequence
  source: /note="Description of Artificial Sequence: Synthetic peptide"
AAAAHEDPYR

SEQ ID NO: 31875 - protein, 10 aa, Artificial Sequence
  source: /note="Description of Artificial Sequence: Synthetic peptide"
AALPVHPLQR

SEQ ID NO: 31876 - protein, 10 aa, Artificial Sequence
  source: /note="Description of Artificial Sequence: Synthetic peptide"
RLRCLSQLPE

SEQ ID NO: 31877 - protein, 10 aa, Artificial Sequence
  source: /note="Description of Artificial Sequence: Synthetic peptide"
HVHHLRGPLH

SEQ ID NO: 31878 - protein, 10 aa, Artificial Sequence
  source: /note="Description of Artificial Sequence: Synthetic peptide"
LQRQVRAQLR

SEQ ID NO: 31879 - protein, 10 aa, Artificial Sequence
  source: /note="Description of Artificial Sequence: Synthetic peptide"
HAHPHGRAAL

SEQ ID NO: 31880 - protein, 10 aa, Artificial Sequence
  source: /note="Description of Artificial Sequence: Synthetic peptide"
HGRAALPVRV

SEQ ID NO: 31881 - protein, 10 aa, Artificial Sequence
  source: /note="Description of Artificial Sequence: Synthetic peptide"
RAALPVRVLL

SEQ ID NO: 31882 - protein, 10 aa, Artificial Sequence
  source: /note="Description of Artificial Sequence: Synthetic peptide"
RVLLQELHAL

SEQ ID NO: 31883 - protein, 10 aa, Artificial Sequence
  source: /note="Description of Artificial Sequence: Synthetic peptide"
HLPQSHHGGR

SEQ ID NO: 31884 - protein, 10 aa, Artificial Sequence
  source: /note="Description of Artificial Sequence: Synthetic peptide"
EAHRGAALPV

SEQ ID NO: 31885 - protein, 10 aa, Artificial Sequence
  source: /note="Description of Artificial Sequence: Synthetic peptide"
HPPGRPLPTL

SEQ ID NO: 31886 - protein, 10 aa, Artificial Sequence
  source: /note="Description of Artificial Sequence: Synthetic peptide"
APGRRAQAEA

SEQ ID NO: 31887 - protein, 10 aa, Artificial Sequence
  source: /note="Description of Artificial Sequence: Synthetic peptide"
HAEAHRGAAL

SEQ ID NO: 31888 - protein, 10 aa, Artificial Sequence
  source: /note="Description of Artificial Sequence: Synthetic peptide"
LPVHPLQRQV

SEQ ID NO: 31889 - protein, 10 aa, Artificial Sequence
  source: /note="Description of Artificial Sequence: Synthetic peptide"
RPQEPHAHPH

SEQ ID NO: 31890 - protein, 10 aa, Artificial Sequence
  source: /note="Description of Artificial Sequence: Synthetic peptide"
HPHGRAALPV

SEQ ID NO: 31891 - protein, 10 aa, Artificial Sequence
  source: /note="Description of Artificial Sequence: Synthetic peptide"
LPVRVLLQEL

SEQ ID NO: 31892 - protein, 10 aa, Artificial Sequence
  source: /note="Description of Artificial Sequence: Synthetic peptide"
EAAAAHEDPY

SEQ ID NO: 31893 - protein, 10 aa, Artificial Sequence
  source: /note="Description of Artificial Sequence: Synthetic peptide"
HQGGERLRCL

SEQ ID NO: 31894 - protein, 10 aa, Artificial Sequence
  source: /note="Description of Artificial Sequence: Synthetic peptide"
GERLRCLSQL

SEQ ID NO: 31895 - protein, 10 aa, Artificial Sequence
  source: /note="Description of Artificial Sequence: Synthetic peptide"
SQLPECHPPG

SEQ ID NO: 31896 - protein, 10 aa, Artificial Sequence
  source: /note="Description of Artificial Sequence: Synthetic peptide"
RRAQAEAQGL

SEQ ID NO: 31897 - protein, 10 aa, Artificial Sequence
  source: /note="Description of Artificial Sequence: Synthetic peptide"
AQGLSAVPHL

SEQ ID NO: 31898 - protein, 10 aa, Artificial Sequence
  source: /note="Description of Artificial Sequence: Synthetic peptide"
HEDPYRGEAI

SEQ ID NO: 31899 - protein, 10 aa, Artificial Sequence
  source: /note="Description of Artificial Sequence: Synthetic peptide"
IHVHHLRGPL

SEQ ID NO: 31900 - protein, 10 aa, Artificial Sequence
  source: /note="Description of Artificial Sequence: Synthetic peptide"
HQAGQAENPH

SEQ ID NO: 31901 - protein, 10 aa, Artificial Sequence
  source: /note="Description of Artificial Sequence: Synthetic peptide"
AHRGAALPVH

SEQ ID NO: 31902 - protein, 10 aa, Artificial Sequence
  source: /note="Description of Artificial Sequence: Synthetic peptide"
RGAALPVHPL

SEQ ID NO: 31903 - protein, 10 aa, Artificial Sequence
  source: /note="Description of Artificial Sequence: Synthetic peptide"
RQVRAQLRPQ

SEQ ID NO: 31904 - protein, 10 aa, Artificial Sequence
  source: /note="Description of Artificial Sequence: Synthetic peptide"
AQLRPQEPHA

SEQ ID NO: 31905 - protein, 10 aa, Artificial Sequence
  source: /note="Description of Artificial Sequence: Synthetic peptide"
GRAALPVRVL

SEQ ID NO: 31906 - protein, 10 aa, Artificial Sequence
  source: /note="Description of Artificial Sequence: Synthetic peptide"
FPDLPGGASG

SEQ ID NO: 31907 - protein, 10 aa, Artificial Sequence
  source: /note="Description of Artificial Sequence: Synthetic peptide"
AEAQGLSAVP

SEQ ID NO: 31908 - protein, 10 aa, Artificial Sequence
  source: /note="Description of Artificial Sequence: Synthetic peptide"
DPYRGEAIHV

SEQ ID NO: 31909 - protein, 9 aa, Artificial Sequence
  source: /note="Description of Artificial Sequence: Synthetic peptide"
TMMTRRTLL

SEQ ID NO: 31910 - protein, 9 aa, Artificial Sequence
  source: /note="Description of Artificial Sequence: Synthetic peptide"
SLTPSRLAV

SEQ ID NO: 31911 - protein, 9 aa, Artificial Sequence
  source: /note="Description of Artificial Sequence: Synthetic peptide"
CLTPRTSAA

SEQ ID NO: 31912 - protein, 9 aa, Artificial Sequence
  source: /note="Description of Artificial Sequence: Synthetic peptide"
KMMMMRRTK

SEQ ID NO: 31913 - protein, 9 aa, Artificial Sequence
  source: /note="Description of Artificial Sequence: Synthetic peptide"
MMMMRRTKR

SEQ ID NO: 31914 - protein, 9 aa, Artificial Sequence
  source: /note="Description of Artificial Sequence: Synthetic peptide"
MMMRRTKRR

SEQ ID NO: 31915 - protein, 9 aa, Artificial Sequence
  source: /note="Description of Artificial Sequence: Synthetic peptide"
MTRRTLLTK

SEQ ID NO: 31916 - protein, 9 aa, Artificial Sequence
  source: /note="Description of Artificial Sequence: Synthetic peptide"
GTGGRRMTR

SEQ ID NO: 31917 - protein, 9 aa, Artificial Sequence
  source: /note="Description of Artificial Sequence: Synthetic peptide"
TTTKMMMMR

SEQ ID NO: 31918 - protein, 9 aa, Artificial Sequence
  source: /note="Description of Artificial Sequence: Synthetic peptide"
TTKMMMMRR

SEQ ID NO: 31919 - protein, 9 aa, Artificial Sequence
  source: /note="Description of Artificial Sequence: Synthetic peptide"
SAATKALPR

SEQ ID NO: 31920 - protein, 9 aa, Artificial Sequence
  source: /note="Description of Artificial Sequence: Synthetic peptide"
RMTRRTMTT

SEQ ID NO: 31921 - protein, 9 aa, Artificial Sequence
  source: /note="Description of Artificial Sequence: Synthetic peptide"
MTRRTMTTT

SEQ ID NO: 31922 - protein, 9 aa, Artificial Sequence
  source: /note="Description of Artificial Sequence: Synthetic peptide"
TRRTMTTTK

SEQ ID NO: 31923 - protein, 9 aa, Artificial Sequence
  source: /note="Description of Artificial Sequence: Synthetic peptide"
RTMTTTKMM

SEQ ID NO: 31924 - protein, 9 aa, Artificial Sequence
  source: /note="Description of Artificial Sequence: Synthetic peptide"
MMRRTKRRR

SEQ ID NO: 31925 - protein, 9 aa, Artificial Sequence
  source: /note="Description of Artificial Sequence: Synthetic peptide"
RTKRRRRKR

SEQ ID NO: 31926 - protein, 9 aa, Artificial Sequence
  source: /note="Description of Artificial Sequence: Synthetic peptide"
RRRMTMMTR

SEQ ID NO: 31927 - protein, 9 aa, Artificial Sequence
  source: /note="Description of Artificial Sequence: Synthetic peptide"
MTMMTRRTL

SEQ ID NO: 31928 - protein, 9 aa, Artificial Sequence
  source: /note="Description of Artificial Sequence: Synthetic peptide"
RTSAATKAL

SEQ ID NO: 31929 - protein, 9 aa, Artificial Sequence
  source: /note="Description of Artificial Sequence: Synthetic peptide"
MTTTKMMMM

SEQ ID NO: 31930 - protein, 9 aa, Artificial Sequence
  source: /note="Description of Artificial Sequence: Synthetic peptide"
QTISQRRPI

SEQ ID NO: 31931 - protein, 9 aa, Artificial Sequence
  source: /note="Description of Artificial Sequence: Synthetic peptide"
RRKRRRMTM

SEQ ID NO: 31932 - protein, 9 aa, Artificial Sequence
  source: /note="Description of Artificial Sequence: Synthetic peptide"
TLLTKKTCL

SEQ ID NO: 31933 - protein, 9 aa, Artificial Sequence
  source: /note="Description of Artificial Sequence: Synthetic peptide"
IQTPPGTSL

SEQ ID NO: 31934 - protein, 9 aa, Artificial Sequence
  source: /note="Description of Artificial Sequence: Synthetic peptide"
RRTMTTTKM

SEQ ID NO: 31935 - protein, 9 aa, Artificial Sequence
  source: /note="Description of Artificial Sequence: Synthetic peptide"
TMTTTKMMM

SEQ ID NO: 31936 - protein, 9 aa, Artificial Sequence
  source: /note="Description of Artificial Sequence: Synthetic peptide"
RKRRRMTMM

SEQ ID NO: 31937 - protein, 9 aa, Artificial Sequence
  source: /note="Description of Artificial Sequence: Synthetic peptide"
TKALPRQTI

SEQ ID NO: 31938 - protein, 9 aa, Artificial Sequence
  source: /note="Description of Artificial Sequence: Synthetic peptide"
SQRRPIQTP

SEQ ID NO: 31939 - protein, 9 aa, Artificial Sequence
  source: /note="Description of Artificial Sequence: Synthetic peptide"
SRLAVLAIW

SEQ ID NO: 31940 - protein, 10 aa, Artificial Sequence
  source: /note="Description of Artificial Sequence: Synthetic peptide"
TMMTRRTLLT

SEQ ID NO: 31941 - protein, 10 aa, Artificial Sequence
  source: /note="Description of Artificial Sequence: Synthetic peptide"
CLTPRTSAAT

SEQ ID NO: 31942 - protein, 10 aa, Artificial Sequence
  source: /note="Description of Artificial Sequence: Synthetic peptide"
SLTPSRLAVL

SEQ ID NO: 31943 - protein, 10 aa, Artificial Sequence
  source: /note="Description of Artificial Sequence: Synthetic peptide"
MTRRTMTTTK

SEQ ID NO: 31944 - protein, 10 aa, Artificial Sequence
  source: /note="Description of Artificial Sequence: Synthetic peptide"
KMMMMRRTKR

SEQ ID NO: 31945 - protein, 10 aa, Artificial Sequence
  source: /note="Description of Artificial Sequence: Synthetic peptide"
MMMMRRTKRR

SEQ ID NO: 31946 - protein, 10 aa, Artificial Sequence
  source: /note="Description of Artificial Sequence: Synthetic peptide"
MMMRRTKRRR

SEQ ID NO: 31947 - protein, 10 aa, Artificial Sequence
  source: /note="Description of Artificial Sequence: Synthetic peptide"
MMTRRTLLTK

SEQ ID NO: 31948 - protein, 10 aa, Artificial Sequence
  source: /note="Description of Artificial Sequence: Synthetic peptide"
MTRRTLLTKK

SEQ ID NO: 31949 - protein, 10 aa, Artificial Sequence
  source: /note="Description of Artificial Sequence: Synthetic peptide"
MTTTKMMMMR

SEQ ID NO: 31950 - protein, 10 aa, Artificial Sequence
  source: /note="Description of Artificial Sequence: Synthetic peptide"
TTTKMMMMRR

SEQ ID NO: 31951 - protein, 10 aa, Artificial Sequence
  source: /note="Description of Artificial Sequence: Synthetic peptide"
LTPRTSAATK

SEQ ID NO: 31952 - protein, 10 aa, Artificial Sequence
  source: /note="Description of Artificial Sequence: Synthetic peptide"
TSAATKALPR

SEQ ID NO: 31953 - protein, 10 aa, Artificial Sequence
  source: /note="Description of Artificial Sequence: Synthetic peptide"
RTMTTTKMMM

SEQ ID NO: 31954 - protein, 10 aa, Artificial Sequence
  source: /note="Description of Artificial Sequence: Synthetic peptide"
MMRRTKRRRR

SEQ ID NO: 31955 - protein, 10 aa, Artificial Sequence
  source: /note="Description of Artificial Sequence: Synthetic peptide"
MRRTKRRRRK

SEQ ID NO: 31956 - protein, 10 aa, Artificial Sequence
  source: /note="Description of Artificial Sequence: Synthetic peptide"
RTKRRRRKRR

SEQ ID NO: 31957 - protein, 10 aa, Artificial Sequence
  source: /note="Description of Artificial Sequence: Synthetic peptide"
RRRKRRRMTM

SEQ ID NO: 31958 - protein, 10 aa, Artificial Sequence
  source: /note="Description of Artificial Sequence: Synthetic peptide"
KRRRMTMMTR

SEQ ID NO: 31959 - protein, 10 aa, Artificial Sequence
  source: /note="Description of Artificial Sequence: Synthetic peptide"
RRRMTMMTRR

SEQ ID NO: 31960 - protein, 10 aa, Artificial Sequence
  source: /note="Description of Artificial Sequence: Synthetic peptide"
RMTMMTRRTL

SEQ ID NO: 31961 - protein, 10 aa, Artificial Sequence
  source: /note="Description of Artificial Sequence: Synthetic peptide"
MTMMTRRTLL

SEQ ID NO: 31962 - protein, 10 aa, Artificial Sequence
  source: /note="Description of Artificial Sequence: Synthetic peptide"
RTLLTKKTCL

SEQ ID NO: 31963 - protein, 10 aa, Artificial Sequence
  source: /note="Description of Artificial Sequence: Synthetic peptide"
LTKKTCLTPR

SEQ ID NO: 31964 - protein, 10 aa, Artificial Sequence
  source: /note="Description of Artificial Sequence: Synthetic peptide"
KTCLTPRTSA

SEQ ID NO: 31965 - protein, 10 aa, Artificial Sequence
  source: /note="Description of Artificial Sequence: Synthetic peptide"
ATKALPRQTI

SEQ ID NO: 31966 - protein, 10 aa, Artificial Sequence
  source: /note="Description of Artificial Sequence: Synthetic peptide"
RQTISQRRPI

SEQ ID NO: 31967 - protein, 10 aa, Artificial Sequence
  source: /note="Description of Artificial Sequence: Synthetic peptide"
TPRTSAATKA

SEQ ID NO: 31968 - protein, 10 aa, Artificial Sequence
  source: /note="Description of Artificial Sequence: Synthetic peptide"
TPSRLAVLAI

SEQ ID NO: 31969 - protein, 10 aa, Artificial Sequence
  source: /note="Description of Artificial Sequence: Synthetic peptide"
RRKRRRMTMM

SEQ ID NO: 31970 - protein, 10 aa, Artificial Sequence
  source: /note="Description of Artificial Sequence: Synthetic peptide"
RMTRRTMTTT

SEQ ID NO: 31971 - protein, 10 aa, Artificial Sequence
  source: /note="Description of Artificial Sequence: Synthetic peptide"
TRRTMTTTKM

SEQ ID NO: 31972 - protein, 10 aa, Artificial Sequence
  source: /note="Description of Artificial Sequence: Synthetic peptide"
RRTMTTTKMM

SEQ ID NO: 31973 - protein, 10 aa, Artificial Sequence
  source: /note="Description of Artificial Sequence: Synthetic peptide"
TMTTTKMMMM

SEQ ID NO: 31974 - protein, 10 aa, Artificial Sequence
  source: /note="Description of Artificial Sequence: Synthetic peptide"
SQRRPIQTPP

SEQ ID NO: 31975 - protein, 10 aa, Artificial Sequence
  source: /note="Description of Artificial Sequence: Synthetic peptide"
IQTPPGTSLT

SEQ ID NO: 31976 - protein, 9 aa, Artificial Sequence
  source: /note="Description of Artificial Sequence: Synthetic peptide"
TMMTRRTLL

SEQ ID NO: 31977 - protein, 9 aa, Artificial Sequence
  source: /note="Description of Artificial Sequence: Synthetic peptide"
SLTPSRLAV

SEQ ID NO: 31978 - protein, 9 aa, Artificial Sequence
  source: /note="Description of Artificial Sequence: Synthetic peptide"
CLTPRTSAA

SEQ ID NO: 31979 - protein, 9 aa, Artificial Sequence
  source: /note="Description of Artificial Sequence: Synthetic peptide"
KMMMMRRTK

SEQ ID NO: 31980 - protein, 9 aa, Artificial Sequence
  source: /note="Description of Artificial Sequence: Synthetic peptide"
MMMMRRTKR

SEQ ID NO: 31981 - protein, 9 aa, Artificial Sequence
  source: /note="Description of Artificial Sequence: Synthetic peptide"
MMMRRTKRR

SEQ ID NO: 31982 - protein, 9 aa, Artificial Sequence
  source: /note="Description of Artificial Sequence: Synthetic peptide"
MTRRTLLTK

SEQ ID NO: 31983 - protein, 9 aa, Artificial Sequence
  source: /note="Description of Artificial Sequence: Synthetic peptide"
TTTKMMMMR

SEQ ID NO: 31984 - protein, 9 aa, Artificial Sequence
  source: /note="Description of Artificial Sequence: Synthetic peptide"
TTKMMMMRR

SEQ ID NO: 31985 - protein, 9 aa, Artificial Sequence
  source: /note="Description of Artificial Sequence: Synthetic peptide"
SAATKALPR

SEQ ID NO: 31986 - protein, 9 aa, Artificial Sequence
  source: /note="Description of Artificial Sequence: Synthetic peptide"
RMTRRTMTT

SEQ ID NO: 31987 - protein, 9 aa, Artificial Sequence
  source: /note="Description of Artificial Sequence: Synthetic peptide"
MTRRTMTTT

SEQ ID NO: 31988 - protein, 9 aa, Artificial Sequence
  source: /note="Description of Artificial Sequence: Synthetic peptide"
TRRTMTTTK

SEQ ID NO: 31989 - protein, 9 aa, Artificial Sequence
  source: /note="Description of Artificial Sequence: Synthetic peptide"
RTMTTTKMM

SEQ ID NO: 31990 - protein, 9 aa, Artificial Sequence
  source: /note="Description of Artificial Sequence: Synthetic peptide"
MMRRTKRRR

SEQ ID NO: 31991 - protein, 9 aa, Artificial Sequence
  source: /note="Description of Artificial Sequence: Synthetic peptide"
RTKRRRRKR

SEQ ID NO: 31992 - protein, 9 aa, Artificial Sequence
  source: /note="Description of Artificial Sequence: Synthetic peptide"
RRRMTMMTR

SEQ ID NO: 31993 - protein, 9 aa, Artificial Sequence
  source: /note="Description of Artificial Sequence: Synthetic peptide"
MTMMTRRTL

SEQ ID NO: 31994 - protein, 9 aa, Artificial Sequence
  source: /note="Description of Artificial Sequence: Synthetic peptide"
RTSAATKAL

SEQ ID NO: 31995 - protein, 9 aa, Artificial Sequence
  source: /note="Description of Artificial Sequence: Synthetic peptide"
MTTTKMMMM

SEQ ID NO: 31996 - protein, 9 aa, Artificial Sequence
  source: /note="Description of Artificial Sequence: Synthetic peptide"
QTISQRRPI

SEQ ID NO: 31997 - protein, 9 aa, Artificial Sequence
  source: /note="Description of Artificial Sequence: Synthetic peptide"
RRKRRRMTM

SEQ ID NO: 31998 - protein, 9 aa, Artificial Sequence
  source: /note="Description of Artificial Sequence: Synthetic peptide"
TLLTKKTCL

SEQ ID NO: 31999 - protein, 9 aa, Artificial Sequence
  source: /note="Description of Artificial Sequence: Synthetic peptide"
IQTPPGTSL

SEQ ID NO: 32000 - protein, 9 aa, Artificial Sequence
  source: /note="Description of Artificial Sequence: Synthetic peptide"
RRTMTTTKM

SEQ ID NO: 32001 - protein, 9 aa, Artificial Sequence
  source: /note="Description of Artificial Sequence: Synthetic peptide"
TMTTTKMMM

SEQ ID NO: 32002 - protein, 9 aa, Artificial Sequence
  source: /note="Description of Artificial Sequence: Synthetic peptide"
RKRRRMTMM

SEQ ID NO: 32003 - protein, 9 aa, Artificial Sequence
  source: /note="Description of Artificial Sequence: Synthetic peptide"
TKALPRQTI

SEQ ID NO: 32004 - protein, 9 aa, Artificial Sequence
  source: /note="Description of Artificial Sequence: Synthetic peptide"
SQRRPIQTP

SEQ ID NO: 32005 - protein, 9 aa, Artificial Sequence
  source: /note="Description of Artificial Sequence: Synthetic peptide"
SRLAVLAIW

SEQ ID NO: 32006 - protein, 10 aa, Artificial Sequence
  source: /note="Description of Artificial Sequence: Synthetic peptide"
TMMTRRTLLT

SEQ ID NO: 32007 - protein, 10 aa, Artificial Sequence
  source: /note="Description of Artificial Sequence: Synthetic peptide"
CLTPRTSAAT

SEQ ID NO: 32008 - protein, 10 aa, Artificial Sequence
  source: /note="Description of Artificial Sequence: Synthetic peptide"
SLTPSRLAVL

SEQ ID NO: 32009 - protein, 10 aa, Artificial Sequence
  source: /note="Description of Artificial Sequence: Synthetic peptide"
MTRRTMTTTK

SEQ ID NO: 32010 - protein, 10 aa, Artificial Sequence
  source: /note="Description of Artificial Sequence: Synthetic peptide"
KMMMMRRTKR

SEQ ID NO: 32011 - protein, 10 aa, Artificial Sequence
  source: /note="Description of Artificial Sequence: Synthetic peptide"
MMMMRRTKRR

SEQ ID NO: 32012 - protein, 10 aa, Artificial Sequence
  source: /note="Description of Artificial Sequence: Synthetic peptide"
MMMRRTKRRR

SEQ ID NO: 32013 - protein, 10 aa, Artificial Sequence
  source: /note="Description of Artificial Sequence: Synthetic peptide"
MMTRRTLLTK

SEQ ID NO: 32014 - protein, 10 aa, Artificial Sequence
  source: /note="Description of Artificial Sequence: Synthetic peptide"
MTRRTLLTKK

SEQ ID NO: 32015 - protein, 10 aa, Artificial Sequence
  source: /note="Description of Artificial Sequence: Synthetic peptide"
MTTTKMMMMR

SEQ ID NO: 32016 - protein, 10 aa, Artificial Sequence
  source: /note="Description of Artificial Sequence: Synthetic peptide"
TTTKMMMMRR

SEQ ID NO: 32017 - protein, 10 aa, Artificial Sequence
  source: /note="Description of Artificial Sequence: Synthetic peptide"
LTPRTSAATK

SEQ ID NO: 32018 - protein, 10 aa, Artificial Sequence
  source: /note="Description of Artificial Sequence: Synthetic peptide"
TSAATKALPR

SEQ ID NO: 32019 - protein, 10 aa, Artificial Sequence
  source: /note="Description of Artificial Sequence: Synthetic peptide"
RTMTTTKMMM

SEQ ID NO: 32020 - protein, 10 aa, Artificial Sequence
  source: /note="Description of Artificial Sequence: Synthetic peptide"
MMRRTKRRRR

SEQ ID NO: 32021 - protein, 10 aa, Artificial Sequence
  source: /note="Description of Artificial Sequence: Synthetic peptide"
MRRTKRRRRK

SEQ ID NO: 32022 - protein, 10 aa, Artificial Sequence
  source: /note="Description of Artificial Sequence: Synthetic peptide"
RTKRRRRKRR

SEQ ID NO: 32023 - protein, 10 aa, Artificial Sequence
  source: /note="Description of Artificial Sequence: Synthetic peptide"
RRRKRRRMTM

SEQ ID NO: 32024 - protein, 10 aa, Artificial Sequence
  source: /note="Description of Artificial Sequence: Synthetic peptide"
KRRRMTMMTR

SEQ ID NO: 32025 - protein, 10 aa, Artificial Sequence
  source: /note="Description of Artificial Sequence: Synthetic peptide"
RRRMTMMTRR

SEQ ID NO: 32026 - protein, 10 aa, Artificial Sequence
  source: /note="Description of Artificial Sequence: Synthetic peptide"
RMTMMTRRTL

SEQ ID NO: 32027 - protein, 10 aa, Artificial Sequence
  source: /note="Description of Artificial Sequence: Synthetic peptide"
MTMMTRRTLL

SEQ ID NO: 32028 - protein, 10 aa, Artificial Sequence
  source: /note="Description of Artificial Sequence: Synthetic peptide"
RTLLTKKTCL

SEQ ID NO: 32029 - protein, 10 aa, Artificial Sequence
  source: /note="Description of Artificial Sequence: Synthetic peptide"
LTKKTCLTPR

SEQ ID NO: 32030 - protein, 10 aa, Artificial Sequence
  source: /note="Description of Artificial Sequence: Synthetic peptide"
KTCLTPRTSA

SEQ ID NO: 32031 - protein, 10 aa, Artificial Sequence
  source: /note="Description of Artificial Sequence: Synthetic peptide"
ATKALPRQTI

SEQ ID NO: 32032 - protein, 10 aa, Artificial Sequence
  source: /note="Description of Artificial Sequence: Synthetic peptide"
RQTISQRRPI

SEQ ID NO: 32033 - protein, 10 aa, Artificial Sequence
  source: /note="Description of Artificial Sequence: Synthetic peptide"
TPRTSAATKA

SEQ ID NO: 32034 - protein, 10 aa, Artificial Sequence
  source: /note="Description of Artificial Sequence: Synthetic peptide"
TPSRLAVLAI

SEQ ID NO: 32035 - protein, 10 aa, Artificial Sequence
  source: /note="Description of Artificial Sequence: Synthetic peptide"
RRKRRRMTMM

SEQ ID NO: 32036 - protein, 10 aa, Artificial Sequence
  source: /note="Description of Artificial Sequence: Synthetic peptide"
RMTRRTMTTT

SEQ ID NO: 32037 - protein, 10 aa, Artificial Sequence
  source: /note="Description of Artificial Sequence: Synthetic peptide"
TRRTMTTTKM

SEQ ID NO: 32038 - protein, 10 aa, Artificial Sequence
  source: /note="Description of Artificial Sequence: Synthetic peptide"
RRTMTTTKMM

SEQ ID NO: 32039 - protein, 10 aa, Artificial Sequence
  source: /note="Description of Artificial Sequence: Synthetic peptide"
TMTTTKMMMM

SEQ ID NO: 32040 - protein, 10 aa, Artificial Sequence
  source: /note="Description of Artificial Sequence: Synthetic peptide"
SQRRPIQTPP

SEQ ID NO: 32041 - protein, 10 aa, Artificial Sequence
  source: /note="Description of Artificial Sequence: Synthetic peptide"
IQTPPGTSLT

SEQ ID NO: 32042 - protein, 9 aa, Artificial Sequence
  source: /note="Description of Artificial Sequence: Synthetic peptide"
LPSPPGLQL

SEQ ID NO: 32043 - protein, 10 aa, Artificial Sequence
  source: /note="Description of Artificial Sequence: Synthetic peptide"
SQFSPGDLPS

SEQ ID NO: 32044 - protein, 9 aa, Artificial Sequence
  source: /note="Description of Artificial Sequence: Synthetic peptide"
LMKKQPSKV

SEQ ID NO: 32045 - protein, 9 aa, Artificial Sequence
  source: /note="Description of Artificial Sequence: Synthetic peptide"
KVILIFLMK

SEQ ID NO: 32046 - protein, 9 aa, Artificial Sequence
  source: /note="Description of Artificial Sequence: Synthetic peptide"
VILIFLMKK

SEQ ID NO: 32047 - protein, 9 aa, Artificial Sequence
  source: /note="Description of Artificial Sequence: Synthetic peptide"
FLMKKQPSK

SEQ ID NO: 32048 - protein, 9 aa, Artificial Sequence
  source: /note="Description of Artificial Sequence: Synthetic peptide"
KNPKVILIF

SEQ ID NO: 32049 - protein, 9 aa, Artificial Sequence
  source: /note="Description of Artificial Sequence: Synthetic peptide"
KQPSKVRRK

SEQ ID NO: 32050 - protein, 9 aa, Artificial Sequence
  source: /note="Description of Artificial Sequence: Synthetic peptide"
KVRRKEAHG

SEQ ID NO: 32051 - protein, 9 aa, Artificial Sequence
  source: /note="Description of Artificial Sequence: Synthetic peptide"
RKEAHGLPL

SEQ ID NO: 32052 - protein, 10 aa, Artificial Sequence
  source: /note="Description of Artificial Sequence: Synthetic peptide"
FLMKKQPSKV

SEQ ID NO: 32053 - protein, 10 aa, Artificial Sequence
  source: /note="Description of Artificial Sequence: Synthetic peptide"
KVILIFLMKK

SEQ ID NO: 32054 - protein, 10 aa, Artificial Sequence
  source: /note="Description of Artificial Sequence: Synthetic peptide"
SIEKNVKNPK

SEQ ID NO: 32055 - protein, 10 aa, Artificial Sequence
  source: /note="Description of Artificial Sequence: Synthetic peptide"
IFLMKKQPSK

SEQ ID NO: 32056 - protein, 10 aa, Artificial Sequence
  source: /note="Description of Artificial Sequence: Synthetic peptide"
LMKKQPSKVR

SEQ ID NO: 32057 - protein, 10 aa, Artificial Sequence
  source: /note="Description of Artificial Sequence: Synthetic peptide"
KVRRKEAHGL

SEQ ID NO: 32058 - protein, 10 aa, Artificial Sequence
  source: /note="Description of Artificial Sequence: Synthetic peptide"
RRKEAHGLPL

SEQ ID NO: 32059 - protein, 10 aa, Artificial Sequence
  source: /note="Description of Artificial Sequence: Synthetic peptide"
QPSKVRRKEA

SEQ ID NO: 32060 - protein, 10 aa, Artificial Sequence
  source: /note="Description of Artificial Sequence: Synthetic peptide"
VKNPKVILIF

SEQ ID NO: 32061 - protein, 10 aa, Artificial Sequence
  source: /note="Description of Artificial Sequence: Synthetic peptide"
NPKVILIFLM

SEQ ID NO: 32062 - protein, 10 aa, Artificial Sequence
  source: /note="Description of Artificial Sequence: Synthetic peptide"
IEKNVKNPKV

SEQ ID NO: 32063 - protein, 9 aa, Artificial Sequence
  source: /note="Description of Artificial Sequence: Synthetic peptide"
AKRQRQWQW

SEQ ID NO: 32064 - protein, 10 aa, Artificial Sequence
  source: /note="Description of Artificial Sequence: Synthetic peptide"
RTPPQEADAK

SEQ ID NO: 32065 - protein, 10 aa, Artificial Sequence
  source: /note="Description of Artificial Sequence: Synthetic peptide"
RPARTPPQEA

SEQ ID NO: 32066 - protein, 9 aa, Artificial Sequence
  source: /note="Description of Artificial Sequence: Synthetic peptide"
RAHLWPTRR

SEQ ID NO: 32067 - protein, 9 aa, Artificial Sequence
  source: /note="Description of Artificial Sequence: Synthetic peptide"
QQAPPGSPS

SEQ ID NO: 32068 - protein, 10 aa, Artificial Sequence
  source: /note="Description of Artificial Sequence: Synthetic peptide"
PSRAHLWPTR

SEQ ID NO: 32069 - protein, 10 aa, Artificial Sequence
  source: /note="Description of Artificial Sequence: Synthetic peptide"
RAHLWPTRRS

SEQ ID NO: 32070 - protein, 10 aa, Artificial Sequence
  source: /note="Description of Artificial Sequence: Synthetic peptide"
SPSRAHLWPT

SEQ ID NO: 32071 - protein, 9 aa, Artificial Sequence
  source: /note="Description of Artificial Sequence: Synthetic peptide"
SSKQDRENK

SEQ ID NO: 32072 - protein, 9 aa, Artificial Sequence
  source: /note="Description of Artificial Sequence: Synthetic peptide"
KEGDTGNWY

SEQ ID NO: 32073 - protein, 9 aa, Artificial Sequence
  source: /note="Description of Artificial Sequence: Synthetic peptide"
KSFDHKPRM

SEQ ID NO: 32074 - protein, 9 aa, Artificial Sequence
  source: /note="Description of Artificial Sequence: Synthetic peptide"
FIFLCEKSF

SEQ ID NO: 32075 - protein, 10 aa, Artificial Sequence
  source: /note="Description of Artificial Sequence: Synthetic peptide"
EFIFLCEKSF

SEQ ID NO: 32076 - protein, 10 aa, Artificial Sequence
  source: /note="Description of Artificial Sequence: Synthetic peptide"
KSFDHKPRMI

SEQ ID NO: 32077 - protein, 10 aa, Artificial Sequence
  source: /note="Description of Artificial Sequence: Synthetic peptide"
GEFIFLCEKS

SEQ ID NO: 32078 - protein, 10 aa, Artificial Sequence
  source: /note="Description of Artificial Sequence: Synthetic peptide"
NVCEENNSPV

SEQ ID NO: 32079 - protein, 9 aa, Artificial Sequence
  source: /note="Description of Artificial Sequence: Synthetic peptide"
KQFFGRVIK

SEQ ID NO: 32080 - protein, 9 aa, Artificial Sequence
  source: /note="Description of Artificial Sequence: Synthetic peptide"
RAINNKQFF

SEQ ID NO: 32081 - protein, 9 aa, Artificial Sequence
  source: /note="Description of Artificial Sequence: Synthetic peptide"
INNKQFFGR

SEQ ID NO: 32082 - protein, 9 aa, Artificial Sequence
  source: /note="Description of Artificial Sequence: Synthetic peptide"
NKQFFGRVI

SEQ ID NO: 32083 - protein, 10 aa, Artificial Sequence
  source: /note="Description of Artificial Sequence: Synthetic peptide"
AINNKQFFGR

SEQ ID NO: 32084 - protein, 10 aa, Artificial Sequence
  source: /note="Description of Artificial Sequence: Synthetic peptide"
FFGRVIKASI

SEQ ID NO: 32085 - protein, 10 aa, Artificial Sequence
  source: /note="Description of Artificial Sequence: Synthetic peptide"
RAINNKQFFG

SEQ ID NO: 32086 - protein, 10 aa, Artificial Sequence
  source: /note="Description of Artificial Sequence: Synthetic peptide"
KQFFGRVIKA

SEQ ID NO: 32087 - protein, 10 aa, Artificial Sequence
  source: /note="Description of Artificial Sequence: Synthetic peptide"
CTRAINNKQF

SEQ ID NO: 32088 - protein, 9 aa, Artificial Sequence
  source: /note="Description of Artificial Sequence: Synthetic peptide"
EFLGNPHSR

SEQ ID NO: 32089 - protein, 9 aa, Artificial Sequence
  source: /note="Description of Artificial Sequence: Synthetic peptide"
LGNPHSRSW

SEQ ID NO: 32090 - protein, 9 aa, Artificial Sequence
  source: /note="Description of Artificial Sequence: Synthetic peptide"
IEFLGNPHS

SEQ ID NO: 32091 - protein, 10 aa, Artificial Sequence
  source: /note="Description of Artificial Sequence: Synthetic peptide"
YHIEFLGNPH

SEQ ID NO: 32092 - protein, 10 aa, Artificial Sequence
  source: /note="Description of Artificial Sequence: Synthetic peptide"
FLGNPHSRSW

SEQ ID NO: 32093 - protein, 9 aa, Artificial Sequence
  source: /note="Description of Artificial Sequence: Synthetic peptide"
GLVQLGQLL

SEQ ID NO: 32094 - protein, 9 aa, Artificial Sequence
  source: /note="Description of Artificial Sequence: Synthetic peptide"
VQLGQLLIF

SEQ ID NO: 32095 - protein, 9 aa, Artificial Sequence
  source: /note="Description of Artificial Sequence: Synthetic peptide"
LDFLGLVQL

SEQ ID NO: 32096 - protein, 10 aa, Artificial Sequence
  source: /note="Description of Artificial Sequence: Synthetic peptide"
LLDFLGLVQL

SEQ ID NO: 32097 - protein, 10 aa, Artificial Sequence
  source: /note="Description of Artificial Sequence: Synthetic peptide"
FLGLVQLGQL

SEQ ID NO: 32098 - protein, 10 aa, Artificial Sequence
  source: /note="Description of Artificial Sequence: Synthetic peptide"
QLGQLLIFHI

SEQ ID NO: 32099 - protein, 10 aa, Artificial Sequence
  source: /note="Description of Artificial Sequence: Synthetic peptide"
GLVQLGQLLI

SEQ ID NO: 32100 - protein, 10 aa, Artificial Sequence
  source: /note="Description of Artificial Sequence: Synthetic peptide"
LVQLGQLLIF

SEQ ID NO: 32101 - protein, 9 aa, Artificial Sequence
  source: /note="Description of Artificial Sequence: Synthetic peptide"
WAWCQHCPL

SEQ ID NO: 32102 - protein, 9 aa, Artificial Sequence
  source: /note="Description of Artificial Sequence: Synthetic peptide"
CQHCPLVAW

SEQ ID NO: 32103 - protein, 10 aa, Artificial Sequence
  source: /note="Description of Artificial Sequence: Synthetic peptide"
WAWCQHCPLV

SEQ ID NO: 32104 - protein, 9 aa, Artificial Sequence
  source: /note="Description of Artificial Sequence: Synthetic peptide"
ETEVALQPL

SEQ ID NO: 32105 - protein, 9 aa, Artificial Sequence
  source: /note="Description of Artificial Sequence: Synthetic peptide"
TEVALQPLL

SEQ ID NO: 32106 - protein, 10 aa, Artificial Sequence
  source: /note="Description of Artificial Sequence: Synthetic peptide"
AQPGVSETEV

SEQ ID NO: 32107 - protein, 10 aa, Artificial Sequence
  source: /note="Description of Artificial Sequence: Synthetic peptide"
ETEVALQPLL

SEQ ID NO: 32108 - protein, 10 aa, Artificial Sequence
  source: /note="Description of Artificial Sequence: Synthetic peptide"
SETEVALQPL

SEQ ID NO: 32109 - protein, 10 aa, Artificial Sequence
  source: /note="Description of Artificial Sequence: Synthetic peptide"
TEVALQPLLT

SEQ ID NO: 32110 - protein, 9 aa, Artificial Sequence
  source: /note="Description of Artificial Sequence: Synthetic peptide"
KSVFGGPPH

SEQ ID NO: 32111 - protein, 10 aa, Artificial Sequence
  source: /note="Description of Artificial Sequence: Synthetic peptide"
MKSVFGGPPH

SEQ ID NO: 32112 - protein, 9 aa, Artificial Sequence
  source: /note="Description of Artificial Sequence: Synthetic peptide"
KAREKGHLE

SEQ ID NO: 32113 - protein, 10 aa, Artificial Sequence
  source: /note="Description of Artificial Sequence: Synthetic peptide"
KAREKGHLEP

SEQ ID NO: 32114 - protein, 9 aa, Artificial Sequence
  source: /note="Description of Artificial Sequence: Synthetic peptide"
LEEHDGHAV

SEQ ID NO: 32115 - protein, 9 aa, Artificial Sequence
  source: /note="Description of Artificial Sequence: Synthetic peptide"
EEHDGHAVS

SEQ ID NO: 32116 - protein, 10 aa, Artificial Sequence
  source: /note="Description of Artificial Sequence: Synthetic peptide"
KLEEHDGHAV

SEQ ID NO: 32117 - protein, 10 aa, Artificial Sequence
  source: /note="Description of Artificial Sequence: Synthetic peptide"
EEHDGHAVSI

SEQ ID NO: 32118 - protein, 9 aa, Artificial Sequence
  source: /note="Description of Artificial Sequence: Synthetic peptide"
TSRAGLAAT

SEQ ID NO: 32119 - protein, 9 aa, Artificial Sequence
  source: /note="Description of Artificial Sequence: Synthetic peptide"
RAGLAATSR

SEQ ID NO: 32120 - protein, 9 aa, Artificial Sequence
  source: /note="Description of Artificial Sequence: Synthetic peptide"
ATSRAQAVA

SEQ ID NO: 32121 - protein, 10 aa, Artificial Sequence
  source: /note="Description of Artificial Sequence: Synthetic peptide"
GLAATSRAQA

SEQ ID NO: 32122 - protein, 10 aa, Artificial Sequence
  source: /note="Description of Artificial Sequence: Synthetic peptide"
TSRAQAVAST

SEQ ID NO: 32123 - protein, 10 aa, Artificial Sequence
  source: /note="Description of Artificial Sequence: Synthetic peptide"
LAATSRAQAV

SEQ ID NO: 32124 - protein, 9 aa, Artificial Sequence
  source: /note="Description of Artificial Sequence: Synthetic peptide"
QSASKNGNK

SEQ ID NO: 32125 - protein, 10 aa, Artificial Sequence
  source: /note="Description of Artificial Sequence: Synthetic peptide"
LQSASKNGNK

SEQ ID NO: 32126 - protein, 9 aa, Artificial Sequence
  source: /note="Description of Artificial Sequence: Synthetic peptide"
RQPISVAPA

SEQ ID NO: 32127 - protein, 9 aa, Artificial Sequence
  source: /note="Description of Artificial Sequence: Synthetic peptide"
RSSATLPGR

SEQ ID NO: 32128 - protein, 9 aa, Artificial Sequence
  source: /note="Description of Artificial Sequence: Synthetic peptide"
SSATLPGRR

SEQ ID NO: 32129 - protein, 9 aa, Artificial Sequence
  source: /note="Description of Artificial Sequence: Synthetic peptide"
SVAPAGPPR

SEQ ID NO: 32130 - protein, 9 aa, Artificial Sequence
  source: /note="Description of Artificial Sequence: Synthetic peptide"
ATLPGRRRR

SEQ ID NO: 32131 - protein, 9 aa, Artificial Sequence
  source: /note="Description of Artificial Sequence: Synthetic peptide"
RRRRRWLRR

SEQ ID NO: 32132 - protein, 9 aa, Artificial Sequence
  source: /note="Description of Artificial Sequence: Synthetic peptide"
RRRRQPISV

SEQ ID NO: 32133 - protein, 9 aa, Artificial Sequence
  source: /note="Description of Artificial Sequence: Synthetic peptide"
IMRPTWPGT

SEQ ID NO: 32134 - protein, 9 aa, Artificial Sequence
  source: /note="Description of Artificial Sequence: Synthetic peptide"
TLPGRRRRR

SEQ ID NO: 32135 - protein, 9 aa, Artificial Sequence
  source: /note="Description of Artificial Sequence: Synthetic peptide"
WLRRRRQPI

SEQ ID NO: 32136 - protein, 9 aa, Artificial Sequence
  source: /note="Description of Artificial Sequence: Synthetic peptide"
RPNQKPNPP

SEQ ID NO: 32137 - protein, 9 aa, Artificial Sequence
  source: /note="Description of Artificial Sequence: Synthetic peptide"
RPTWPGTSA

SEQ ID NO: 32138 - protein, 9 aa, Artificial Sequence
  source: /note="Description of Artificial Sequence: Synthetic peptide"
LQNGGGSRS

SEQ ID NO: 32139 - protein, 9 aa, Artificial Sequence
  source: /note="Description of Artificial Sequence: Synthetic peptide"
RRRQPISVA

SEQ ID NO: 32140 - protein, 9 aa, Artificial Sequence
  source: /note="Description of Artificial Sequence: Synthetic peptide"
RCVIMRPTW

SEQ ID NO: 32141 - protein, 9 aa, Artificial Sequence
  source: /note="Description of Artificial Sequence: Synthetic peptide"
PTWPGTSAF

SEQ ID NO: 32142 - protein, 9 aa, Artificial Sequence
  source: /note="Description of Artificial Sequence: Synthetic peptide"
QPISVAPAG

SEQ ID NO: 32143 - protein, 10 aa, Artificial Sequence
  source: /note="Description of Artificial Sequence: Synthetic peptide"
RSSATLPGRR

SEQ ID NO: 32144 - protein, 10 aa, Artificial Sequence
  source: /note="Description of Artificial Sequence: Synthetic peptide"
ISVAPAGPPR

SEQ ID NO: 32145 - protein, 10 aa, Artificial Sequence
  source: /note="Description of Artificial Sequence: Synthetic peptide"
SVAPAGPPRR

SEQ ID NO: 32146 - protein, 10 aa, Artificial Sequence
  source: /note="Description of Artificial Sequence: Synthetic peptide"
RWLRRRRQPI

SEQ ID NO: 32147 - protein, 10 aa, Artificial Sequence
  source: /note="Description of Artificial Sequence: Synthetic peptide"
GSRSSATLPG

SEQ ID NO: 32148 - protein, 10 aa, Artificial Sequence
  source: /note="Description of Artificial Sequence: Synthetic peptide"
ATLPGRRRRR

SEQ ID NO: 32149 - protein, 10 aa, Artificial Sequence
  source: /note="Description of Artificial Sequence: Synthetic peptide"
RRRRRWLRRR

SEQ ID NO: 32150 - protein, 10 aa, Artificial Sequence
  source: /note="Description of Artificial Sequence: Synthetic peptide"
RRRRQPISVA

SEQ ID NO: 32151 - protein, 10 aa, Artificial Sequence
  source: /note="Description of Artificial Sequence: Synthetic peptide"
AGPPRRPNQK

SEQ ID NO: 32152 - protein, 10 aa, Artificial Sequence
  source: /note="Description of Artificial Sequence: Synthetic peptide"
IMRPTWPGTS

SEQ ID NO: 32153 - protein, 10 aa, Artificial Sequence
  source: /note="Description of Artificial Sequence: Synthetic peptide"
LPGRRRRRWL

SEQ ID NO: 32154 - protein, 10 aa, Artificial Sequence
  source: /note="Description of Artificial Sequence: Synthetic peptide"
RPNQKPNPPG

SEQ ID NO: 32155 - protein, 10 aa, Artificial Sequence
  source: /note="Description of Artificial Sequence: Synthetic peptide"
RPTWPGTSAF

SEQ ID NO: 32156 - protein, 10 aa, Artificial Sequence
  source: /note="Description of Artificial Sequence: Synthetic peptide"
WLRRRRQPIS

SEQ ID NO: 32157 - protein, 10 aa, Artificial Sequence
  source: /note="Description of Artificial Sequence: Synthetic peptide"
LRRRRQPISV

SEQ ID NO: 32158 - protein, 10 aa, Artificial Sequence
  source: /note="Description of Artificial Sequence: Synthetic peptide"
LQNGGGSRSS

SEQ ID NO: 32159 - protein, 10 aa, Artificial Sequence
  source: /note="Description of Artificial Sequence: Synthetic peptide"
RRQPISVAPA

SEQ ID NO: 32160 - protein, 10 aa, Artificial Sequence
  source: /note="Description of Artificial Sequence: Synthetic peptide"
HTAGAAAAAA

SEQ ID NO: 32161 - protein, 9 aa, Artificial Sequence
  source: /note="Description of Artificial Sequence: Synthetic peptide"
TARCLEGQR

SEQ ID NO: 32162 - protein, 9 aa, Artificial Sequence
  source: /note="Description of Artificial Sequence: Synthetic peptide"
SEGNTARCL

SEQ ID NO: 32163 - protein, 9 aa, Artificial Sequence
  source: /note="Description of Artificial Sequence: Synthetic peptide"
EERVGTRGW

SEQ ID NO: 32164 - protein, 10 aa, Artificial Sequence
  source: /note="Description of Artificial Sequence: Synthetic peptide"
NTARCLEGQR

SEQ ID NO: 32165 - protein, 10 aa, Artificial Sequence
  source: /note="Description of Artificial Sequence: Synthetic peptide"
GQRRGGRGQH

SEQ ID NO: 32166 - protein, 10 aa, Artificial Sequence
  source: /note="Description of Artificial Sequence: Synthetic peptide"
GQHRSEGNTA

SEQ ID NO: 32167 - protein, 10 aa, Artificial Sequence
  source: /note="Description of Artificial Sequence: Synthetic peptide"
REERVGTRGW

SEQ ID NO: 32168 - protein, 10 aa, Artificial Sequence
  source: /note="Description of Artificial Sequence: Synthetic peptide"
EERVGTRGWF

SEQ ID NO: 32169 - protein, 9 aa, Artificial Sequence
  source: /note="Description of Artificial Sequence: Synthetic peptide"
AEVNLGGAV

SEQ ID NO: 32170 - protein, 9 aa, Artificial Sequence
  source: /note="Description of Artificial Sequence: Synthetic peptide"
IQHNLHFGL

SEQ ID NO: 32171 - protein, 9 aa, Artificial Sequence
  source: /note="Description of Artificial Sequence: Synthetic peptide"
NLHFGLAPA

SEQ ID NO: 32172 - protein, 9 aa, Artificial Sequence
  source: /note="Description of Artificial Sequence: Synthetic peptide"
KQIQHNLHF

SEQ ID NO: 32173 - protein, 10 aa, Artificial Sequence
  source: /note="Description of Artificial Sequence: Synthetic peptide"
MKQIQHNLHF

SEQ ID NO: 32174 - protein, 10 aa, Artificial Sequence
  source: /note="Description of Artificial Sequence: Synthetic peptide"
KQIQHNLHFG

SEQ ID NO: 32175 - protein, 10 aa, Artificial Sequence
  source: /note="Description of Artificial Sequence: Synthetic peptide"
IQHNLHFGLA

SEQ ID NO: 32176 - protein, 10 aa, Artificial Sequence
  source: /note="Description of Artificial Sequence: Synthetic peptide"
LHFGLAPAEA

SEQ ID NO: 32177 - protein, 10 aa, Artificial Sequence
  source: /note="Description of Artificial Sequence: Synthetic peptide"
NSKDNHLDAK

SEQ ID NO: 32178 - protein, 9 aa, Artificial Sequence
  source: /note="Description of Artificial Sequence: Synthetic peptide"
QQHMHFLAA

SEQ ID NO: 32179 - protein, 9 aa, Artificial Sequence
  source: /note="Description of Artificial Sequence: Synthetic peptide"
ELWQEQQHM

SEQ ID NO: 32180 - protein, 9 aa, Artificial Sequence
  source: /note="Description of Artificial Sequence: Synthetic peptide"
WQEQQHMHF

SEQ ID NO: 32181 - protein, 9 aa, Artificial Sequence
  source: /note="Description of Artificial Sequence: Synthetic peptide"
QEQQHMHFL

SEQ ID NO: 32182 - protein, 10 aa, Artificial Sequence
  source: /note="Description of Artificial Sequence: Synthetic peptide"
LWQEQQHMHF

SEQ ID NO: 32183 - protein, 10 aa, Artificial Sequence
  source: /note="Description of Artificial Sequence: Synthetic peptide"
LELWQEQQHM

SEQ ID NO: 32184 - protein, 10 aa, Artificial Sequence
  source: /note="Description of Artificial Sequence: Synthetic peptide"
WQEQQHMHFL

SEQ ID NO: 32185 - protein, 10 aa, Artificial Sequence
  source: /note="Description of Artificial Sequence: Synthetic peptide"
EQQHMHFLAA

SEQ ID NO: 32186 - protein, 10 aa, Artificial Sequence
  source: /note="Description of Artificial Sequence: Synthetic peptide"
QQHMHFLAAQ

SEQ ID NO: 32187 - protein, 10 aa, Artificial Sequence
  source: /note="Description of Artificial Sequence: Synthetic peptide"
QEQQHMHFLA

SEQ ID NO: 32188 - protein, 9 aa, Artificial Sequence
  source: /note="Description of Artificial Sequence: Synthetic peptide"
RLRQQLVCH

SEQ ID NO: 32189 - protein, 9 aa, Artificial Sequence
  source: /note="Description of Artificial Sequence: Synthetic peptide"
QQLVCHQRI

SEQ ID NO: 32190 - protein, 10 aa, Artificial Sequence
  source: /note="Description of Artificial Sequence: Synthetic peptide"
RQQLVCHQRI

SEQ ID NO: 32191 - protein, 10 aa, Artificial Sequence
  source: /note="Description of Artificial Sequence: Synthetic peptide"
LVCHQRIHTR

SEQ ID NO: 32192 - protein, 10 aa, Artificial Sequence
  source: /note="Description of Artificial Sequence: Synthetic peptide"
QQLVCHQRIH

SEQ ID NO: 32193 - protein, 9 aa, Artificial Sequence
  source: /note="Description of Artificial Sequence: Synthetic peptide"
DFSLEEWEF

SEQ ID NO: 32194 - protein, 9 aa, Artificial Sequence
  source: /note="Description of Artificial Sequence: Synthetic peptide"
RDVAIDFSL

SEQ ID NO: 32195 - protein, 10 aa, Artificial Sequence
  source: /note="Description of Artificial Sequence: Synthetic peptide"
VAIDFSLEEW

SEQ ID NO: 32196 - protein, 10 aa, Artificial Sequence
  source: /note="Description of Artificial Sequence: Synthetic peptide"
IDFSLEEWEF

SEQ ID NO: 32197 - protein, 10 aa, Artificial Sequence
  source: /note="Description of Artificial Sequence: Synthetic peptide"
LEEWEFLDPA

SEQ ID NO: 32198 - protein, 9 aa, Artificial Sequence
  source: /note="Description of Artificial Sequence: Synthetic peptide"
RSSLTVHQI

SEQ ID NO: 32199 - protein, 9 aa, Artificial Sequence
  source: /note="Description of Artificial Sequence: Synthetic peptide"
SSLTVHQII

SEQ ID NO: 32200 - protein, 10 aa, Artificial Sequence
  source: /note="Description of Artificial Sequence: Synthetic peptide"
RSSLTVHQII

SEQ ID NO: 32201 - protein, 9 aa, Artificial Sequence
  source: /note="Description of Artificial Sequence: Synthetic peptide"
QIIHTEERY

SEQ ID NO: 32202 - protein, 9 aa, Artificial Sequence
  source: /note="Description of Artificial Sequence: Synthetic peptide"
HQIIHTEER

SEQ ID NO: 32203 - protein, 9 aa, Artificial Sequence
  source: /note="Description of Artificial Sequence: Synthetic peptide"
IQHQIIHTE

SEQ ID NO: 32204 - protein, 10 aa, Artificial Sequence
  source: /note="Description of Artificial Sequence: Synthetic peptide"
HQIIHTEERY

SEQ ID NO: 32205 - protein, 9 aa, Artificial Sequence
  source: /note="Description of Artificial Sequence: Synthetic peptide"
RAFGTRNAL

SEQ ID NO: 32206 - protein, 9 aa, Artificial Sequence
  source: /note="Description of Artificial Sequence: Synthetic peptide"
GTRNALHLG

SEQ ID NO: 32207 - protein, 9 aa, Artificial Sequence
  source: /note="Description of Artificial Sequence: Synthetic peptide"
NALHLGFPR

SEQ ID NO: 32208 - protein, 9 aa, Artificial Sequence
  source: /note="Description of Artificial Sequence: Synthetic peptide"
TRNALHLGF

SEQ ID NO: 32209 - protein, 10 aa, Artificial Sequence
  source: /note="Description of Artificial Sequence: Synthetic peptide"
RAFGTRNALH

SEQ ID NO: 32210 - protein, 10 aa, Artificial Sequence
  source: /note="Description of Artificial Sequence: Synthetic peptide"
GTRNALHLGF

SEQ ID NO: 32211 - protein, 10 aa, Artificial Sequence
  source: /note="Description of Artificial Sequence: Synthetic peptide"
RNALHLGFPR

SEQ ID NO: 32212 - protein, 10 aa, Artificial Sequence
  source: /note="Description of Artificial Sequence: Synthetic peptide"
LRAFGTRNAL

SEQ ID NO: 32213 - protein, 9 aa, Artificial Sequence
  source: /note="Description of Artificial Sequence: Synthetic peptide"
AFIESSKLK

SEQ ID NO: 32214 - protein, 9 aa, Artificial Sequence
  source: /note="Description of Artificial Sequence: Synthetic peptide"
KAFIESSKL

SEQ ID NO: 32215 - protein, 10 aa, Artificial Sequence
  source: /note="Description of Artificial Sequence: Synthetic peptide"
KAFIESSKLK

SEQ ID NO: 32216 - protein, 10 aa, Artificial Sequence
  source: /note="Description of Artificial Sequence: Synthetic peptide"
CGKAFIESSK

SEQ ID NO: 32217 - protein, 10 aa, Artificial Sequence
  source: /note="Description of Artificial Sequence: Synthetic peptide"
AFIESSKLKR

SEQ ID NO: 32218 - protein, 10 aa, Artificial Sequence
  source: /note="Description of Artificial Sequence: Synthetic peptide"
GKAFIESSKL

SEQ ID NO: 32219 - protein, 10 aa, Artificial Sequence
  source: /note="Description of Artificial Sequence: Synthetic peptide"
IESSKLKRHF

SEQ ID NO: 32220 - protein, 10 aa, Artificial Sequence
  source: /note="Description of Artificial Sequence: Synthetic peptide"
AECGKAFIES

SEQ ID NO: 32221 - protein, 9 aa, Artificial Sequence
  source: /note="Description of Artificial Sequence: Synthetic peptide"
RMHVRIHTG

SEQ ID NO: 32222 - protein, 9 aa, Artificial Sequence
  source: /note="Description of Artificial Sequence: Synthetic peptide"
DFNLRMHVR

SEQ ID NO: 32223 - protein, 9 aa, Artificial Sequence
  source: /note="Description of Artificial Sequence: Synthetic peptide"
FSLDFNLRM

SEQ ID NO: 32224 - protein, 10 aa, Artificial Sequence
  source: /note="Description of Artificial Sequence: Synthetic peptide"
SLDFNLRMHV

SEQ ID NO: 32225 - protein, 10 aa, Artificial Sequence
  source: /note="Description of Artificial Sequence: Synthetic peptide"
RFSLDFNLRM

SEQ ID NO: 32226 - protein, 10 aa, Artificial Sequence
  source: /note="Description of Artificial Sequence: Synthetic peptide"
RMHVRIHTGE

SEQ ID NO: 32227 - protein, 10 aa, Artificial Sequence
  source: /note="Description of Artificial Sequence: Synthetic peptide"
NLRMHVRIHT

SEQ ID NO: 32228 - protein, 9 aa, Artificial Sequence
  source: /note="Description of Artificial Sequence: Synthetic peptide"
AFRKKNQPA

SEQ ID NO: 32229 - protein, 10 aa, Artificial Sequence
  source: /note="Description of Artificial Sequence: Synthetic peptide"
RAFRKKNQPA

SEQ ID NO: 32230 - protein, 9 aa, Artificial Sequence
  source: /note="Description of Artificial Sequence: Synthetic peptide"
QLLRAQAPL

SEQ ID NO: 32231 - protein, 9 aa, Artificial Sequence
  source: /note="Description of Artificial Sequence: Synthetic peptide"
RLGDPGQDV

SEQ ID NO: 32232 - protein, 9 aa, Artificial Sequence
  source: /note="Description of Artificial Sequence: Synthetic peptide"
LLRAQAPLL

SEQ ID NO: 32233 - protein, 9 aa, Artificial Sequence
  source: /note="Description of Artificial Sequence: Synthetic peptide"
ALVPGPRSA

SEQ ID NO: 32234 - protein, 9 aa, Artificial Sequence
  source: /note="Description of Artificial Sequence: Synthetic peptide"
RAQAPLLFR

SEQ ID NO: 32235 - protein, 9 aa, Artificial Sequence
  source: /note="Description of Artificial Sequence: Synthetic peptide"
LLFRPPCAR

SEQ ID NO: 32236 - protein, 9 aa, Artificial Sequence
  source: /note="Description of Artificial Sequence: Synthetic peptide"
RAQAQGAPR

SEQ ID NO: 32237 - protein, 9 aa, Artificial Sequence
  source: /note="Description of Artificial Sequence: Synthetic peptide"
RAALVPGPR

SEQ ID NO: 32238 - protein, 9 aa, Artificial Sequence
  source: /note="Description of Artificial Sequence: Synthetic peptide"
RAWAPGPVA

SEQ ID NO: 32239 - protein, 9 aa, Artificial Sequence
  source: /note="Description of Artificial Sequence: Synthetic peptide"
QGRAVQPHA

SEQ ID NO: 32240 - protein, 9 aa, Artificial Sequence
  source: /note="Description of Artificial Sequence: Synthetic peptide"
GARRAGPGR

SEQ ID NO: 32241 - protein, 9 aa, Artificial Sequence
  source: /note="Description of Artificial Sequence: Synthetic peptide"
RAGPGRGPV

SEQ ID NO: 32242 - protein, 9 aa, Artificial Sequence
  source: /note="Description of Artificial Sequence: Synthetic peptide"
SAVRVRARR

SEQ ID NO: 32243 - protein, 9 aa, Artificial Sequence
  source: /note="Description of Artificial Sequence: Synthetic peptide"
AVRVRARRG

SEQ ID NO: 32244 - protein, 9 aa, Artificial Sequence
  source: /note="Description of Artificial Sequence: Synthetic peptide"
RVRARRGAP

SEQ ID NO: 32245 - protein, 9 aa, Artificial Sequence
  source: /note="Description of Artificial Sequence: Synthetic peptide"
RARRGAPRL

SEQ ID NO: 32246 - protein, 9 aa, Artificial Sequence
  source: /note="Description of Artificial Sequence: Synthetic peptide"
RAGAQPAAA

SEQ ID NO: 32247 - protein, 9 aa, Artificial Sequence
  source: /note="Description of Artificial Sequence: Synthetic peptide"
AGRGRGRRR

SEQ ID NO: 32248 - protein, 9 aa, Artificial Sequence
  source: /note="Description of Artificial Sequence: Synthetic peptide"
RGRGRRRRA

SEQ ID NO: 32249 - protein, 9 aa, Artificial Sequence
  source: /note="Description of Artificial Sequence: Synthetic peptide"
RGRRRRADR

SEQ ID NO: 32250 - protein, 9 aa, Artificial Sequence
  source: /note="Description of Artificial Sequence: Synthetic peptide"
RALPRGPQG

SEQ ID NO: 32251 - protein, 9 aa, Artificial Sequence
  source: /note="Description of Artificial Sequence: Synthetic peptide"
QGRYVLRVR

SEQ ID NO: 32252 - protein, 9 aa, Artificial Sequence
  source: /note="Description of Artificial Sequence: Synthetic peptide"
RVRDHLQQR

SEQ ID NO: 32253 - protein, 9 aa, Artificial Sequence
  source: /note="Description of Artificial Sequence: Synthetic peptide"
CARGRACRA

SEQ ID NO: 32254 - protein, 9 aa, Artificial Sequence
  source: /note="Description of Artificial Sequence: Synthetic peptide"
RGRACRAQA

SEQ ID NO: 32255 - protein, 9 aa, Artificial Sequence
  source: /note="Description of Artificial Sequence: Synthetic peptide"
RTRRAALVP

SEQ ID NO: 32256 - protein, 9 aa, Artificial Sequence
  source: /note="Description of Artificial Sequence: Synthetic peptide"
SARGGGWGR

SEQ ID NO: 32257 - protein, 9 aa, Artificial Sequence
  source: /note="Description of Artificial Sequence: Synthetic peptide"
RGHARGRRG

SEQ ID NO: 32258 - protein, 9 aa, Artificial Sequence
  source: /note="Description of Artificial Sequence: Synthetic peptide"
RGRRGRPGQ

SEQ ID NO: 32259 - protein, 9 aa, Artificial Sequence
  source: /note="Description of Artificial Sequence: Synthetic peptide"
SGPEWRQQR

SEQ ID NO: 32260 - protein, 9 aa, Artificial Sequence
  source: /note="Description of Artificial Sequence: Synthetic peptide"
HAGLQPGAR

SEQ ID NO: 32261 - protein, 9 aa, Artificial Sequence
  source: /note="Description of Artificial Sequence: Synthetic peptide"
LVPGPRSAR

SEQ ID NO: 32262 - protein, 9 aa, Artificial Sequence
  source: /note="Description of Artificial Sequence: Synthetic peptide"
HPGPRRAWA

SEQ ID NO: 32263 - protein, 9 aa, Artificial Sequence
  source: /note="Description of Artificial Sequence: Synthetic peptide"
GPRRAWAPG

SEQ ID NO: 32264 - protein, 9 aa, Artificial Sequence
  source: /note="Description of Artificial Sequence: Synthetic peptide"
APGPVADAV

SEQ ID NO: 32265 - protein, 9 aa, Artificial Sequence
  source: /note="Description of Artificial Sequence: Synthetic peptide"
RPGQGQGRA

SEQ ID NO: 32266 - protein, 9 aa, Artificial Sequence
  source: /note="Description of Artificial Sequence: Synthetic peptide"
RAVQPHAGL

SEQ ID NO: 32267 - protein, 9 aa, Artificial Sequence
  source: /note="Description of Artificial Sequence: Synthetic peptide"
VPSAVRVRA

SEQ ID NO: 32268 - protein, 9 aa, Artificial Sequence
  source: /note="Description of Artificial Sequence: Synthetic peptide"
RRRRADRAL

SEQ ID NO: 32269 - protein, 9 aa, Artificial Sequence
  source: /note="Description of Artificial Sequence: Synthetic peptide"
RPPCARGRA

SEQ ID NO: 32270 - protein, 9 aa, Artificial Sequence
  source: /note="Description of Artificial Sequence: Synthetic peptide"
APRPGPRAP

SEQ ID NO: 32271 - protein, 9 aa, Artificial Sequence
  source: /note="Description of Artificial Sequence: Synthetic peptide"
RPARRTRRA

SEQ ID NO: 32272 - protein, 9 aa, Artificial Sequence
  source: /note="Description of Artificial Sequence: Synthetic peptide"
ARRTRRAAL

SEQ ID NO: 32273 - protein, 9 aa, Artificial Sequence
  source: /note="Description of Artificial Sequence: Synthetic peptide"
RPGQRGQPE

SEQ ID NO: 32274 - protein, 9 aa, Artificial Sequence
  source: /note="Description of Artificial Sequence: Synthetic peptide"
HLQQRQQLL

SEQ ID NO: 32275 - protein, 9 aa, Artificial Sequence
  source: /note="Description of Artificial Sequence: Synthetic peptide"
ARAASGPEW

SEQ ID NO: 32276 - protein, 9 aa, Artificial Sequence
  source: /note="Description of Artificial Sequence: Synthetic peptide"
RRAWAPGPV

SEQ ID NO: 32277 - protein, 9 aa, Artificial Sequence
  source: /note="Description of Artificial Sequence: Synthetic peptide"
GQGRAVQPH

SEQ ID NO: 32278 - protein, 9 aa, Artificial Sequence
  source: /note="Description of Artificial Sequence: Synthetic peptide"
RQQLLRAQA

SEQ ID NO: 32279 - protein, 9 aa, Artificial Sequence
  source: /note="Description of Artificial Sequence: Synthetic peptide"
LRAQAPLLF

SEQ ID NO: 32280 - protein, 9 aa, Artificial Sequence
  source: /note="Description of Artificial Sequence: Synthetic peptide"
GPVADAVAA

SEQ ID NO: 32281 - protein, 9 aa, Artificial Sequence
  source: /note="Description of Artificial Sequence: Synthetic peptide"
LPRGPQGRY

SEQ ID NO: 32282 - protein, 10 aa, Artificial Sequence
  source: /note="Description of Artificial Sequence: Synthetic peptide"
QLLRAQAPLL

SEQ ID NO: 32283 - protein, 10 aa, Artificial Sequence
  source: /note="Description of Artificial Sequence: Synthetic peptide"
RVRARRGAPR

SEQ ID NO: 32284 - protein, 10 aa, Artificial Sequence
  source: /note="Description of Artificial Sequence: Synthetic peptide"
RSARGGGWGR

SEQ ID NO: 32285 - protein, 10 aa, Artificial Sequence
  source: /note="Description of Artificial Sequence: Synthetic peptide"
RYVLRVRDHL

SEQ ID NO: 32286 - protein, 10 aa, Artificial Sequence
  source: /note="Description of Artificial Sequence: Synthetic peptide"
AVRVRARRGA

SEQ ID NO: 32287 - protein, 10 aa, Artificial Sequence
  source: /note="Description of Artificial Sequence: Synthetic peptide"
RARRGAPRLG

SEQ ID NO: 32288 - protein, 10 aa, Artificial Sequence
  source: /note="Description of Artificial Sequence: Synthetic peptide"
AGRGRGRRRR

SEQ ID NO: 32289 - protein, 10 aa, Artificial Sequence
  source: /note="Description of Artificial Sequence: Synthetic peptide"
RGRRRRADRA

SEQ ID NO: 32290 - protein, 10 aa, Artificial Sequence
  source: /note="Description of Artificial Sequence: Synthetic peptide"
RRRADRALPR

SEQ ID NO: 32291 - protein, 10 aa, Artificial Sequence
  source: /note="Description of Artificial Sequence: Synthetic peptide"
RALPRGPQGR

SEQ ID NO: 32292 - protein, 10 aa, Artificial Sequence
  source: /note="Description of Artificial Sequence: Synthetic peptide"
RVRDHLQQRQ

SEQ ID NO: 32293 - protein, 10 aa, Artificial Sequence
  source: /note="Description of Artificial Sequence: Synthetic peptide"
LLRAQAPLLF

SEQ ID NO: 32294 - protein, 10 aa, Artificial Sequence
  source: /note="Description of Artificial Sequence: Synthetic peptide"
LFRPPCARGR

SEQ ID NO: 32295 - protein, 10 aa, Artificial Sequence
  source: /note="Description of Artificial Sequence: Synthetic peptide"
RGRACRAQAQ

SEQ ID NO: 32296 - protein, 10 aa, Artificial Sequence
  source: /note="Description of Artificial Sequence: Synthetic peptide"
RAPRPARRTR

SEQ ID NO: 32297 - protein, 10 aa, Artificial Sequence
  source: /note="Description of Artificial Sequence: Synthetic peptide"
RTRRAALVPG

SEQ ID NO: 32298 - protein, 10 aa, Artificial Sequence
  source: /note="Description of Artificial Sequence: Synthetic peptide"
RGHARGRRGR

SEQ ID NO: 32299 - protein, 10 aa, Artificial Sequence
  source: /note="Description of Artificial Sequence: Synthetic peptide"
RGRRGRPGQR

SEQ ID NO: 32300 - protein, 10 aa, Artificial Sequence
  source: /note="Description of Artificial Sequence: Synthetic peptide"
ALPRGPQGRY

SEQ ID NO: 32301 - protein, 10 aa, Artificial Sequence
  source: /note="Description of Artificial Sequence: Synthetic peptide"
HAGLQPGARR

SEQ ID NO: 32302 - protein, 10 aa, Artificial Sequence
  source: /note="Description of Artificial Sequence: Synthetic peptide"
HLQQRQQLLR

SEQ ID NO: 32303 - protein, 10 aa, Artificial Sequence
  source: /note="Description of Artificial Sequence: Synthetic peptide"
WAPGPVADAV

SEQ ID NO: 32304 - protein, 10 aa, Artificial Sequence
  source: /note="Description of Artificial Sequence: Synthetic peptide"
GPHPGPRRAW

SEQ ID NO: 32305 - protein, 10 aa, Artificial Sequence
  source: /note="Description of Artificial Sequence: Synthetic peptide"
RPGQGQGRAV

SEQ ID NO: 32306 - protein, 10 aa, Artificial Sequence
  source: /note="Description of Artificial Sequence: Synthetic peptide"
LPRGPQGRYV

SEQ ID NO: 32307 - protein, 10 aa, Artificial Sequence
  source: /note="Description of Artificial Sequence: Synthetic peptide"
RPPCARGRAC

SEQ ID NO: 32308 - protein, 10 aa, Artificial Sequence
  source: /note="Description of Artificial Sequence: Synthetic peptide"
RPGPRAPRPA

SEQ ID NO: 32309 - protein, 10 aa, Artificial Sequence
  source: /note="Description of Artificial Sequence: Synthetic peptide"
RPARRTRRAA

SEQ ID NO: 32310 - protein, 10 aa, Artificial Sequence
  source: /note="Description of Artificial Sequence: Synthetic peptide"
PARRTRRAAL

SEQ ID NO: 32311 - protein, 10 aa, Artificial Sequence
  source: /note="Description of Artificial Sequence: Synthetic peptide"
GPRSARGGGW

SEQ ID NO: 32312 - protein, 10 aa, Artificial Sequence
  source: /note="Description of Artificial Sequence: Synthetic peptide"
QQLLRAQAPL

SEQ ID NO: 32313 - protein, 10 aa, Artificial Sequence
  source: /note="Description of Artificial Sequence: Synthetic peptide"
RQQRAPGGPQ

SEQ ID NO: 32314 - protein, 10 aa, Artificial Sequence
  source: /note="Description of Artificial Sequence: Synthetic peptide"
RRAWAPGPVA

SEQ ID NO: 32315 - protein, 10 aa, Artificial Sequence
  source: /note="Description of Artificial Sequence: Synthetic peptide"
GQGRAVQPHA

SEQ ID NO: 32316 - protein, 10 aa, Artificial Sequence
  source: /note="Description of Artificial Sequence: Synthetic peptide"
RRAGPGRGPV

SEQ ID NO: 32317 - protein, 10 aa, Artificial Sequence
  source: /note="Description of Artificial Sequence: Synthetic peptide"
VRARRGAPRL

SEQ ID NO: 32318 - protein, 10 aa, Artificial Sequence
  source: /note="Description of Artificial Sequence: Synthetic peptide"
RDHLQQRQQL

SEQ ID NO: 32319 - protein, 10 aa, Artificial Sequence
  source: /note="Description of Artificial Sequence: Synthetic peptide"
LQQRQQLLRA

SEQ ID NO: 32320 - protein, 10 aa, Artificial Sequence
  source: /note="Description of Artificial Sequence: Synthetic peptide"
RQQLLRAQAP

SEQ ID NO: 32321 - protein, 10 aa, Artificial Sequence
  source: /note="Description of Artificial Sequence: Synthetic peptide"
AQAPLLFRPP

SEQ ID NO: 32322 - protein, 10 aa, Artificial Sequence
  source: /note="Description of Artificial Sequence: Synthetic peptide"
AQAQGAPRPG

SEQ ID NO: 32323 - protein, 9 aa, Artificial Sequence
  source: /note="Description of Artificial Sequence: Synthetic peptide"
RMEAAASPR

SEQ ID NO: 32324 - protein, 9 aa, Artificial Sequence
  source: /note="Description of Artificial Sequence: Synthetic peptide"
RVAPWTTRR

SEQ ID NO: 32325 - protein, 9 aa, Artificial Sequence
  source: /note="Description of Artificial Sequence: Synthetic peptide"
STCSGPTRR

SEQ ID NO: 32326 - protein, 9 aa, Artificial Sequence
  source: /note="Description of Artificial Sequence: Synthetic peptide"
RALRASSAR

SEQ ID NO: 32327 - protein, 9 aa, Artificial Sequence
  source: /note="Description of Artificial Sequence: Synthetic peptide"
TVQAAVRPR

SEQ ID NO: 32328 - protein, 9 aa, Artificial Sequence
  source: /note="Description of Artificial Sequence: Synthetic peptide"
ATSASAATR

SEQ ID NO: 32329 - protein, 9 aa, Artificial Sequence
  source: /note="Description of Artificial Sequence: Synthetic peptide"
CTSGTTAPR

SEQ ID NO: 32330 - protein, 9 aa, Artificial Sequence
  source: /note="Description of Artificial Sequence: Synthetic peptide"
TTAPRATTR

SEQ ID NO: 32331 - protein, 9 aa, Artificial Sequence
  source: /note="Description of Artificial Sequence: Synthetic peptide"
TSCTRPAPR

SEQ ID NO: 32332 - protein, 9 aa, Artificial Sequence
  source: /note="Description of Artificial Sequence: Synthetic peptide"
WAWPGPCSF

SEQ ID NO: 32333 - protein, 9 aa, Artificial Sequence
  source: /note="Description of Artificial Sequence: Synthetic peptide"
RSWPRCPSW

SEQ ID NO: 32334 - protein, 9 aa, Artificial Sequence
  source: /note="Description of Artificial Sequence: Synthetic peptide"
ASRWRRWRS

SEQ ID NO: 32335 - protein, 9 aa, Artificial Sequence
  source: /note="Description of Artificial Sequence: Synthetic peptide"
RWRRWRSRR

SEQ ID NO: 32336 - protein, 9 aa, Artificial Sequence
  source: /note="Description of Artificial Sequence: Synthetic peptide"
RWRSRRRPP

SEQ ID NO: 32337 - protein, 9 aa, Artificial Sequence
  source: /note="Description of Artificial Sequence: Synthetic peptide"
RSRRRPPSW

SEQ ID NO: 32338 - protein, 9 aa, Artificial Sequence
  source: /note="Description of Artificial Sequence: Synthetic peptide"
RPRRGRRRR

SEQ ID NO: 32339 - protein, 9 aa, Artificial Sequence
  source: /note="Description of Artificial Sequence: Synthetic peptide"
RGRRRRAAP

SEQ ID NO: 32340 - protein, 9 aa, Artificial Sequence
  source: /note="Description of Artificial Sequence: Synthetic peptide"
RRRRAAPPR

SEQ ID NO: 32341 - protein, 9 aa, Artificial Sequence
  source: /note="Description of Artificial Sequence: Synthetic peptide"
RSTCSGPTR

SEQ ID NO: 32342 - protein, 9 aa, Artificial Sequence
  source: /note="Description of Artificial Sequence: Synthetic peptide"
PTRRPPPRR

SEQ ID NO: 32343 - protein, 9 aa, Artificial Sequence
  source: /note="Description of Artificial Sequence: Synthetic peptide"
RARARAPAA

SEQ ID NO: 32344 - protein, 9 aa, Artificial Sequence
  source: /note="Description of Artificial Sequence: Synthetic peptide"
RARAPAARR

SEQ ID NO: 32345 - protein, 9 aa, Artificial Sequence
  source: /note="Description of Artificial Sequence: Synthetic peptide"
ALRASSARS

SEQ ID NO: 32346 - protein, 9 aa, Artificial Sequence
  source: /note="Description of Artificial Sequence: Synthetic peptide"
RASSARSPS

SEQ ID NO: 32347 - protein, 9 aa, Artificial Sequence
  source: /note="Description of Artificial Sequence: Synthetic peptide"
ASSARSPSA

SEQ ID NO: 32348 - protein, 9 aa, Artificial Sequence
  source: /note="Description of Artificial Sequence: Synthetic peptide"
AVRPRTRLP

SEQ ID NO: 32349 - protein, 9 aa, Artificial Sequence
  source: /note="Description of Artificial Sequence: Synthetic peptide"
RPRTRLPRA

SEQ ID NO: 32350 - protein, 9 aa, Artificial Sequence
  source: /note="Description of Artificial Sequence: Synthetic peptide"
RTRLPRAGP

SEQ ID NO: 32351 - protein, 9 aa, Artificial Sequence
  source: /note="Description of Artificial Sequence: Synthetic peptide"
RLPRAGPRR

SEQ ID NO: 32352 - protein, 9 aa, Artificial Sequence
  source: /note="Description of Artificial Sequence: Synthetic peptide"
RAGPRRPPA

SEQ ID NO: 32353 - protein, 9 aa, Artificial Sequence
  source: /note="Description of Artificial Sequence: Synthetic peptide"
PARPARPPA

SEQ ID NO: 32354 - protein, 9 aa, Artificial Sequence
  source: /note="Description of Artificial Sequence: Synthetic peptide"
PTRRARPRA

SEQ ID NO: 32355 - protein, 9 aa, Artificial Sequence
  source: /note="Description of Artificial Sequence: Synthetic peptide"
RARPRAPER

SEQ ID NO: 32356 - protein, 9 aa, Artificial Sequence
  source: /note="Description of Artificial Sequence: Synthetic peptide"
RARRGLGAR

SEQ ID NO: 32357 - protein, 9 aa, Artificial Sequence
  source: /note="Description of Artificial Sequence: Synthetic peptide"
GARPRPRTA

SEQ ID NO: 32358 - protein, 9 aa, Artificial Sequence
  source: /note="Description of Artificial Sequence: Synthetic peptide"
RPRPRTARA

SEQ ID NO: 32359 - protein, 9 aa, Artificial Sequence
  source: /note="Description of Artificial Sequence: Synthetic peptide"
RTARAAGAA

SEQ ID NO: 32360 - protein, 9 aa, Artificial Sequence
  source: /note="Description of Artificial Sequence: Synthetic peptide"
TARAAGAAR

SEQ ID NO: 32361 - protein, 9 aa, Artificial Sequence
  source: /note="Description of Artificial Sequence: Synthetic peptide"
AAGAARAAR

SEQ ID NO: 32362 - protein, 9 aa, Artificial Sequence
  source: /note="Description of Artificial Sequence: Synthetic peptide"
AARAARARV

SEQ ID NO: 32363 - protein, 9 aa, Artificial Sequence
  source: /note="Description of Artificial Sequence: Synthetic peptide"
AARARVAPW

SEQ ID NO: 32364 - protein, 9 aa, Artificial Sequence
  source: /note="Description of Artificial Sequence: Synthetic peptide"
RARVAPWTT

SEQ ID NO: 32365 - protein, 9 aa, Artificial Sequence
  source: /note="Description of Artificial Sequence: Synthetic peptide"
TTRRTTPAA

SEQ ID NO: 32366 - protein, 9 aa, Artificial Sequence
  source: /note="Description of Artificial Sequence: Synthetic peptide"
RTTPAARCA

SEQ ID NO: 32367 - protein, 9 aa, Artificial Sequence
  source: /note="Description of Artificial Sequence: Synthetic peptide"
AARCARPAT

SEQ ID NO: 32368 - protein, 9 aa, Artificial Sequence
  source: /note="Description of Artificial Sequence: Synthetic peptide"
ATRPTPCTS

SEQ ID NO: 32369 - protein, 9 aa, Artificial Sequence
  source: /note="Description of Artificial Sequence: Synthetic peptide"
ATTRRRADR

SEQ ID NO: 32370 - protein, 9 aa, Artificial Sequence
  source: /note="Description of Artificial Sequence: Synthetic peptide"
RPRPPLPPR

SEQ ID NO: 32371 - protein, 9 aa, Artificial Sequence
  source: /note="Description of Artificial Sequence: Synthetic peptide"
CTRPAPRPP

SEQ ID NO: 32372 - protein, 9 aa, Artificial Sequence
  source: /note="Description of Artificial Sequence: Synthetic peptide"
RPAPRPPRR

SEQ ID NO: 32373 - protein, 9 aa, Artificial Sequence
  source: /note="Description of Artificial Sequence: Synthetic peptide"
PLRARPAPR

SEQ ID NO: 32374 - protein, 9 aa, Artificial Sequence
  source: /note="Description of Artificial Sequence: Synthetic peptide"
RARPAPRPT

SEQ ID NO: 32375 - protein, 9 aa, Artificial Sequence
  source: /note="Description of Artificial Sequence: Synthetic peptide"
EARAEPWPR

SEQ ID NO: 32376 - protein, 9 aa, Artificial Sequence
  source: /note="Description of Artificial Sequence: Synthetic peptide"
GASRWRRWR

SEQ ID NO: 32377 - protein, 9 aa, Artificial Sequence
  source: /note="Description of Artificial Sequence: Synthetic peptide"
ESLGPRPRR

SEQ ID NO: 32378 - protein, 9 aa, Artificial Sequence
  source: /note="Description of Artificial Sequence: Synthetic peptide"
SWCTAGCSR

SEQ ID NO: 32379 - protein, 9 aa, Artificial Sequence
  source: /note="Description of Artificial Sequence: Synthetic peptide"
CTAGCSRAR

SEQ ID NO: 32380 - protein, 9 aa, Artificial Sequence
  source: /note="Description of Artificial Sequence: Synthetic peptide"
QAAVRPRTR

SEQ ID NO: 32381 - protein, 9 aa, Artificial Sequence
  source: /note="Description of Artificial Sequence: Synthetic peptide"
TTPAARCAR

SEQ ID NO: 32382 - protein, 9 aa, Artificial Sequence
  source: /note="Description of Artificial Sequence: Synthetic peptide"
EAAPASPLR

SEQ ID NO: 32383 - protein, 9 aa, Artificial Sequence
  source: /note="Description of Artificial Sequence: Synthetic peptide"
TTCTSASTV

SEQ ID NO: 32384 - protein, 9 aa, Artificial Sequence
  source: /note="Description of Artificial Sequence: Synthetic peptide"
CTSASTVQA

SEQ ID NO: 32385 - protein, 9 aa, Artificial Sequence
  source: /note="Description of Artificial Sequence: Synthetic peptide"
SASTVQAAV

SEQ ID NO: 32386 - protein, 9 aa, Artificial Sequence
  source: /note="Description of Artificial Sequence: Synthetic peptide"
WTTRRTTPA

SEQ ID NO: 32387 - protein, 9 aa, Artificial Sequence
  source: /note="Description of Artificial Sequence: Synthetic peptide"
EPWPRMEAA

SEQ ID NO: 32388 - protein, 9 aa, Artificial Sequence
  source: /note="Description of Artificial Sequence: Synthetic peptide"
WPRMEAAAS

SEQ ID NO: 32389 - protein, 9 aa, Artificial Sequence
  source: /note="Description of Artificial Sequence: Synthetic peptide"
SPRRPPGAS

SEQ ID NO: 32390 - protein, 9 aa, Artificial Sequence
  source: /note="Description of Artificial Sequence: Synthetic peptide"
CPAPRRAPA

SEQ ID NO: 32391 - protein, 9 aa, Artificial Sequence
  source: /note="Description of Artificial Sequence: Synthetic peptide"
APARCPASW

SEQ ID NO: 32392 - protein, 9 aa, Artificial Sequence
  source: /note="Description of Artificial Sequence: Synthetic peptide"
APAARRPGS

SEQ ID NO: 32393 - protein, 9 aa, Artificial Sequence
  source: /note="Description of Artificial Sequence: Synthetic peptide"
RPARPPASP

SEQ ID NO: 32394 - protein, 9 aa, Artificial Sequence
  source: /note="Description of Artificial Sequence: Synthetic peptide"
APERARRGL

SEQ ID NO: 32395 - protein, 9 aa, Artificial Sequence
  source: /note="Description of Artificial Sequence: Synthetic peptide"
RPRTARAAG

SEQ ID NO: 32396 - protein, 9 aa, Artificial Sequence
  source: /note="Description of Artificial Sequence: Synthetic peptide"
RAAGAARAA

SEQ ID NO: 32397 - protein, 9 aa, Artificial Sequence
  source: /note="Description of Artificial Sequence: Synthetic peptide"
APWTTRRTT

SEQ ID NO: 32398 - protein, 9 aa, Artificial Sequence
  source: /note="Description of Artificial Sequence: Synthetic peptide"
RPATSASAA

SEQ ID NO: 32399 - protein, 9 aa, Artificial Sequence
  source: /note="Description of Artificial Sequence: Synthetic peptide"
RPTPCTSGT

SEQ ID NO: 32400 - protein, 9 aa, Artificial Sequence
  source: /note="Description of Artificial Sequence: Synthetic peptide"
RPRPRPPLP

SEQ ID NO: 32401 - protein, 9 aa, Artificial Sequence
  source: /note="Description of Artificial Sequence: Synthetic peptide"
APRPPRRPA

SEQ ID NO: 32402 - protein, 9 aa, Artificial Sequence
  source: /note="Description of Artificial Sequence: Synthetic peptide"
RPATPPRPS

SEQ ID NO: 32403 - protein, 9 aa, Artificial Sequence
  source: /note="Description of Artificial Sequence: Synthetic peptide"
RPSRRGPEA

SEQ ID NO: 32404 - protein, 9 aa, Artificial Sequence
  source: /note="Description of Artificial Sequence: Synthetic peptide"
RPAPRPTAP

SEQ ID NO: 32405 - protein, 9 aa, Artificial Sequence
  source: /note="Description of Artificial Sequence: Synthetic peptide"
APRPTAPST

SEQ ID NO: 32406 - protein, 9 aa, Artificial Sequence
  source: /note="Description of Artificial Sequence: Synthetic peptide"
ARAEPWPRM

SEQ ID NO: 32407 - protein, 9 aa, Artificial Sequence
  source: /note="Description of Artificial Sequence: Synthetic peptide"
RRAPARCPA

SEQ ID NO: 32408 - protein, 9 aa, Artificial Sequence
  source: /note="Description of Artificial Sequence: Synthetic peptide"
ARCPASWAW

SEQ ID NO: 32409 - protein, 9 aa, Artificial Sequence
  source: /note="Description of Artificial Sequence: Synthetic peptide"
AAVRPRTRL

SEQ ID NO: 32410 - protein, 9 aa, Artificial Sequence
  source: /note="Description of Artificial Sequence: Synthetic peptide"
AEAAPASPL

SEQ ID NO: 32411 - protein, 9 aa, Artificial Sequence
  source: /note="Description of Artificial Sequence: Synthetic peptide"
CPASWAWPG

SEQ ID NO: 32412 - protein, 9 aa, Artificial Sequence
  source: /note="Description of Artificial Sequence: Synthetic peptide"
AEAEAAPAS

SEQ ID NO: 32413 - protein, 9 aa, Artificial Sequence
  source: /note="Description of Artificial Sequence: Synthetic peptide"
AEPWPRMEA

SEQ ID NO: 32414 - protein, 9 aa, Artificial Sequence
  source: /note="Description of Artificial Sequence: Synthetic peptide"
LPPRLCARA

SEQ ID NO: 32415 - protein, 10 aa, Artificial Sequence
  source: /note="Description of Artificial Sequence: Synthetic peptide"
STVQAAVRPR

SEQ ID NO: 32416 - protein, 10 aa, Artificial Sequence
  source: /note="Description of Artificial Sequence: Synthetic peptide"
RTARAAGAAR

SEQ ID NO: 32417 - protein, 10 aa, Artificial Sequence
  source: /note="Description of Artificial Sequence: Synthetic peptide"
RTTPAARCAR

SEQ ID NO: 32418 - protein, 10 aa, Artificial Sequence
  source: /note="Description of Artificial Sequence: Synthetic peptide"
GTTAPRATTR

SEQ ID NO: 32419 - protein, 10 aa, Artificial Sequence
  source: /note="Description of Artificial Sequence: Synthetic peptide"
TTAPRATTRR

SEQ ID NO: 32420 - protein, 10 aa, Artificial Sequence
  source: /note="Description of Artificial Sequence: Synthetic peptide"
STSCTRPAPR

SEQ ID NO: 32421 - protein, 10 aa, Artificial Sequence
  source: /note="Description of Artificial Sequence: Synthetic peptide"
SWAWPGPCSF

SEQ ID NO: 32422 - protein, 10 aa, Artificial Sequence
  source: /note="Description of Artificial Sequence: Synthetic peptide"
RMEAAASPRR

SEQ ID NO: 32423 - protein, 10 aa, Artificial Sequence
  source: /note="Description of Artificial Sequence: Synthetic peptide"
AASPRRPPGA

SEQ ID NO: 32424 - protein, 10 aa, Artificial Sequence
  source: /note="Description of Artificial Sequence: Synthetic peptide"
ASRWRRWRSR

SEQ ID NO: 32425 - protein, 10 aa, Artificial Sequence
  source: /note="Description of Artificial Sequence: Synthetic peptide"
RWRRWRSRRR

SEQ ID NO: 32426 - protein, 10 aa, Artificial Sequence
  source: /note="Description of Artificial Sequence: Synthetic peptide"
RWRSRRRPPS

SEQ ID NO: 32427 - protein, 10 aa, Artificial Sequence
  source: /note="Description of Artificial Sequence: Synthetic peptide"
RSRRRPPSWA

SEQ ID NO: 32428 - protein, 10 aa, Artificial Sequence
  source: /note="Description of Artificial Sequence: Synthetic peptide"
RGRRRRAAPP

SEQ ID NO: 32429 - protein, 10 aa, Artificial Sequence
  source: /note="Description of Artificial Sequence: Synthetic peptide"
RAAPPRPGSR

SEQ ID NO: 32430 - protein, 10 aa, Artificial Sequence
  source: /note="Description of Artificial Sequence: Synthetic peptide"
GSRPSCPAPR

SEQ ID NO: 32431 - protein, 10 aa, Artificial Sequence
  source: /note="Description of Artificial Sequence: Synthetic peptide"
SFRSTCSGPT

SEQ ID NO: 32432 - protein, 10 aa, Artificial Sequence
  source: /note="Description of Artificial Sequence: Synthetic peptide"
RSTCSGPTRR

SEQ ID NO: 32433 - protein, 10 aa, Artificial Sequence
  source: /note="Description of Artificial Sequence: Synthetic peptide"
SGPTRRPPPR

SEQ ID NO: 32434 - protein, 10 aa, Artificial Sequence
  source: /note="Description of Artificial Sequence: Synthetic peptide"
RSWPRCPSWC

SEQ ID NO: 32435 - protein, 10 aa, Artificial Sequence
  source: /note="Description of Artificial Sequence: Synthetic peptide"
CSRARARAPA

SEQ ID NO: 32436 - protein, 10 aa, Artificial Sequence
  source: /note="Description of Artificial Sequence: Synthetic peptide"
RARARAPAAR

SEQ ID NO: 32437 - protein, 10 aa, Artificial Sequence
  source: /note="Description of Artificial Sequence: Synthetic peptide"
RARAPAARRP

SEQ ID NO: 32438 - protein, 10 aa, Artificial Sequence
  source: /note="Description of Artificial Sequence: Synthetic peptide"
AARRPGSSPG

SEQ ID NO: 32439 - protein, 10 aa, Artificial Sequence
  source: /note="Description of Artificial Sequence: Synthetic peptide"
RALRASSARS

SEQ ID NO: 32440 - protein, 10 aa, Artificial Sequence
  source: /note="Description of Artificial Sequence: Synthetic peptide"
RASSARSPSA

SEQ ID NO: 32441 - protein, 10 aa, Artificial Sequence
  source: /note="Description of Artificial Sequence: Synthetic peptide"
AVRPRTRLPR

SEQ ID NO: 32442 - protein, 10 aa, Artificial Sequence
  source: /note="Description of Artificial Sequence: Synthetic peptide"
RTRLPRAGPR

SEQ ID NO: 32443 - protein, 10 aa, Artificial Sequence
  source: /note="Description of Artificial Sequence: Synthetic peptide"
RAGPRRPPAR

SEQ ID NO: 32444 - protein, 10 aa, Artificial Sequence
  source: /note="Description of Artificial Sequence: Synthetic peptide"
RARPRAPERA

SEQ ID NO: 32445 - protein, 10 aa, Artificial Sequence
  source: /note="Description of Artificial Sequence: Synthetic peptide"
RPRAPERARR

SEQ ID NO: 32446 - protein, 10 aa, Artificial Sequence
  source: /note="Description of Artificial Sequence: Synthetic peptide"
RARRGLGARP

SEQ ID NO: 32447 - protein, 10 aa, Artificial Sequence
  source: /note="Description of Artificial Sequence: Synthetic peptide"
RGLGARPRPR

SEQ ID NO: 32448 - protein, 10 aa, Artificial Sequence
  source: /note="Description of Artificial Sequence: Synthetic peptide"
GARPRPRTAR

SEQ ID NO: 32449 - protein, 10 aa, Artificial Sequence
  source: /note="Description of Artificial Sequence: Synthetic peptide"
TARAAGAARA

SEQ ID NO: 32450 - protein, 10 aa, Artificial Sequence
  source: /note="Description of Artificial Sequence: Synthetic peptide"
RAAGAARAAR

SEQ ID NO: 32451 - protein, 10 aa, Artificial Sequence
  source: /note="Description of Artificial Sequence: Synthetic peptide"
AARAARARVA

SEQ ID NO: 32452 - protein, 10 aa, Artificial Sequence
  source: /note="Description of Artificial Sequence: Synthetic peptide"
AARARVAPWT

SEQ ID NO: 32453 - protein, 10 aa, Artificial Sequence
  source: /note="Description of Artificial Sequence: Synthetic peptide"
RARVAPWTTR

SEQ ID NO: 32454 - protein, 10 aa, Artificial Sequence
  source: /note="Description of Artificial Sequence: Synthetic peptide"
TTRRTTPAAR

SEQ ID NO: 32455 - protein, 10 aa, Artificial Sequence
  source: /note="Description of Artificial Sequence: Synthetic peptide"
AARCARPATS

SEQ ID NO: 32456 - protein, 10 aa, Artificial Sequence
  source: /note="Description of Artificial Sequence: Synthetic peptide"
CARPATSASA

SEQ ID NO: 32457 - protein, 10 aa, Artificial Sequence
  source: /note="Description of Artificial Sequence: Synthetic peptide"
ATRPTPCTSG

SEQ ID NO: 32458 - protein, 10 aa, Artificial Sequence
  source: /note="Description of Artificial Sequence: Synthetic peptide"
RATTRRRADR

SEQ ID NO: 32459 - protein, 10 aa, Artificial Sequence
  source: /note="Description of Artificial Sequence: Synthetic peptide"
TTRRRADRPR

SEQ ID NO: 32460 - protein, 10 aa, Artificial Sequence
  source: /note="Description of Artificial Sequence: Synthetic peptide"
RRRADRPRPR

SEQ ID NO: 32461 - protein, 10 aa, Artificial Sequence
  source: /note="Description of Artificial Sequence: Synthetic peptide"
RPRPRDPLGR

SEQ ID NO: 32462 - protein, 10 aa, Artificial Sequence
  source: /note="Description of Artificial Sequence: Synthetic peptide"
RPRDPLGRPR

SEQ ID NO: 32463 - protein, 10 aa, Artificial Sequence
  source: /note="Description of Artificial Sequence: Synthetic peptide"
LGRPRPRPPL

SEQ ID NO: 32464 - protein, 10 aa, Artificial Sequence
  source: /note="Description of Artificial Sequence: Synthetic peptide"
RPRPPLPPRL

SEQ ID NO: 32465 - protein, 10 aa, Artificial Sequence
  source: /note="Description of Artificial Sequence: Synthetic peptide"
CTRPAPRPPR

SEQ ID NO: 32466 - protein, 10 aa, Artificial Sequence
  source: /note="Description of Artificial Sequence: Synthetic peptide"
RARPAPRPTA

SEQ ID NO: 32467 - protein, 10 aa, Artificial Sequence
  source: /note="Description of Artificial Sequence: Synthetic peptide"
SWAPESLGPR

SEQ ID NO: 32468 - protein, 10 aa, Artificial Sequence
  source: /note="Description of Artificial Sequence: Synthetic peptide"
CPAPRRAPAR

SEQ ID NO: 32469 - protein, 10 aa, Artificial Sequence
  source: /note="Description of Artificial Sequence: Synthetic peptide"
WAWPGPCSFR

SEQ ID NO: 32470 - protein, 10 aa, Artificial Sequence
  source: /note="Description of Artificial Sequence: Synthetic peptide"
RPPPRRSWPR

SEQ ID NO: 32471 - protein, 10 aa, Artificial Sequence
  source: /note="Description of Artificial Sequence: Synthetic peptide"
TAGCSRARAR

SEQ ID NO: 32472 - protein, 10 aa, Artificial Sequence
  source: /note="Description of Artificial Sequence: Synthetic peptide"
SASTVQAAVR

SEQ ID NO: 32473 - protein, 10 aa, Artificial Sequence
  source: /note="Description of Artificial Sequence: Synthetic peptide"
DAASSTSCTR

SEQ ID NO: 32474 - protein, 10 aa, Artificial Sequence
  source: /note="Description of Artificial Sequence: Synthetic peptide"
SPLRARPAPR

SEQ ID NO: 32475 - protein, 10 aa, Artificial Sequence
  source: /note="Description of Artificial Sequence: Synthetic peptide"
CTAGCSRARA

SEQ ID NO: 32476 - protein, 10 aa, Artificial Sequence
  source: /note="Description of Artificial Sequence: Synthetic peptide"
TTTCTSASTV

SEQ ID NO: 32477 - protein, 10 aa, Artificial Sequence
  source: /note="Description of Artificial Sequence: Synthetic peptide"
CTSASTVQAA

SEQ ID NO: 32478 - protein, 10 aa, Artificial Sequence
  source: /note="Description of Artificial Sequence: Synthetic peptide"
TSASTVQAAV

SEQ ID NO: 32479 - protein, 10 aa, Artificial Sequence
  source: /note="Description of Artificial Sequence: Synthetic peptide"
WTTRRTTPAA

SEQ ID NO: 32480 - protein, 10 aa, Artificial Sequence
  source: /note="Description of Artificial Sequence: Synthetic peptide"
CTSGTTAPRA

SEQ ID NO: 32481 - protein, 10 aa, Artificial Sequence
  source: /note="Description of Artificial Sequence: Synthetic peptide"
EAEAAPASPL

SEQ ID NO: 32482 - protein, 10 aa, Artificial Sequence
  source: /note="Description of Artificial Sequence: Synthetic peptide"
EAAPASPLRA

SEQ ID NO: 32483 - protein, 10 aa, Artificial Sequence
  source: /note="Description of Artificial Sequence: Synthetic peptide"
WPRMEAAASP

SEQ ID NO: 32484 - protein, 10 aa, Artificial Sequence
  source: /note="Description of Artificial Sequence: Synthetic peptide"
RPPSWAPESL

SEQ ID NO: 32485 - protein, 10 aa, Artificial Sequence
  source: /note="Description of Artificial Sequence: Synthetic peptide"
RPRRGRRRRA

SEQ ID NO: 32486 - protein, 10 aa, Artificial Sequence
  source: /note="Description of Artificial Sequence: Synthetic peptide"
RPGSRPSCPA

SEQ ID NO: 32487 - protein, 10 aa, Artificial Sequence
  source: /note="Description of Artificial Sequence: Synthetic peptide"
RPSCPAPRRA

SEQ ID NO: 32488 - protein, 10 aa, Artificial Sequence
  source: /note="Description of Artificial Sequence: Synthetic peptide"
APARCPASWA

SEQ ID NO: 32489 - protein, 10 aa, Artificial Sequence
  source: /note="Description of Artificial Sequence: Synthetic peptide"
WPRCPSWCTA

SEQ ID NO: 32490 - protein, 10 aa, Artificial Sequence
  source: /note="Description of Artificial Sequence: Synthetic peptide"
APAARRPGSS

SEQ ID NO: 32491 - protein, 10 aa, Artificial Sequence
  source: /note="Description of Artificial Sequence: Synthetic peptide"
PPRALRASSA

SEQ ID NO: 32492 - protein, 10 aa, Artificial Sequence
  source: /note="Description of Artificial Sequence: Synthetic peptide"
RPRTRLPRAG

SEQ ID NO: 32493 - protein, 10 aa, Artificial Sequence
  source: /note="Description of Artificial Sequence: Synthetic peptide"
LPRAGPRRPP

SEQ ID NO: 32494 - protein, 10 aa, Artificial Sequence
  source: /note="Description of Artificial Sequence: Synthetic peptide"
GPRRPPARPA

SEQ ID NO: 32495 - protein, 10 aa, Artificial Sequence
  source: /note="Description of Artificial Sequence: Synthetic peptide"
RPARPPASPP

SEQ ID NO: 32496 - protein, 10 aa, Artificial Sequence
  source: /note="Description of Artificial Sequence: Synthetic peptide"
RPRPRTARAA

SEQ ID NO: 32497 - protein, 10 aa, Artificial Sequence
  source: /note="Description of Artificial Sequence: Synthetic peptide"
RPRTARAAGA

SEQ ID NO: 32498 - protein, 10 aa, Artificial Sequence
  source: /note="Description of Artificial Sequence: Synthetic peptide"
APWTTRRTTP

SEQ ID NO: 32499 - protein, 10 aa, Artificial Sequence
  source: /note="Description of Artificial Sequence: Synthetic peptide"
TPAARCARPA

SEQ ID NO: 32500 - protein, 10 aa, Artificial Sequence
  source: /note="Description of Artificial Sequence: Synthetic peptide"
RPATSASAAT

SEQ ID NO: 32501 - protein, 10 aa, Artificial Sequence
  source: /note="Description of Artificial Sequence: Synthetic peptide"
RPTPCTSGTT

SEQ ID NO: 32502 - protein, 10 aa, Artificial Sequence
  source: /note="Description of Artificial Sequence: Synthetic peptide"
APRATTRRRA

SEQ ID NO: 32503 - protein, 10 aa, Artificial Sequence
  source: /note="Description of Artificial Sequence: Synthetic peptide"
RPRPRPPLPP

SEQ ID NO: 32504 - protein, 10 aa, Artificial Sequence
  source: /note="Description of Artificial Sequence: Synthetic peptide"
RPPLPPRLCA

SEQ ID NO: 32505 - protein, 10 aa, Artificial Sequence
  source: /note="Description of Artificial Sequence: Synthetic peptide"
APRPPRRPAT

SEQ ID NO: 32506 - protein, 10 aa, Artificial Sequence
  source: /note="Description of Artificial Sequence: Synthetic peptide"
RPAPRPTAPS

SEQ ID NO: 32507 - protein, 10 aa, Artificial Sequence
  source: /note="Description of Artificial Sequence: Synthetic peptide"
WRSRRRPPSW

SEQ ID NO: 32508 - protein, 10 aa, Artificial Sequence
  source: /note="Description of Artificial Sequence: Synthetic peptide"
RAPARCPASW

SEQ ID NO: 32509 - protein, 10 aa, Artificial Sequence
  source: /note="Description of Artificial Sequence: Synthetic peptide"
RRSWPRCPSW

SEQ ID NO: 32510 - protein, 10 aa, Artificial Sequence
  source: /note="Description of Artificial Sequence: Synthetic peptide"
ARAAGAARAA

SEQ ID NO: 32511 - protein, 10 aa, Artificial Sequence
  source: /note="Description of Artificial Sequence: Synthetic peptide"
RAARARVAPW

SEQ ID NO: 32512 - protein, 10 aa, Artificial Sequence
  source: /note="Description of Artificial Sequence: Synthetic peptide"
EPWPRMEAAA

SEQ ID NO: 32513 - protein, 10 aa, Artificial Sequence
  source: /note="Description of Artificial Sequence: Synthetic peptide"
AEPWPRMEAA

SEQ ID NO: 32514 - protein, 10 aa, Artificial Sequence
  source: /note="Description of Artificial Sequence: Synthetic peptide"
AEAEAAPASP

SEQ ID NO: 32515 - protein, 10 aa, Artificial Sequence
  source: /note="Description of Artificial Sequence: Synthetic peptide"
PEAEAEAAPA

SEQ ID NO: 32516 - protein, 9 aa, Artificial Sequence
  source: /note="Description of Artificial Sequence: Synthetic peptide"
RSYEDRPNF

SEQ ID NO: 32517 - protein, 9 aa, Artificial Sequence
  source: /note="Description of Artificial Sequence: Synthetic peptide"
RPNFQSAAL

SEQ ID NO: 32518 - protein, 10 aa, Artificial Sequence
  source: /note="Description of Artificial Sequence: Synthetic peptide"
ARSYEDRPNF

SEQ ID NO: 32519 - protein, 10 aa, Artificial Sequence
  source: /note="Description of Artificial Sequence: Synthetic peptide"
YEDRPNFQSA

SEQ ID NO: 32520 - protein, 9 aa, Artificial Sequence
  source: /note="Description of Artificial Sequence: Synthetic peptide"
IYQTHADRL

SEQ ID NO: 32521 - protein, 9 aa, Artificial Sequence
  source: /note="Description of Artificial Sequence: Synthetic peptide"
VIYQTHADR

SEQ ID NO: 32522 - protein, 9 aa, Artificial Sequence
  source: /note="Description of Artificial Sequence: Synthetic peptide"
YQTHADRLH

SEQ ID NO: 32523 - protein, 10 aa, Artificial Sequence
  source: /note="Description of Artificial Sequence: Synthetic peptide"
AISDLVIYQT

SEQ ID NO: 32524 - protein, 10 aa, Artificial Sequence
  source: /note="Description of Artificial Sequence: Synthetic peptide"
LVIYQTHADR

SEQ ID NO: 32525 - protein, 10 aa, Artificial Sequence
  source: /note="Description of Artificial Sequence: Synthetic peptide"
VIYQTHADRL

SEQ ID NO: 32526 - protein, 9 aa, Artificial Sequence
  source: /note="Description of Artificial Sequence: Synthetic peptide"
SNRYNEIMK

SEQ ID NO: 32527 - protein, 9 aa, Artificial Sequence
  source: /note="Description of Artificial Sequence: Synthetic peptide"
IPSNRYNEI

SEQ ID NO: 32528 - protein, 9 aa, Artificial Sequence
  source: /note="Description of Artificial Sequence: Synthetic peptide"
RYNEIMKAM

SEQ ID NO: 32529 - protein, 10 aa, Artificial Sequence
  source: /note="Description of Artificial Sequence: Synthetic peptide"
IPSNRYNEIM

SEQ ID NO: 32530 - protein, 10 aa, Artificial Sequence
  source: /note="Description of Artificial Sequence: Synthetic peptide"
NRYNEIMKAM

SEQ ID NO: 32531 - protein, 9 aa, Artificial Sequence
  source: /note="Description of Artificial Sequence: Synthetic peptide"
QASASSAKK

SEQ ID NO: 32532 - protein, 9 aa, Artificial Sequence
  source: /note="Description of Artificial Sequence: Synthetic peptide"
ASSAKKPHA

SEQ ID NO: 32533 - protein, 9 aa, Artificial Sequence
  source: /note="Description of Artificial Sequence: Synthetic peptide"
KPHAANGPL

SEQ ID NO: 32534 - protein, 10 aa, Artificial Sequence
  source: /note="Description of Artificial Sequence: Synthetic peptide"
SQASASSAKK

SEQ ID NO: 32535 - protein, 10 aa, Artificial Sequence
  source: /note="Description of Artificial Sequence: Synthetic peptide"
KPHAANGPLI

SEQ ID NO: 32536 - protein, 10 aa, Artificial Sequence
  source: /note="Description of Artificial Sequence: Synthetic peptide"
KKPHAANGPL

SEQ ID NO: 32537 - protein, 9 aa, Artificial Sequence
  source: /note="Description of Artificial Sequence: Synthetic peptide"
EAASAQHSL

SEQ ID NO: 32538 - protein, 9 aa, Artificial Sequence
  source: /note="Description of Artificial Sequence: Synthetic peptide"
AEAASAQHS

SEQ ID NO: 32539 - protein, 10 aa, Artificial Sequence
  source: /note="Description of Artificial Sequence: Synthetic peptide"
EAASAQHSLF

SEQ ID NO: 32540 - protein, 10 aa, Artificial Sequence
  source: /note="Description of Artificial Sequence: Synthetic peptide"
RGFGDAAEAA

SEQ ID NO: 32541 - protein, 10 aa, Artificial Sequence
  source: /note="Description of Artificial Sequence: Synthetic peptide"
AEAASAQHSL

SEQ ID NO: 32542 - protein, 9 aa, Artificial Sequence
  source: /note="Description of Artificial Sequence: Synthetic peptide"
HLHVHTSDK

SEQ ID NO: 32543 - protein, 9 aa, Artificial Sequence
  source: /note="Description of Artificial Sequence: Synthetic peptide"
KKHLHVHTS

SEQ ID NO: 32544 - protein, 10 aa, Artificial Sequence
  source: /note="Description of Artificial Sequence: Synthetic peptide"
KHLHVHTSDK

SEQ ID NO: 32545 - protein, 10 aa, Artificial Sequence
  source: /note="Description of Artificial Sequence: Synthetic peptide"
LHVHTSDKPY

SEQ ID NO: 32546 - protein, 9 aa, Artificial Sequence
  source: /note="Description of Artificial Sequence: Synthetic peptide"
KSNVINHEK

SEQ ID NO: 32547 - protein, 9 aa, Artificial Sequence
  source: /note="Description of Artificial Sequence: Synthetic peptide"
SQKSNVINH

SEQ ID NO: 32548 - protein, 10 aa, Artificial Sequence
  source: /note="Description of Artificial Sequence: Synthetic peptide"
KSNVINHEKI

SEQ ID NO: 32549 - protein, 10 aa, Artificial Sequence
  source: /note="Description of Artificial Sequence: Synthetic peptide"
INHEKIHTGK

SEQ ID NO: 32550 - protein, 9 aa, Artificial Sequence
  source: /note="Description of Artificial Sequence: Synthetic peptide"
ILGKSPMNV

SEQ ID NO: 32551 - protein, 9 aa, Artificial Sequence
  source: /note="Description of Artificial Sequence: Synthetic peptide"
FIAIRKLIA

SEQ ID NO: 32552 - protein, 9 aa, Artificial Sequence
  source: /note="Description of Artificial Sequence: Synthetic peptide"
KLIAERGPI

SEQ ID NO: 32553 - protein, 9 aa, Artificial Sequence
  source: /note="Description of Artificial Sequence: Synthetic peptide"
SQTFIAIRK

SEQ ID NO: 32554 - protein, 9 aa, Artificial Sequence
  source: /note="Description of Artificial Sequence: Synthetic peptide"
RSQTFIAIR

SEQ ID NO: 32555 - protein, 9 aa, Artificial Sequence
  source: /note="Description of Artificial Sequence: Synthetic peptide"
TFIAIRKLI

SEQ ID NO: 32556 - protein, 9 aa, Artificial Sequence
  source: /note="Description of Artificial Sequence: Synthetic peptide"
QHKKSILGK

SEQ ID NO: 32557 - protein, 9 aa, Artificial Sequence
  source: /note="Description of Artificial Sequence: Synthetic peptide"
KSILGKSPM

SEQ ID NO: 32558 - protein, 9 aa, Artificial Sequence
  source: /note="Description of Artificial Sequence: Synthetic peptide"
SFRSQTFIA

SEQ ID NO: 32559 - protein, 9 aa, Artificial Sequence
  source: /note="Description of Artificial Sequence: Synthetic peptide"
AIRKLIAER

SEQ ID NO: 32560 - protein, 9 aa, Artificial Sequence
  source: /note="Description of Artificial Sequence: Synthetic peptide"
KPSFRSQTF

SEQ ID NO: 32561 - protein, 9 aa, Artificial Sequence
  source: /note="Description of Artificial Sequence: Synthetic peptide"
NLIQHKKSI

SEQ ID NO: 32562 - protein, 9 aa, Artificial Sequence
  source: /note="Description of Artificial Sequence: Synthetic peptide"
LIQHKKSIL

SEQ ID NO: 32563 - protein, 9 aa, Artificial Sequence
  source: /note="Description of Artificial Sequence: Synthetic peptide"
FRSQTFIAI

SEQ ID NO: 32564 - protein, 9 aa, Artificial Sequence
  source: /note="Description of Artificial Sequence: Synthetic peptide"
AERGPIDVV

SEQ ID NO: 32565 - protein, 10 aa, Artificial Sequence
  source: /note="Description of Artificial Sequence: Synthetic peptide"
SILGKSPMNV

SEQ ID NO: 32566 - protein, 10 aa, Artificial Sequence
  source: /note="Description of Artificial Sequence: Synthetic peptide"
LIAERGPIDV

SEQ ID NO: 32567 - protein, 10 aa, Artificial Sequence
  source: /note="Description of Artificial Sequence: Synthetic peptide"
IQHKKSILGK

SEQ ID NO: 32568 - protein, 10 aa, Artificial Sequence
  source: /note="Description of Artificial Sequence: Synthetic peptide"
RSQTFIAIRK

SEQ ID NO: 32569 - protein, 10 aa, Artificial Sequence
  source: /note="Description of Artificial Sequence: Synthetic peptide"
SFRSQTFIAI

SEQ ID NO: 32570 - protein, 10 aa, Artificial Sequence
  source: /note="Description of Artificial Sequence: Synthetic peptide"
IAIRKLIAER

SEQ ID NO: 32571 - protein, 10 aa, Artificial Sequence
  source: /note="Description of Artificial Sequence: Synthetic peptide"
QTFIAIRKLI

SEQ ID NO: 32572 - protein, 10 aa, Artificial Sequence
  source: /note="Description of Artificial Sequence: Synthetic peptide"
KPSFRSQTFI

SEQ ID NO: 32573 - protein, 10 aa, Artificial Sequence
  source: /note="Description of Artificial Sequence: Synthetic peptide"
NLIQHKKSIL

SEQ ID NO: 32574 - protein, 10 aa, Artificial Sequence
  source: /note="Description of Artificial Sequence: Synthetic peptide"
KKSILGKSPM

SEQ ID NO: 32575 - protein, 10 aa, Artificial Sequence
  source: /note="Description of Artificial Sequence: Synthetic peptide"
SQTFIAIRKL

SEQ ID NO: 32576 - protein, 10 aa, Artificial Sequence
  source: /note="Description of Artificial Sequence: Synthetic peptide"
RKLIAERGPI

SEQ ID NO: 32577 - protein, 10 aa, Artificial Sequence
  source: /note="Description of Artificial Sequence: Synthetic peptide"
NVTDVEKPSF

SEQ ID NO: 32578 - protein, 9 aa, Artificial Sequence
  source: /note="Description of Artificial Sequence: Synthetic peptide"
HRIHARESL

SEQ ID NO: 32579 - protein, 10 aa, Artificial Sequence
  source: /note="Description of Artificial Sequence: Synthetic peptide"
HHRIHARESL

SEQ ID NO: 32580 - protein, 10 aa, Artificial Sequence
  source: /note="Description of Artificial Sequence: Synthetic peptide"
REDAVVASRL

SEQ ID NO: 32581 - protein, 9 aa, Artificial Sequence
  source: /note="Description of Artificial Sequence: Synthetic peptide"
NAIGSRQHY

SEQ ID NO: 32582 - protein, 9 aa, Artificial Sequence
  source: /note="Description of Artificial Sequence: Synthetic peptide"
RQHYCHECG

SEQ ID NO: 32583 - protein, 10 aa, Artificial Sequence
  source: /note="Description of Artificial Sequence: Synthetic peptide"
RQHYCHECGK

SEQ ID NO: 32584 - protein, 10 aa, Artificial Sequence
  source: /note="Description of Artificial Sequence: Synthetic peptide"
KNAIGSRQHY

SEQ ID NO: 32585 - protein, 9 aa, Artificial Sequence
  source: /note="Description of Artificial Sequence: Synthetic peptide"
QLRLPRSRK

SEQ ID NO: 32586 - protein, 9 aa, Artificial Sequence
  source: /note="Description of Artificial Sequence: Synthetic peptide"
EVIDLDPQL

SEQ ID NO: 32587 - protein, 9 aa, Artificial Sequence
  source: /note="Description of Artificial Sequence: Synthetic peptide"
RLPRSRKTF

SEQ ID NO: 32588 - protein, 10 aa, Artificial Sequence
  source: /note="Description of Artificial Sequence: Synthetic peptide"
EVIDLDPQLR

SEQ ID NO: 32589 - protein, 10 aa, Artificial Sequence
  source: /note="Description of Artificial Sequence: Synthetic peptide"
DLDPQLRLPR

SEQ ID NO: 32590 - protein, 10 aa, Artificial Sequence
  source: /note="Description of Artificial Sequence: Synthetic peptide"
REVIDLDPQL

SEQ ID NO: 32591 - protein, 10 aa, Artificial Sequence
  source: /note="Description of Artificial Sequence: Synthetic peptide"
LRLPRSRKTF

SEQ ID NO: 32592 - protein, 9 aa, Artificial Sequence
  source: /note="Description of Artificial Sequence: Synthetic peptide"
IVTMTSCLY

SEQ ID NO: 32593 - protein, 9 aa, Artificial Sequence
  source: /note="Description of Artificial Sequence: Synthetic peptide"
YLDPPTCRA

SEQ ID NO: 32594 - protein, 9 aa, Artificial Sequence
  source: /note="Description of Artificial Sequence: Synthetic peptide"
AIVTMTSCL

SEQ ID NO: 32595 - protein, 9 aa, Artificial Sequence
  source: /note="Description of Artificial Sequence: Synthetic peptide"
TMTSCLYLR

SEQ ID NO: 32596 - protein, 9 aa, Artificial Sequence
  source: /note="Description of Artificial Sequence: Synthetic peptide"
AVGRGALPR

SEQ ID NO: 32597 - protein, 9 aa, Artificial Sequence
  source: /note="Description of Artificial Sequence: Synthetic peptide"
SYPTYPTHF

SEQ ID NO: 32598 - protein, 9 aa, Artificial Sequence
  source: /note="Description of Artificial Sequence: Synthetic peptide"
TYPTHFSTW

SEQ ID NO: 32599 - protein, 9 aa, Artificial Sequence
  source: /note="Description of Artificial Sequence: Synthetic peptide"
VTMTSCLYL

SEQ ID NO: 32600 - protein, 9 aa, Artificial Sequence
  source: /note="Description of Artificial Sequence: Synthetic peptide"
AIPPHSASY

SEQ ID NO: 32601 - protein, 9 aa, Artificial Sequence
  source: /note="Description of Artificial Sequence: Synthetic peptide"
SYLDPPTCR

SEQ ID NO: 32602 - protein, 9 aa, Artificial Sequence
  source: /note="Description of Artificial Sequence: Synthetic peptide"
SASYPTYPT

SEQ ID NO: 32603 - protein, 9 aa, Artificial Sequence
  source: /note="Description of Artificial Sequence: Synthetic peptide"
RPAPEPRAV

SEQ ID NO: 32604 - protein, 9 aa, Artificial Sequence
  source: /note="Description of Artificial Sequence: Synthetic peptide"
EPRAVGRGA

SEQ ID NO: 32605 - protein, 9 aa, Artificial Sequence
  source: /note="Description of Artificial Sequence: Synthetic peptide"
GALPRCSPL

SEQ ID NO: 32606 - protein, 9 aa, Artificial Sequence
  source: /note="Description of Artificial Sequence: Synthetic peptide"
RAIVTMTSC

SEQ ID NO: 32607 - protein, 9 aa, Artificial Sequence
  source: /note="Description of Artificial Sequence: Synthetic peptide"
ASYPTYPTH

SEQ ID NO: 32608 - protein, 9 aa, Artificial Sequence
  source: /note="Description of Artificial Sequence: Synthetic peptide"
THFSTWEPV

SEQ ID NO: 32609 - protein, 9 aa, Artificial Sequence
  source: /note="Description of Artificial Sequence: Synthetic peptide"
HPVGAIPPH

SEQ ID NO: 32610 - protein, 9 aa, Artificial Sequence
  source: /note="Description of Artificial Sequence: Synthetic peptide"
YPTYPTHFS

SEQ ID NO: 32611 - protein, 9 aa, Artificial Sequence
  source: /note="Description of Artificial Sequence: Synthetic peptide"
EPVPSDRPA

SEQ ID NO: 32612 - protein, 9 aa, Artificial Sequence
  source: /note="Description of Artificial Sequence: Synthetic peptide"
TEGHPVGAI

SEQ ID NO: 32613 - protein, 10 aa, Artificial Sequence
  source: /note="Description of Artificial Sequence: Synthetic peptide"
YLDPPTCRAI

SEQ ID NO: 32614 - protein, 10 aa, Artificial Sequence
  source: /note="Description of Artificial Sequence: Synthetic peptide"
YLRTTEGHPV

SEQ ID NO: 32615 - protein, 10 aa, Artificial Sequence
  source: /note="Description of Artificial Sequence: Synthetic peptide"
VTMTSCLYLR

SEQ ID NO: 32616 - protein, 10 aa, Artificial Sequence
  source: /note="Description of Artificial Sequence: Synthetic peptide"
LSYLDPPTCR

SEQ ID NO: 32617 - protein, 10 aa, Artificial Sequence
  source: /note="Description of Artificial Sequence: Synthetic peptide"
AIVTMTSCLY

SEQ ID NO: 32618 - protein, 10 aa, Artificial Sequence
  source: /note="Description of Artificial Sequence: Synthetic peptide"
STWEPVPSDR

SEQ ID NO: 32619 - protein, 10 aa, Artificial Sequence
  source: /note="Description of Artificial Sequence: Synthetic peptide"
RAVGRGALPR

SEQ ID NO: 32620 - protein, 10 aa, Artificial Sequence
  source: /note="Description of Artificial Sequence: Synthetic peptide"
ASYPTYPTHF

SEQ ID NO: 32621 - protein, 10 aa, Artificial Sequence
  source: /note="Description of Artificial Sequence: Synthetic peptide"
PTYPTHFSTW

SEQ ID NO: 32622 - protein, 10 aa, Artificial Sequence
  source: /note="Description of Artificial Sequence: Synthetic peptide"
RAIVTMTSCL

SEQ ID NO: 32623 - protein, 10 aa, Artificial Sequence
  source: /note="Description of Artificial Sequence: Synthetic peptide"
RTTEGHPVGA

SEQ ID NO: 32624 - protein, 10 aa, Artificial Sequence
  source: /note="Description of Artificial Sequence: Synthetic peptide"
RGALPRCSPL

SEQ ID NO: 32625 - protein, 10 aa, Artificial Sequence
  source: /note="Description of Artificial Sequence: Synthetic peptide"
GALPRCSPLR

SEQ ID NO: 32626 - protein, 10 aa, Artificial Sequence
  source: /note="Description of Artificial Sequence: Synthetic peptide"
GAIPPHSASY

SEQ ID NO: 32627 - protein, 10 aa, Artificial Sequence
  source: /note="Description of Artificial Sequence: Synthetic peptide"
HSASYPTYPT

SEQ ID NO: 32628 - protein, 10 aa, Artificial Sequence
  source: /note="Description of Artificial Sequence: Synthetic peptide"
YPTYPTHFST

SEQ ID NO: 32629 - protein, 10 aa, Artificial Sequence
  source: /note="Description of Artificial Sequence: Synthetic peptide"
RPAPEPRAVG

SEQ ID NO: 32630 - protein, 10 aa, Artificial Sequence
  source: /note="Description of Artificial Sequence: Synthetic peptide"
EPRAVGRGAL

SEQ ID NO: 32631 - protein, 10 aa, Artificial Sequence
  source: /note="Description of Artificial Sequence: Synthetic peptide"
PPHSASYPTY

SEQ ID NO: 32632 - protein, 10 aa, Artificial Sequence
  source: /note="Description of Artificial Sequence: Synthetic peptide"
WEPVPSDRPA

SEQ ID NO: 32633 - protein, 9 aa, Artificial Sequence
  source: /note="Description of Artificial Sequence: Synthetic peptide"
AAAAAVAAL

SEQ ID NO: 32634 - protein, 9 aa, Artificial Sequence
  source: /note="Description of Artificial Sequence: Synthetic peptide"
AAVAALQEK

SEQ ID NO: 32635 - protein, 10 aa, Artificial Sequence
  source: /note="Description of Artificial Sequence: Synthetic peptide"
AAAVAALQEK

SEQ ID NO: 32636 - protein, 10 aa, Artificial Sequence
  source: /note="Description of Artificial Sequence: Synthetic peptide"
AAAAAAVAAL

SEQ ID NO: 32637 - protein, 9 aa, Artificial Sequence
  source: /note="Description of Artificial Sequence: Synthetic peptide"
LLIRGKGLL

SEQ ID NO: 32638 - protein, 9 aa, Artificial Sequence
  source: /note="Description of Artificial Sequence: Synthetic peptide"
YSAPHCASL

SEQ ID NO: 32639 - protein, 9 aa, Artificial Sequence
  source: /note="Description of Artificial Sequence: Synthetic peptide"
KSSRRGKLL

SEQ ID NO: 32640 - protein, 9 aa, Artificial Sequence
  source: /note="Description of Artificial Sequence: Synthetic peptide"
SSRRGKLLI

SEQ ID NO: 32641 - protein, 9 aa, Artificial Sequence
  source: /note="Description of Artificial Sequence: Synthetic peptide"
RGKLLIRGK

SEQ ID NO: 32642 - protein, 9 aa, Artificial Sequence
  source: /note="Description of Artificial Sequence: Synthetic peptide"
RGKGLLSYS

SEQ ID NO: 32643 - protein, 9 aa, Artificial Sequence
  source: /note="Description of Artificial Sequence: Synthetic peptide"
AHRLLSPRK

SEQ ID NO: 32644 - protein, 9 aa, Artificial Sequence
  source: /note="Description of Artificial Sequence: Synthetic peptide"
RLLSPRKLV

SEQ ID NO: 32645 - protein, 9 aa, Artificial Sequence
  source: /note="Description of Artificial Sequence: Synthetic peptide"
IRGKGLLSY

SEQ ID NO: 32646 - protein, 9 aa, Artificial Sequence
  source: /note="Description of Artificial Sequence: Synthetic peptide"
CSGCKKSSR

SEQ ID NO: 32647 - protein, 9 aa, Artificial Sequence
  source: /note="Description of Artificial Sequence: Synthetic peptide"
IQFHLPAHR

SEQ ID NO: 32648 - protein, 9 aa, Artificial Sequence
  source: /note="Description of Artificial Sequence: Synthetic peptide"
PAHRLLSPR

SEQ ID NO: 32649 - protein, 9 aa, Artificial Sequence
  source: /note="Description of Artificial Sequence: Synthetic peptide"
APHCASLDI

SEQ ID NO: 32650 - protein, 9 aa, Artificial Sequence
  source: /note="Description of Artificial Sequence: Synthetic peptide"
LPAHRLLSP

SEQ ID NO: 32651 - protein, 9 aa, Artificial Sequence
  source: /note="Description of Artificial Sequence: Synthetic peptide"
SPRKLVQVA

SEQ ID NO: 32652 - protein, 9 aa, Artificial Sequence
  source: /note="Description of Artificial Sequence: Synthetic peptide"
LVQVAQKTF

SEQ ID NO: 32653 - protein, 9 aa, Artificial Sequence
  source: /note="Description of Artificial Sequence: Synthetic peptide"
GLLSYSAPH

SEQ ID NO: 32654 - protein, 9 aa, Artificial Sequence
  source: /note="Description of Artificial Sequence: Synthetic peptide"
HCASLDIQF

SEQ ID NO: 32655 - protein, 9 aa, Artificial Sequence
  source: /note="Description of Artificial Sequence: Synthetic peptide"
ASLDIQFHL

SEQ ID NO: 32656 - protein, 9 aa, Artificial Sequence
  source: /note="Description of Artificial Sequence: Synthetic peptide"
LDIQFHLPA

SEQ ID NO: 32657 - protein, 9 aa, Artificial Sequence
  source: /note="Description of Artificial Sequence: Synthetic peptide"
FHLPAHRLL

SEQ ID NO: 32658 - protein, 10 aa, Artificial Sequence
  source: /note="Description of Artificial Sequence: Synthetic peptide"
SLDIQFHLPA

SEQ ID NO: 32659 - protein, 10 aa, Artificial Sequence
  source: /note="Description of Artificial Sequence: Synthetic peptide"
IQFHLPAHRL

SEQ ID NO: 32660 - protein, 10 aa, Artificial Sequence
  source: /note="Description of Artificial Sequence: Synthetic peptide"
LLSPRKLVQV

SEQ ID NO: 32661 - protein, 10 aa, Artificial Sequence
  source: /note="Description of Artificial Sequence: Synthetic peptide"
LLSYSAPHCA

SEQ ID NO: 32662 - protein, 10 aa, Artificial Sequence
  source: /note="Description of Artificial Sequence: Synthetic peptide"
SYSAPHCASL

SEQ ID NO: 32663 - protein, 10 aa, Artificial Sequence
  source: /note="Description of Artificial Sequence: Synthetic peptide"
GCKKSSRRGK

SEQ ID NO: 32664 - protein, 10 aa, Artificial Sequence
  source: /note="Description of Artificial Sequence: Synthetic peptide"
KSSRRGKLLI

SEQ ID NO: 32665 - protein, 10 aa, Artificial Sequence
  source: /note="Description of Artificial Sequence: Synthetic peptide"
SSRRGKLLIR

SEQ ID NO: 32666 - protein, 10 aa, Artificial Sequence
  source: /note="Description of Artificial Sequence: Synthetic peptide"
RGKGLLSYSA

SEQ ID NO: 32667 - protein, 10 aa, Artificial Sequence
  source: /note="Description of Artificial Sequence: Synthetic peptide"
PAHRLLSPRK

SEQ ID NO: 32668 - protein, 10 aa, Artificial Sequence
  source: /note="Description of Artificial Sequence: Synthetic peptide"
LIRGKGLLSY

SEQ ID NO: 32669 - protein, 10 aa, Artificial Sequence
  source: /note="Description of Artificial Sequence: Synthetic peptide"
DIQFHLPAHR

SEQ ID NO: 32670 - protein, 10 aa, Artificial Sequence
  source: /note="Description of Artificial Sequence: Synthetic peptide"
LPAHRLLSPR

SEQ ID NO: 32671 - protein, 10 aa, Artificial Sequence
  source: /note="Description of Artificial Sequence: Synthetic peptide"
KLVQVAQKTF

SEQ ID NO: 32672 - protein, 10 aa, Artificial Sequence
  source: /note="Description of Artificial Sequence: Synthetic peptide"
KKSSRRGKLL

SEQ ID NO: 32673 - protein, 10 aa, Artificial Sequence
  source: /note="Description of Artificial Sequence: Synthetic peptide"
LDIQFHLPAH

SEQ ID NO: 32674 - protein, 9 aa, Artificial Sequence
  source: /note="Description of Artificial Sequence: Synthetic peptide"
CSILCLTGY

SEQ ID NO: 32675 - protein, 9 aa, Artificial Sequence
  source: /note="Description of Artificial Sequence: Synthetic peptide"
QLFCSILCL

SEQ ID NO: 32676 - protein, 9 aa, Artificial Sequence
  source: /note="Description of Artificial Sequence: Synthetic peptide"
ILCLTGYTV

SEQ ID NO: 32677 - protein, 9 aa, Artificial Sequence
  source: /note="Description of Artificial Sequence: Synthetic peptide"
GSTQLFCSI

SEQ ID NO: 32678 - protein, 10 aa, Artificial Sequence
  source: /note="Description of Artificial Sequence: Synthetic peptide"
TQLFCSILCL

SEQ ID NO: 32679 - protein, 10 aa, Artificial Sequence
  source: /note="Description of Artificial Sequence: Synthetic peptide"
QLFCSILCLT

SEQ ID NO: 32680 - protein, 10 aa, Artificial Sequence
  source: /note="Description of Artificial Sequence: Synthetic peptide"
SILCLTGYTV

SEQ ID NO: 32681 - protein, 10 aa, Artificial Sequence
  source: /note="Description of Artificial Sequence: Synthetic peptide"
KGSTQLFCSI

SEQ ID NO: 32682 - protein, 10 aa, Artificial Sequence
  source: /note="Description of Artificial Sequence: Synthetic peptide"
GSTQLFCSIL

SEQ ID NO: 32683 - protein, 10 aa, Artificial Sequence
  source: /note="Description of Artificial Sequence: Synthetic peptide"
FCSILCLTGY

SEQ ID NO: 32684 - protein, 10 aa, Artificial Sequence
  source: /note="Description of Artificial Sequence: Synthetic peptide"
KQNEDDEVPV

SEQ ID NO: 32685 - protein, 10 aa, Artificial Sequence
  source: /note="Description of Artificial Sequence: Synthetic peptide"
QTSHLIRHKI

SEQ ID NO: 32686 - protein, 9 aa, Artificial Sequence
  source: /note="Description of Artificial Sequence: Synthetic peptide"
KLILEKSPI

SEQ ID NO: 32687 - protein, 9 aa, Artificial Sequence
  source: /note="Description of Artificial Sequence: Synthetic peptide"
ILEKSPINV

SEQ ID NO: 32688 - protein, 9 aa, Artificial Sequence
  source: /note="Description of Artificial Sequence: Synthetic peptide"
KHKKLILEK

SEQ ID NO: 32689 - protein, 9 aa, Artificial Sequence
  source: /note="Description of Artificial Sequence: Synthetic peptide"
KGFNHYSFC

SEQ ID NO: 32690 - protein, 9 aa, Artificial Sequence
  source: /note="Description of Artificial Sequence: Synthetic peptide"
FNHYSFCQK

SEQ ID NO: 32691 - protein, 9 aa, Artificial Sequence
  source: /note="Description of Artificial Sequence: Synthetic peptide"
KKCKGFNHY

SEQ ID NO: 32692 - protein, 9 aa, Artificial Sequence
  source: /note="Description of Artificial Sequence: Synthetic peptide"
LWKHKKLIL

SEQ ID NO: 32693 - protein, 9 aa, Artificial Sequence
  source: /note="Description of Artificial Sequence: Synthetic peptide"
CKGFNHYSF

SEQ ID NO: 32694 - protein, 10 aa, Artificial Sequence
  source: /note="Description of Artificial Sequence: Synthetic peptide"
LILEKSPINV

SEQ ID NO: 32695 - protein, 10 aa, Artificial Sequence
  source: /note="Description of Artificial Sequence: Synthetic peptide"
ILEKSPINVK

SEQ ID NO: 32696 - protein, 10 aa, Artificial Sequence
  source: /note="Description of Artificial Sequence: Synthetic peptide"
GFNHYSFCQK

SEQ ID NO: 32697 - protein, 10 aa, Artificial Sequence
  source: /note="Description of Artificial Sequence: Synthetic peptide"
KSPINVKKCK

SEQ ID NO: 32698 - protein, 10 aa, Artificial Sequence
  source: /note="Description of Artificial Sequence: Synthetic peptide"
TLWKHKKLIL

SEQ ID NO: 32699 - protein, 10 aa, Artificial Sequence
  source: /note="Description of Artificial Sequence: Synthetic peptide"
KKLILEKSPI

SEQ ID NO: 32700 - protein, 10 aa, Artificial Sequence
  source: /note="Description of Artificial Sequence: Synthetic peptide"
VKKCKGFNHY

SEQ ID NO: 32701 - protein, 10 aa, Artificial Sequence
  source: /note="Description of Artificial Sequence: Synthetic peptide"
KCKGFNHYSF

SEQ ID NO: 32702 - protein, 9 aa, Artificial Sequence
  source: /note="Description of Artificial Sequence: Synthetic peptide"
HRRVHNGEK

SEQ ID NO: 32703 - protein, 10 aa, Artificial Sequence
  source: /note="Description of Artificial Sequence: Synthetic peptide"
KHRRVHNGEK

SEQ ID NO: 32704 - protein, 10 aa, Artificial Sequence
  source: /note="Description of Artificial Sequence: Synthetic peptide"
RRVHNGEKPY

SEQ ID NO: 32705 - protein, 9 aa, Artificial Sequence
  source: /note="Description of Artificial Sequence: Synthetic peptide"
QSSSLIQHW

SEQ ID NO: 32706 - protein, 10 aa, Artificial Sequence
  source: /note="Description of Artificial Sequence: Synthetic peptide"
QSSSLIQHWR

SEQ ID NO: 32707 - protein, 10 aa, Artificial Sequence
  source: /note="Description of Artificial Sequence: Synthetic peptide"
SQSSSLIQHW

SEQ ID NO: 32708 - protein, 9 aa, Artificial Sequence
  source: /note="Description of Artificial Sequence: Synthetic peptide"
LMVHQITHT

SEQ ID NO: 32709 - protein, 9 aa, Artificial Sequence
  source: /note="Description of Artificial Sequence: Synthetic peptide"
SLMVHQITH

SEQ ID NO: 32710 - protein, 10 aa, Artificial Sequence
  source: /note="Description of Artificial Sequence: Synthetic peptide"
SLMVHQITHT

SEQ ID NO: 32711 - protein, 10 aa, Artificial Sequence
  source: /note="Description of Artificial Sequence: Synthetic peptide"
YSSSLMVHQI

SEQ ID NO: 32712 - protein, 9 aa, Artificial Sequence
  source: /note="Description of Artificial Sequence: Synthetic peptide"
RVHTGERTY

SEQ ID NO: 32713 - protein, 10 aa, Artificial Sequence
  source: /note="Description of Artificial Sequence: Synthetic peptide"
RVHTGERTYT

SEQ ID NO: 32714 - protein, 10 aa, Artificial Sequence
  source: /note="Description of Artificial Sequence: Synthetic peptide"
KRVHTGERTY

SEQ ID NO: 32715 - protein, 9 aa, Artificial Sequence
  source: /note="Description of Artificial Sequence: Synthetic peptide"
HLVSHQITH

SEQ ID NO: 32716 - protein, 10 aa, Artificial Sequence
  source: /note="Description of Artificial Sequence: Synthetic peptide"
HLVSHQITHT

SEQ ID NO: 32717 - protein, 10 aa, Artificial Sequence
  source: /note="Description of Artificial Sequence: Synthetic peptide"
ITHTGEKPYR

SEQ ID NO: 32718 - protein, 10 aa, Artificial Sequence
  source: /note="Description of Artificial Sequence: Synthetic peptide"
RSSHLVSHQI

SEQ ID NO: 32719 - protein, 9 aa, Artificial Sequence
  source: /note="Description of Artificial Sequence: Synthetic peptide"
SHLVMHQII

SEQ ID NO: 32720 - protein, 10 aa, Artificial Sequence
  source: /note="Description of Artificial Sequence: Synthetic peptide"
RSSHLVMHQI

SEQ ID NO: 32721 - protein, 10 aa, Artificial Sequence
  source: /note="Description of Artificial Sequence: Synthetic peptide"
SSHLVMHQII

SEQ ID NO: 32722 - protein, 9 aa, Artificial Sequence
  source: /note="Description of Artificial Sequence: Synthetic peptide"
ITHTGEKPF

SEQ ID NO: 32723 - protein, 9 aa, Artificial Sequence
  source: /note="Description of Artificial Sequence: Synthetic peptide"
TQHQITHTG

SEQ ID NO: 32724 - protein, 10 aa, Artificial Sequence
  source: /note="Description of Artificial Sequence: Synthetic peptide"
QITHTGEKPF

SEQ ID NO: 32725 - protein, 9 aa, Artificial Sequence
  source: /note="Description of Artificial Sequence: Synthetic peptide"
HTKLTRHQI

SEQ ID NO: 32726 - protein, 9 aa, Artificial Sequence
  source: /note="Description of Artificial Sequence: Synthetic peptide"
HQIIHSEEK

SEQ ID NO: 32727 - protein, 9 aa, Artificial Sequence
  source: /note="Description of Artificial Sequence: Synthetic peptide"
TKLTRHQII

SEQ ID NO: 32728 - protein, 9 aa, Artificial Sequence
  source: /note="Description of Artificial Sequence: Synthetic peptide"
IIHSEEKPF

SEQ ID NO: 32729 - protein, 10 aa, Artificial Sequence
  source: /note="Description of Artificial Sequence: Synthetic peptide"
HTKLTRHQII

SEQ ID NO: 32730 - protein, 10 aa, Artificial Sequence
  source: /note="Description of Artificial Sequence: Synthetic peptide"
RHQIIHSEEK

SEQ ID NO: 32731 - protein, 10 aa, Artificial Sequence
  source: /note="Description of Artificial Sequence: Synthetic peptide"
QIIHSEEKPF

SEQ ID NO: 32732 - protein, 9 aa, Artificial Sequence
  source: /note="Description of Artificial Sequence: Synthetic peptide"
QQKEPWNVK

SEQ ID NO: 32733 - protein, 10 aa, Artificial Sequence
  source: /note="Description of Artificial Sequence: Synthetic peptide"
QQKEPWNVKR

SEQ ID NO: 32734 - protein, 10 aa, Artificial Sequence
  source: /note="Description of Artificial Sequence: Synthetic peptide"
LEQQKEPWNV

SEQ ID NO: 32735 - protein, 9 aa, Artificial Sequence
  source: /note="Description of Artificial Sequence: Synthetic peptide"
HQCIHTGEK

SEQ ID NO: 32736 - protein, 9 aa, Artificial Sequence
  source: /note="Description of Artificial Sequence: Synthetic peptide"
IQHQCIHTG

SEQ ID NO: 32737 - protein, 10 aa, Artificial Sequence
  source: /note="Description of Artificial Sequence: Synthetic peptide"
CIHTGEKPYV

SEQ ID NO: 32738 - protein, 10 aa, Artificial Sequence
  source: /note="Description of Artificial Sequence: Synthetic peptide"
QCIHTGEKPY

SEQ ID NO: 32739 - protein, 9 aa, Artificial Sequence
  source: /note="Description of Artificial Sequence: Synthetic peptide"
FTEEELWLL

SEQ ID NO: 32740 - protein, 9 aa, Artificial Sequence
  source: /note="Description of Artificial Sequence: Synthetic peptide"
EELWLLDLA

SEQ ID NO: 32741 - protein, 9 aa, Artificial Sequence
  source: /note="Description of Artificial Sequence: Synthetic peptide"
EEELWLLDL

SEQ ID NO: 32742 - protein, 9 aa, Artificial Sequence
  source: /note="Description of Artificial Sequence: Synthetic peptide"
VVFTEEELW

SEQ ID NO: 32743 - protein, 10 aa, Artificial Sequence
  source: /note="Description of Artificial Sequence: Synthetic peptide"
WLLDLAQRKL

SEQ ID NO: 32744 - protein, 10 aa, Artificial Sequence
  source: /note="Description of Artificial Sequence: Synthetic peptide"
VFTEEELWLL

SEQ ID NO: 32745 - protein, 10 aa, Artificial Sequence
  source: /note="Description of Artificial Sequence: Synthetic peptide"
ELWLLDLAQR

SEQ ID NO: 32746 - protein, 10 aa, Artificial Sequence
  source: /note="Description of Artificial Sequence: Synthetic peptide"
TEEELWLLDL

SEQ ID NO: 32747 - protein, 10 aa, Artificial Sequence
  source: /note="Description of Artificial Sequence: Synthetic peptide"
EELWLLDLAQ

SEQ ID NO: 32748 - protein, 10 aa, Artificial Sequence
  source: /note="Description of Artificial Sequence: Synthetic peptide"
EEELWLLDLA

SEQ ID NO: 32749 - protein, 9 aa, Artificial Sequence
  source: /note="Description of Artificial Sequence: Synthetic peptide"
FLVKVQTHI

SEQ ID NO: 32750 - protein, 9 aa, Artificial Sequence
  source: /note="Description of Artificial Sequence: Synthetic peptide"
KVQTHISVI

SEQ ID NO: 32751 - protein, 9 aa, Artificial Sequence
  source: /note="Description of Artificial Sequence: Synthetic peptide"
SLESSPLGV

SEQ ID NO: 32752 - protein, 9 aa, Artificial Sequence
  source: /note="Description of Artificial Sequence: Synthetic peptide"
IPSLESSPL

SEQ ID NO: 32753 - protein, 9 aa, Artificial Sequence
  source: /note="Description of Artificial Sequence: Synthetic peptide"
VKVQTHISV

SEQ ID NO: 32754 - protein, 9 aa, Artificial Sequence
  source: /note="Description of Artificial Sequence: Synthetic peptide"
THISVIPSL

SEQ ID NO: 32755 - protein, 9 aa, Artificial Sequence
  source: /note="Description of Artificial Sequence: Synthetic peptide"
VQDWGNPSA

SEQ ID NO: 32756 - protein, 9 aa, Artificial Sequence
  source: /note="Description of Artificial Sequence: Synthetic peptide"
QDWGNPSAL

SEQ ID NO: 32757 - protein, 9 aa, Artificial Sequence
  source: /note="Description of Artificial Sequence: Synthetic peptide"
VEECFLVKV

SEQ ID NO: 32758 - protein, 9 aa, Artificial Sequence
  source: /note="Description of Artificial Sequence: Synthetic peptide"
SPVEECFLV

SEQ ID NO: 32759 - protein, 10 aa, Artificial Sequence
  source: /note="Description of Artificial Sequence: Synthetic peptide"
VQDWGNPSAL

SEQ ID NO: 32760 - protein, 10 aa, Artificial Sequence
  source: /note="Description of Artificial Sequence: Synthetic peptide"
VIPSLESSPL

SEQ ID NO: 32761 - protein, 10 aa, Artificial Sequence
  source: /note="Description of Artificial Sequence: Synthetic peptide"
CFLVKVQTHI

SEQ ID NO: 32762 - protein, 10 aa, Artificial Sequence
  source: /note="Description of Artificial Sequence: Synthetic peptide"
LVKVQTHISV

SEQ ID NO: 32763 - protein, 10 aa, Artificial Sequence
  source: /note="Description of Artificial Sequence: Synthetic peptide"
QTHISVIPSL

SEQ ID NO: 32764 - protein, 10 aa, Artificial Sequence
  source: /note="Description of Artificial Sequence: Synthetic peptide"
ETSPVEECFL

SEQ ID NO: 32765 - protein, 10 aa, Artificial Sequence
  source: /note="Description of Artificial Sequence: Synthetic peptide"
TSPVEECFLV

SEQ ID NO: 32766 - protein, 10 aa, Artificial Sequence
  source: /note="Description of Artificial Sequence: Synthetic peptide"
VKVQTHISVI

SEQ ID NO: 32767 - protein, 9 aa, Artificial Sequence
  source: /note="Description of Artificial Sequence: Synthetic peptide"
QLMGEPGLA

SEQ ID NO: 32768 - protein, 9 aa, Artificial Sequence
  source: /note="Description of Artificial Sequence: Synthetic peptide"
AQQLMGEPG

SEQ ID NO: 32769 - protein, 9 aa, Artificial Sequence
  source: /note="Description of Artificial Sequence: Synthetic peptide"
QQLMGEPGL

SEQ ID NO: 32770 - protein, 9 aa, Artificial Sequence
  source: /note="Description of Artificial Sequence: Synthetic peptide"
LMGEPGLAP

SEQ ID NO: 32771 - protein, 10 aa, Artificial Sequence
  source: /note="Description of Artificial Sequence: Synthetic peptide"
AQQLMGEPGL

SEQ ID NO: 32772 - protein, 9 aa, Artificial Sequence
  source: /note="Description of Artificial Sequence: Synthetic peptide"
TQVMTLQGL

SEQ ID NO: 32773 - protein, 9 aa, Artificial Sequence
  source: /note="Description of Artificial Sequence: Synthetic peptide"
QVMTLQGLV

SEQ ID NO: 32774 - protein, 10 aa, Artificial Sequence
  source: /note="Description of Artificial Sequence: Synthetic peptide"
TQVMTLQGLV

SEQ ID NO: 32775 - protein, 10 aa, Artificial Sequence
  source: /note="Description of Artificial Sequence: Synthetic peptide"
MTLQGLVSPS

SEQ ID NO: 32776 - protein, 10 aa, Artificial Sequence
  source: /note="Description of Artificial Sequence: Synthetic peptide"
TQDLTQVMTL

SEQ ID NO: 32777 - protein, 9 aa, Artificial Sequence
  source: /note="Description of Artificial Sequence: Synthetic peptide"
HQIIHTRVK

SEQ ID NO: 32778 - protein, 9 aa, Artificial Sequence
  source: /note="Description of Artificial Sequence: Synthetic peptide"
SVLTKHQII

SEQ ID NO: 32779 - protein, 9 aa, Artificial Sequence
  source: /note="Description of Artificial Sequence: Synthetic peptide"
IIHTRVKAL

SEQ ID NO: 32780 - protein, 9 aa, Artificial Sequence
  source: /note="Description of Artificial Sequence: Synthetic peptide"
RSVLTKHQI

SEQ ID NO: 32781 - protein, 10 aa, Artificial Sequence
  source: /note="Description of Artificial Sequence: Synthetic peptide"
LTKHQIIHTR

SEQ ID NO: 32782 - protein, 10 aa, Artificial Sequence
  source: /note="Description of Artificial Sequence: Synthetic peptide"
KHQIIHTRVK

SEQ ID NO: 32783 - protein, 10 aa, Artificial Sequence
  source: /note="Description of Artificial Sequence: Synthetic peptide"
RSVLTKHQII

SEQ ID NO: 32784 - protein, 10 aa, Artificial Sequence
  source: /note="Description of Artificial Sequence: Synthetic peptide"
HQIIHTRVKA

SEQ ID NO: 32785 - protein, 9 aa, Artificial Sequence
  source: /note="Description of Artificial Sequence: Synthetic peptide"
KIRHTENKS

SEQ ID NO: 32786 - protein, 9 aa, Artificial Sequence
  source: /note="Description of Artificial Sequence: Synthetic peptide"
RHTENKSFK

SEQ ID NO: 32787 - protein, 9 aa, Artificial Sequence
  source: /note="Description of Artificial Sequence: Synthetic peptide"
IRHTENKSF

SEQ ID NO: 32788 - protein, 10 aa, Artificial Sequence
  source: /note="Description of Artificial Sequence: Synthetic peptide"
HTENKSFKCK

SEQ ID NO: 32789 - protein, 10 aa, Artificial Sequence
  source: /note="Description of Artificial Sequence: Synthetic peptide"
RPKIRHTENK

SEQ ID NO: 32790 - protein, 10 aa, Artificial Sequence
  source: /note="Description of Artificial Sequence: Synthetic peptide"
KIRHTENKSF

SEQ ID NO: 32791 - protein, 9 aa, Artificial Sequence
  source: /note="Description of Artificial Sequence: Synthetic peptide"
IIHTREKAY

SEQ ID NO: 32792 - protein, 10 aa, Artificial Sequence
  source: /note="Description of Artificial Sequence: Synthetic peptide"
IIHTREKAYK

SEQ ID NO: 32793 - protein, 10 aa, Artificial Sequence
  source: /note="Description of Artificial Sequence: Synthetic peptide"
KIIHTREKAY

SEQ ID NO: 32794 - protein, 10 aa, Artificial Sequence
  source: /note="Description of Artificial Sequence: Synthetic peptide"
RSSHLTKHKI

SEQ ID NO: 32795 - protein, 9 aa, Artificial Sequence
  source: /note="Description of Artificial Sequence: Synthetic peptide"
IIDEFIVKL

SEQ ID NO: 32796 - protein, 9 aa, Artificial Sequence
  source: /note="Description of Artificial Sequence: Synthetic peptide"
ATAEIIDEF

SEQ ID NO: 32797 - protein, 9 aa, Artificial Sequence
  source: /note="Description of Artificial Sequence: Synthetic peptide"
AEIIDEFIV

SEQ ID NO: 32798 - protein, 10 aa, Artificial Sequence
  source: /note="Description of Artificial Sequence: Synthetic peptide"
ATAEIIDEFI

SEQ ID NO: 32799 - protein, 10 aa, Artificial Sequence
  source: /note="Description of Artificial Sequence: Synthetic peptide"
IIDEFIVKLK

SEQ ID NO: 32800 - protein, 10 aa, Artificial Sequence
  source: /note="Description of Artificial Sequence: Synthetic peptide"
EIIDEFIVKL

SEQ ID NO: 32801 - protein, 10 aa, Artificial Sequence
  source: /note="Description of Artificial Sequence: Synthetic peptide"
RANKDATAEI

SEQ ID NO: 32802 - protein, 9 aa, Artificial Sequence
  source: /note="Description of Artificial Sequence: Synthetic peptide"
SNLLRHQII

SEQ ID NO: 32803 - protein, 9 aa, Artificial Sequence
  source: /note="Description of Artificial Sequence: Synthetic peptide"
HFQIHTGIK

SEQ ID NO: 32804 - protein, 9 aa, Artificial Sequence
  source: /note="Description of Artificial Sequence: Synthetic peptide"
FQIHTGIKP

SEQ ID NO: 32805 - protein, 10 aa, Artificial Sequence
  source: /note="Description of Artificial Sequence: Synthetic peptide"
CLSDHFQIHT

SEQ ID NO: 32806 - protein, 10 aa, Artificial Sequence
  source: /note="Description of Artificial Sequence: Synthetic peptide"
QIHTGIKPYK

SEQ ID NO: 32807 - protein, 10 aa, Artificial Sequence
  source: /note="Description of Artificial Sequence: Synthetic peptide"
FQIHTGIKPY

SEQ ID NO: 32808 - protein, 9 aa, Artificial Sequence
  source: /note="Description of Artificial Sequence: Synthetic peptide"
FQLHEQTHT

SEQ ID NO: 32809 - protein, 10 aa, Artificial Sequence
  source: /note="Description of Artificial Sequence: Synthetic peptide"
EQTHTGEKPY

SEQ ID NO: 32810 - protein, 10 aa, Artificial Sequence
  source: /note="Description of Artificial Sequence: Synthetic peptide"
FQLHEQTHTG

SEQ ID NO: 32811 - protein, 9 aa, Artificial Sequence
  source: /note="Description of Artificial Sequence: Synthetic peptide"
KTSQKSILS

SEQ ID NO: 32812 - protein, 10 aa, Artificial Sequence
  source: /note="Description of Artificial Sequence: Synthetic peptide"
KTSQKSILSA

SEQ ID NO: 32813 - protein, 10 aa, Artificial Sequence
  source: /note="Description of Artificial Sequence: Synthetic peptide"
IIHTGTKPYK

SEQ ID NO: 32814 - protein, 9 aa, Artificial Sequence
  source: /note="Description of Artificial Sequence: Synthetic peptide"
QLQCHIKNV

SEQ ID NO: 32815 - protein, 9 aa, Artificial Sequence
  source: /note="Description of Artificial Sequence: Synthetic peptide"
LQCHIKNVH

SEQ ID NO: 32816 - protein, 9 aa, Artificial Sequence
  source: /note="Description of Artificial Sequence: Synthetic peptide"
CHIKNVHTA

SEQ ID NO: 32817 - protein, 10 aa, Artificial Sequence
  source: /note="Description of Artificial Sequence: Synthetic peptide"
FQLQCHIKNV

SEQ ID NO: 32818 - protein, 9 aa, Artificial Sequence
  source: /note="Description of Artificial Sequence: Synthetic peptide"
HHKPGKMPY

SEQ ID NO: 32819 - protein, 9 aa, Artificial Sequence
  source: /note="Description of Artificial Sequence: Synthetic peptide"
GKMPYVCQV

SEQ ID NO: 32820 - protein, 10 aa, Artificial Sequence
  source: /note="Description of Artificial Sequence: Synthetic peptide"
HMKDHHKPGK

SEQ ID NO: 32821 - protein, 10 aa, Artificial Sequence
  source: /note="Description of Artificial Sequence: Synthetic peptide"
MKDHHKPGKM

SEQ ID NO: 32822 - protein, 10 aa, Artificial Sequence
  source: /note="Description of Artificial Sequence: Synthetic peptide"
GKMPYVCQVC

SEQ ID NO: 32823 - protein, 9 aa, Artificial Sequence
  source: /note="Description of Artificial Sequence: Synthetic peptide"
GYQLTQHQI

SEQ ID NO: 32824 - protein, 9 aa, Artificial Sequence
  source: /note="Description of Artificial Sequence: Synthetic peptide"
YQLTQHQIF

SEQ ID NO: 32825 - protein, 9 aa, Artificial Sequence
  source: /note="Description of Artificial Sequence: Synthetic peptide"
TQHQIFHTG

SEQ ID NO: 32826 - protein, 10 aa, Artificial Sequence
  source: /note="Description of Artificial Sequence: Synthetic peptide"
GYQLTQHQIF

SEQ ID NO: 32827 - protein, 10 aa, Artificial Sequence
  source: /note="Description of Artificial Sequence: Synthetic peptide"
WGYQLTQHQI

SEQ ID NO: 32828 - protein, 10 aa, Artificial Sequence
  source: /note="Description of Artificial Sequence: Synthetic peptide"
YQLTQHQIFH

SEQ ID NO: 32829 - protein, 10 aa, Artificial Sequence
  source: /note="Description of Artificial Sequence: Synthetic peptide"
KLEQKSPDLK

SEQ ID NO: 32830 - protein, 9 aa, Artificial Sequence
  source: /note="Description of Artificial Sequence: Synthetic peptide"
ENSFWHHLV

SEQ ID NO: 32831 - protein, 9 aa, Artificial Sequence
  source: /note="Description of Artificial Sequence: Synthetic peptide"
NSFWHHLVL

SEQ ID NO: 32832 - protein, 9 aa, Artificial Sequence
  source: /note="Description of Artificial Sequence: Synthetic peptide"
KCSKCENSF

SEQ ID NO: 32833 - protein, 9 aa, Artificial Sequence
  source: /note="Description of Artificial Sequence: Synthetic peptide"
CENSFWHHL

SEQ ID NO: 32834 - protein, 10 aa, Artificial Sequence
  source: /note="Description of Artificial Sequence: Synthetic peptide"
YKCSKCENSF

SEQ ID NO: 32835 - protein, 10 aa, Artificial Sequence
  source: /note="Description of Artificial Sequence: Synthetic peptide"
CENSFWHHLV

SEQ ID NO: 32836 - protein, 9 aa, Artificial Sequence
  source: /note="Description of Artificial Sequence: Synthetic peptide"
HMQTHTGEK

SEQ ID NO: 32837 - protein, 9 aa, Artificial Sequence
  source: /note="Description of Artificial Sequence: Synthetic peptide"
KSHMQTHTG

SEQ ID NO: 32838 - protein, 10 aa, Artificial Sequence
  source: /note="Description of Artificial Sequence: Synthetic peptide"
SHMQTHTGEK

SEQ ID NO: 32839 - protein, 10 aa, Artificial Sequence
  source: /note="Description of Artificial Sequence: Synthetic peptide"
MQTHTGEKPY

SEQ ID NO: 32840 - protein, 10 aa, Artificial Sequence
  source: /note="Description of Artificial Sequence: Synthetic peptide"
QTHTGEKPYV

SEQ ID NO: 32841 - protein, 9 aa, Artificial Sequence
  source: /note="Description of Artificial Sequence: Synthetic peptide"
AVNVENFYV

SEQ ID NO: 32842 - protein, 9 aa, Artificial Sequence
  source: /note="Description of Artificial Sequence: Synthetic peptide"
FVNLPSMCI

SEQ ID NO: 32843 - protein, 9 aa, Artificial Sequence
  source: /note="Description of Artificial Sequence: Synthetic peptide"
FYVRNQPSL

SEQ ID NO: 32844 - protein, 9 aa, Artificial Sequence
  source: /note="Description of Artificial Sequence: Synthetic peptide"
RIHTGENPM

SEQ ID NO: 32845 - protein, 9 aa, Artificial Sequence
  source: /note="Description of Artificial Sequence: Synthetic peptide"
HTGENPMNV

SEQ ID NO: 32846 - protein, 9 aa, Artificial Sequence
  source: /note="Description of Artificial Sequence: Synthetic peptide"
EVIQERSPM

SEQ ID NO: 32847 - protein, 9 aa, Artificial Sequence
  source: /note="Description of Artificial Sequence: Synthetic peptide"
NAVNVENFY

SEQ ID NO: 32848 - protein, 9 aa, Artificial Sequence
  source: /note="Description of Artificial Sequence: Synthetic peptide"
VVNVRKPSF

SEQ ID NO: 32849 - protein, 9 aa, Artificial Sequence
  source: /note="Description of Artificial Sequence: Synthetic peptide"
VRKPSFVNL

SEQ ID NO: 32850 - protein, 9 aa, Artificial Sequence
  source: /note="Description of Artificial Sequence: Synthetic peptide"
PSFVNLPSM

SEQ ID NO: 32851 - protein, 9 aa, Artificial Sequence
  source: /note="Description of Artificial Sequence: Synthetic peptide"
QERSPMNAV

SEQ ID NO: 32852 - protein, 9 aa, Artificial Sequence
  source: /note="Description of Artificial Sequence: Synthetic peptide"
MNAVNVENF

SEQ ID NO: 32853 - protein, 9 aa, Artificial Sequence
  source: /note="Description of Artificial Sequence: Synthetic peptide"
VRNQPSLHI

SEQ ID NO: 32854 - protein, 9 aa, Artificial Sequence
  source: /note="Description of Artificial Sequence: Synthetic peptide"
LPSMCIEEV

SEQ ID NO: 32855 - protein, 10 aa, Artificial Sequence
  source: /note="Description of Artificial Sequence: Synthetic peptide"
NLPSMCIEEV

SEQ ID NO: 32856 - protein, 10 aa, Artificial Sequence
  source: /note="Description of Artificial Sequence: Synthetic peptide"
VVNVRKPSFV

SEQ ID NO: 32857 - protein, 10 aa, Artificial Sequence
  source: /note="Description of Artificial Sequence: Synthetic peptide"
AVNVENFYVR

SEQ ID NO: 32858 - protein, 10 aa, Artificial Sequence
  source: /note="Description of Artificial Sequence: Synthetic peptide"
SFVNLPSMCI

SEQ ID NO: 32859 - protein, 10 aa, Artificial Sequence
  source: /note="Description of Artificial Sequence: Synthetic peptide"
NVRKPSFVNL

SEQ ID NO: 32860 - protein, 10 aa, Artificial Sequence
  source: /note="Description of Artificial Sequence: Synthetic peptide"
YVRNQPSLHI

SEQ ID NO: 32861 - protein, 10 aa, Artificial Sequence
  source: /note="Description of Artificial Sequence: Synthetic peptide"
MNAVNVENFY

SEQ ID NO: 32862 - protein, 10 aa, Artificial Sequence
  source: /note="Description of Artificial Sequence: Synthetic peptide"
HTGENPMNVV

SEQ ID NO: 32863 - protein, 10 aa, Artificial Sequence
  source: /note="Description of Artificial Sequence: Synthetic peptide"
NAVNVENFYV

SEQ ID NO: 32864 - protein, 10 aa, Artificial Sequence
  source: /note="Description of Artificial Sequence: Synthetic peptide"
KPSFVNLPSM

SEQ ID NO: 32865 - protein, 10 aa, Artificial Sequence
  source: /note="Description of Artificial Sequence: Synthetic peptide"
NFYVRNQPSL

SEQ ID NO: 32866 - protein, 10 aa, Artificial Sequence
  source: /note="Description of Artificial Sequence: Synthetic peptide"
QRIHTGENPM

SEQ ID NO: 32867 - protein, 10 aa, Artificial Sequence
  source: /note="Description of Artificial Sequence: Synthetic peptide"
GENPMNVVNV

SEQ ID NO: 32868 - protein, 10 aa, Artificial Sequence
  source: /note="Description of Artificial Sequence: Synthetic peptide"
NVVNVRKPSF

SEQ ID NO: 32869 - protein, 10 aa, Artificial Sequence
  source: /note="Description of Artificial Sequence: Synthetic peptide"
EEVIQERSPM

SEQ ID NO: 32870 - protein, 10 aa, Artificial Sequence
  source: /note="Description of Artificial Sequence: Synthetic peptide"
IQERSPMNAV

SEQ ID NO: 32871 - protein, 10 aa, Artificial Sequence
  source: /note="Description of Artificial Sequence: Synthetic peptide"
PMNAVNVENF

SEQ ID NO: 32872 - protein, 10 aa, Artificial Sequence
  source: /note="Description of Artificial Sequence: Synthetic peptide"
LPSMCIEEVI

SEQ ID NO: 32873 - protein, 9 aa, Artificial Sequence
  source: /note="Description of Artificial Sequence: Synthetic peptide"
SASLIQHEI

SEQ ID NO: 32874 - protein, 9 aa, Artificial Sequence
  source: /note="Description of Artificial Sequence: Synthetic peptide"
IQHEIIHTG

SEQ ID NO: 32875 - protein, 10 aa, Artificial Sequence
  source: /note="Description of Artificial Sequence: Synthetic peptide"
SLIQHEIIHT

SEQ ID NO: 32876 - protein, 10 aa, Artificial Sequence
  source: /note="Description of Artificial Sequence: Synthetic peptide"
QSASLIQHEI

SEQ ID NO: 32877 - protein, 9 aa, Artificial Sequence
  source: /note="Description of Artificial Sequence: Synthetic peptide"
EEDSLKANL

SEQ ID NO: 32878 - protein, 10 aa, Artificial Sequence
  source: /note="Description of Artificial Sequence: Synthetic peptide"
IEEDSLKANL

SEQ ID NO: 32879 - protein, 9 aa, Artificial Sequence
  source: /note="Description of Artificial Sequence: Synthetic peptide"
RIAGEPSAA

SEQ ID NO: 32880 - protein, 9 aa, Artificial Sequence
  source: /note="Description of Artificial Sequence: Synthetic peptide"
SSGLTATPR

SEQ ID NO: 32881 - protein, 9 aa, Artificial Sequence
  source: /note="Description of Artificial Sequence: Synthetic peptide"
ATPRSWPPA

SEQ ID NO: 32882 - protein, 9 aa, Artificial Sequence
  source: /note="Description of Artificial Sequence: Synthetic peptide"
RPGPSPARI

SEQ ID NO: 32883 - protein, 9 aa, Artificial Sequence
  source: /note="Description of Artificial Sequence: Synthetic peptide"
GLTATPRSW

SEQ ID NO: 32884 - protein, 9 aa, Artificial Sequence
  source: /note="Description of Artificial Sequence: Synthetic peptide"
ARIAGEPSA

SEQ ID NO: 32885 - protein, 10 aa, Artificial Sequence
  source: /note="Description of Artificial Sequence: Synthetic peptide"
RIAGEPSAAA

SEQ ID NO: 32886 - protein, 10 aa, Artificial Sequence
  source: /note="Description of Artificial Sequence: Synthetic peptide"
ISSGLTATPR

SEQ ID NO: 32887 - protein, 10 aa, Artificial Sequence
  source: /note="Description of Artificial Sequence: Synthetic peptide"
PARPGPSPAR

SEQ ID NO: 32888 - protein, 10 aa, Artificial Sequence
  source: /note="Description of Artificial Sequence: Synthetic peptide"
TPRSWPPAPR

SEQ ID NO: 32889 - protein, 10 aa, Artificial Sequence
  source: /note="Description of Artificial Sequence: Synthetic peptide"
APRCSPPPPA

SEQ ID NO: 32890 - protein, 10 aa, Artificial Sequence
  source: /note="Description of Artificial Sequence: Synthetic peptide"
RPGPSPARIA

SEQ ID NO: 32891 - protein, 10 aa, Artificial Sequence
  source: /note="Description of Artificial Sequence: Synthetic peptide"
SGLTATPRSW

SEQ ID NO: 32892 - protein, 10 aa, Artificial Sequence
  source: /note="Description of Artificial Sequence: Synthetic peptide"
ARIAGEPSAA

SEQ ID NO: 32893 - protein, 9 aa, Artificial Sequence
  source: /note="Description of Artificial Sequence: Synthetic peptide"
NLQKQTERV

SEQ ID NO: 32894 - protein, 9 aa, Artificial Sequence
  source: /note="Description of Artificial Sequence: Synthetic peptide"
LQKQTERVL

SEQ ID NO: 32895 - protein, 10 aa, Artificial Sequence
  source: /note="Description of Artificial Sequence: Synthetic peptide"
KIHPAVNLQK

SEQ ID NO: 32896 - protein, 9 aa, Artificial Sequence
  source: /note="Description of Artificial Sequence: Synthetic peptide"
SKHKTMLEA

SEQ ID NO: 32897 - protein, 10 aa, Artificial Sequence
  source: /note="Description of Artificial Sequence: Synthetic peptide"
GSKHKTMLEA

SEQ ID NO: 32898 - protein, 10 aa, Artificial Sequence
  source: /note="Description of Artificial Sequence: Synthetic peptide"
SQLEAHNSGS

SEQ ID NO: 32899 - protein, 10 aa, Artificial Sequence
  source: /note="Description of Artificial Sequence: Synthetic peptide"
LEAHNSGSKH

SEQ ID NO: 32900 - protein, 9 aa, Artificial Sequence
  source: /note="Description of Artificial Sequence: Synthetic peptide"
ILDTNSTNV

SEQ ID NO: 32901 - protein, 9 aa, Artificial Sequence
  source: /note="Description of Artificial Sequence: Synthetic peptide"
KLLTSPQSL

SEQ ID NO: 32902 - protein, 9 aa, Artificial Sequence
  source: /note="Description of Artificial Sequence: Synthetic peptide"
LLTSPQSLL

SEQ ID NO: 32903 - protein, 10 aa, Artificial Sequence
  source: /note="Description of Artificial Sequence: Synthetic peptide"
IILDTNSTNV

SEQ ID NO: 32904 - protein, 10 aa, Artificial Sequence
  source: /note="Description of Artificial Sequence: Synthetic peptide"
KLLTSPQSLL

SEQ ID NO: 32905 - protein, 10 aa, Artificial Sequence
  source: /note="Description of Artificial Sequence: Synthetic peptide"
ILDTNSTNVK

SEQ ID NO: 32906 - protein, 10 aa, Artificial Sequence
  source: /note="Description of Artificial Sequence: Synthetic peptide"
SSRLTTHKKI

SEQ ID NO: 32907 - protein, 10 aa, Artificial Sequence
  source: /note="Description of Artificial Sequence: Synthetic peptide"
DTNSTNVKNV

SEQ ID NO: 32908 - protein, 10 aa, Artificial Sequence
  source: /note="Description of Artificial Sequence: Synthetic peptide"
LTSPQSLLPI

SEQ ID NO: 32909 - protein, 10 aa, Artificial Sequence
  source: /note="Description of Artificial Sequence: Synthetic peptide"
RLTTHKKIIL

SEQ ID NO: 32910 - protein, 10 aa, Artificial Sequence
  source: /note="Description of Artificial Sequence: Synthetic peptide"
AKLLTSPQSL

SEQ ID NO: 32911 - protein, 9 aa, Artificial Sequence
  source: /note="Description of Artificial Sequence: Synthetic peptide"
IICTGEKFY

SEQ ID NO: 32912 - protein, 9 aa, Artificial Sequence
  source: /note="Description of Artificial Sequence: Synthetic peptide"
KIICTGEKF

SEQ ID NO: 32913 - protein, 10 aa, Artificial Sequence
  source: /note="Description of Artificial Sequence: Synthetic peptide"
IICTGEKFYK

SEQ ID NO: 32914 - protein, 10 aa, Artificial Sequence
  source: /note="Description of Artificial Sequence: Synthetic peptide"
CTGEKFYKCK

SEQ ID NO: 32915 - protein, 10 aa, Artificial Sequence
  source: /note="Description of Artificial Sequence: Synthetic peptide"
THKIICTGEK

SEQ ID NO: 32916 - protein, 10 aa, Artificial Sequence
  source: /note="Description of Artificial Sequence: Synthetic peptide"
KIICTGEKFY

SEQ ID NO: 32917 - protein, 10 aa, Artificial Sequence
  source: /note="Description of Artificial Sequence: Synthetic peptide"
HKIICTGEKF

SEQ ID NO: 32918 - protein, 9 aa, Artificial Sequence
  source: /note="Description of Artificial Sequence: Synthetic peptide"
RTPEQCCTK

SEQ ID NO: 32919 - protein, 9 aa, Artificial Sequence
  source: /note="Description of Artificial Sequence: Synthetic peptide"
CTKFKSLQL

SEQ ID NO: 32920 - protein, 9 aa, Artificial Sequence
  source: /note="Description of Artificial Sequence: Synthetic peptide"
TPEQCCTKF

SEQ ID NO: 32921 - protein, 10 aa, Artificial Sequence
  source: /note="Description of Artificial Sequence: Synthetic peptide"
RTPEQCCTKF

SEQ ID NO: 32922 - protein, 9 aa, Artificial Sequence
  source: /note="Description of Artificial Sequence: Synthetic peptide"
ITHIGEKPY

SEQ ID NO: 32923 - protein, 9 aa, Artificial Sequence
  source: /note="Description of Artificial Sequence: Synthetic peptide"
HRIHEITHI

SEQ ID NO: 32924 - protein, 10 aa, Artificial Sequence
  source: /note="Description of Artificial Sequence: Synthetic peptide"
YSATHRIHEI

SEQ ID NO: 32925 - protein, 9 aa, Artificial Sequence
  source: /note="Description of Artificial Sequence: Synthetic peptide"
SSSLQIHER

SEQ ID NO: 32926 - protein, 9 aa, Artificial Sequence
  source: /note="Description of Artificial Sequence: Synthetic peptide"
FSVSSSLQI

SEQ ID NO: 32927 - protein, 10 aa, Artificial Sequence
  source: /note="Description of Artificial Sequence: Synthetic peptide"
VSSSLQIHER

SEQ ID NO: 32928 - protein, 10 aa, Artificial Sequence
  source: /note="Description of Artificial Sequence: Synthetic peptide"
RAFSVSSSLQ

SEQ ID NO: 32929 - protein, 10 aa, Artificial Sequence
  source: /note="Description of Artificial Sequence: Synthetic peptide"
FSVSSSLQIH

SEQ ID NO: 32930 - protein, 9 aa, Artificial Sequence
  source: /note="Description of Artificial Sequence: Synthetic peptide"
CLIHEITHT

SEQ ID NO: 32931 - protein, 9 aa, Artificial Sequence
  source: /note="Description of Artificial Sequence: Synthetic peptide"
SSSCLIHEI

SEQ ID NO: 32932 - protein, 10 aa, Artificial Sequence
  source: /note="Description of Artificial Sequence: Synthetic peptide"
DSSSCLIHEI

SEQ ID NO: 32933 - protein, 10 aa, Artificial Sequence
  source: /note="Description of Artificial Sequence: Synthetic peptide"
EITHTGEKPY

SEQ ID NO: 32934 - protein, 9 aa, Artificial Sequence
  source: /note="Description of Artificial Sequence: Synthetic peptide"
TFMCQQCGK

SEQ ID NO: 32935 - protein, 9 aa, Artificial Sequence
  source: /note="Description of Artificial Sequence: Synthetic peptide"
KTFMCQQCG

SEQ ID NO: 32936 - protein, 9 aa, Artificial Sequence
  source: /note="Description of Artificial Sequence: Synthetic peptide"
APAVEKTFM

SEQ ID NO: 32937 - protein, 9 aa, Artificial Sequence
  source: /note="Description of Artificial Sequence: Synthetic peptide"
MCQQCGKTF

SEQ ID NO: 32938 - protein, 10 aa, Artificial Sequence
  source: /note="Description of Artificial Sequence: Synthetic peptide"
KTFMCQQCGK

SEQ ID NO: 32939 - protein, 10 aa, Artificial Sequence
  source: /note="Description of Artificial Sequence: Synthetic peptide"
FMCQQCGKTF

SEQ ID NO: 32940 - protein, 9 aa, Artificial Sequence
  source: /note="Description of Artificial Sequence: Synthetic peptide"
SSLTEHQII

SEQ ID NO: 32941 - protein, 9 aa, Artificial Sequence
  source: /note="Description of Artificial Sequence: Synthetic peptide"
TEHQIIHTG

SEQ ID NO: 32942 - protein, 10 aa, Artificial Sequence
  source: /note="Description of Artificial Sequence: Synthetic peptide"
SLTEHQIIHT

SEQ ID NO: 32943 - protein, 9 aa, Artificial Sequence
  source: /note="Description of Artificial Sequence: Synthetic peptide"
KVFSKISTL

SEQ ID NO: 32944 - protein, 9 aa, Artificial Sequence
  source: /note="Description of Artificial Sequence: Synthetic peptide"
FSKISTLNK

SEQ ID NO: 32945 - protein, 9 aa, Artificial Sequence
  source: /note="Description of Artificial Sequence: Synthetic peptide"
ISTLNKHQK

SEQ ID NO: 32946 - protein, 10 aa, Artificial Sequence
  source: /note="Description of Artificial Sequence: Synthetic peptide"
VFSKISTLNK

SEQ ID NO: 32947 - protein, 10 aa, Artificial Sequence
  source: /note="Description of Artificial Sequence: Synthetic peptide"
KISTLNKHQK

SEQ ID NO: 32948 - protein, 10 aa, Artificial Sequence
  source: /note="Description of Artificial Sequence: Synthetic peptide"
GKVFSKISTL

SEQ ID NO: 32949 - protein, 10 aa, Artificial Sequence
  source: /note="Description of Artificial Sequence: Synthetic peptide"
SECGKVFSKI

SEQ ID NO: 32950 - protein, 9 aa, Artificial Sequence
  source: /note="Description of Artificial Sequence: Synthetic peptide"
PTSSNTVKK

SEQ ID NO: 32951 - protein, 10 aa, Artificial Sequence
  source: /note="Description of Artificial Sequence: Synthetic peptide"
DSHPTSSNTV

SEQ ID NO: 32952 - protein, 10 aa, Artificial Sequence
  source: /note="Description of Artificial Sequence: Synthetic peptide"
LENETDSHPT

SEQ ID NO: 32953 - protein, 9 aa, Artificial Sequence
  source: /note="Description of Artificial Sequence: Synthetic peptide"
KSLTLHQII

SEQ ID NO: 32954 - protein, 9 aa, Artificial Sequence
  source: /note="Description of Artificial Sequence: Synthetic peptide"
RKSLTLHQI

SEQ ID NO: 32955 - protein, 10 aa, Artificial Sequence
  source: /note="Description of Artificial Sequence: Synthetic peptide"
KSLTLHQIIH

SEQ ID NO: 32956 - protein, 10 aa, Artificial Sequence
  source: /note="Description of Artificial Sequence: Synthetic peptide"
RKSLTLHQII

SEQ ID NO: 32957 - protein, 9 aa, Artificial Sequence
  source: /note="Description of Artificial Sequence: Synthetic peptide"
SEHLIQHQI

SEQ ID NO: 32958 - protein, 10 aa, Artificial Sequence
  source: /note="Description of Artificial Sequence: Synthetic peptide"
SEHLIQHQII

SEQ ID NO: 32959 - protein, 9 aa, Artificial Sequence
  source: /note="Description of Artificial Sequence: Synthetic peptide"
SSAHIKHQR

SEQ ID NO: 32960 - protein, 9 aa, Artificial Sequence
  source: /note="Description of Artificial Sequence: Synthetic peptide"
HIKHQRTHR

SEQ ID NO: 32961 - protein, 9 aa, Artificial Sequence
  source: /note="Description of Artificial Sequence: Synthetic peptide"
KGFGDSSAH

SEQ ID NO: 32962 - protein, 9 aa, Artificial Sequence
  source: /note="Description of Artificial Sequence: Synthetic peptide"
AHIKHQRTH

SEQ ID NO: 32963 - protein, 10 aa, Artificial Sequence
  source: /note="Description of Artificial Sequence: Synthetic peptide"
DSSAHIKHQR

SEQ ID NO: 32964 - protein, 10 aa, Artificial Sequence
  source: /note="Description of Artificial Sequence: Synthetic peptide"
KGFGDSSAHI

SEQ ID NO: 32965 - protein, 9 aa, Artificial Sequence
  source: /note="Description of Artificial Sequence: Synthetic peptide"
RTSHISALI

SEQ ID NO: 32966 - protein, 9 aa, Artificial Sequence
  source: /note="Description of Artificial Sequence: Synthetic peptide"
HISALIAAR

SEQ ID NO: 32967 - protein, 9 aa, Artificial Sequence
  source: /note="Description of Artificial Sequence: Synthetic peptide"
RPRTSHISA

SEQ ID NO: 32968 - protein, 9 aa, Artificial Sequence
  source: /note="Description of Artificial Sequence: Synthetic peptide"
AARGLCSAA

SEQ ID NO: 32969 - protein, 9 aa, Artificial Sequence
  source: /note="Description of Artificial Sequence: Synthetic peptide"
LPRDRRPRT

SEQ ID NO: 32970 - protein, 9 aa, Artificial Sequence
  source: /note="Description of Artificial Sequence: Synthetic peptide"
SHISALIAA

SEQ ID NO: 32971 - protein, 10 aa, Artificial Sequence
  source: /note="Description of Artificial Sequence: Synthetic peptide"
LIAARGLCSA

SEQ ID NO: 32972 - protein, 10 aa, Artificial Sequence
  source: /note="Description of Artificial Sequence: Synthetic peptide"
RQLPRDRRPR

SEQ ID NO: 32973 - protein, 10 aa, Artificial Sequence
  source: /note="Description of Artificial Sequence: Synthetic peptide"
RTSHISALIA

SEQ ID NO: 32974 - protein, 10 aa, Artificial Sequence
  source: /note="Description of Artificial Sequence: Synthetic peptide"
TSHISALIAA

SEQ ID NO: 32975 - protein, 10 aa, Artificial Sequence
  source: /note="Description of Artificial Sequence: Synthetic peptide"
AARGLCSAAA

SEQ ID NO: 32976 - protein, 10 aa, Artificial Sequence
  source: /note="Description of Artificial Sequence: Synthetic peptide"
HLGQPRQLPR

SEQ ID NO: 32977 - protein, 10 aa, Artificial Sequence
  source: /note="Description of Artificial Sequence: Synthetic peptide"
SHISALIAAR

SEQ ID NO: 32978 - protein, 10 aa, Artificial Sequence
  source: /note="Description of Artificial Sequence: Synthetic peptide"
LPRDRRPRTS

SEQ ID NO: 32979 - protein, 10 aa, Artificial Sequence
  source: /note="Description of Artificial Sequence: Synthetic peptide"
RPRTSHISAL

SEQ ID NO: 32980 - protein, 10 aa, Artificial Sequence
  source: /note="Description of Artificial Sequence: Synthetic peptide"
DQWCPDGSHL

SEQ ID NO: 32981 - protein, 10 aa, Artificial Sequence
  source: /note="Description of Artificial Sequence: Synthetic peptide"
IAARGLCSAA

SEQ ID NO: 32982 - protein, 9 aa, Artificial Sequence
  source: /note="Description of Artificial Sequence: Synthetic peptide"
NQNKPLSCV

SEQ ID NO: 32983 - protein, 9 aa, Artificial Sequence
  source: /note="Description of Artificial Sequence: Synthetic peptide"
LSCVVFINK

SEQ ID NO: 32984 - protein, 9 aa, Artificial Sequence
  source: /note="Description of Artificial Sequence: Synthetic peptide"
NKPLSCVVF

SEQ ID NO: 32985 - protein, 9 aa, Artificial Sequence
  source: /note="Description of Artificial Sequence: Synthetic peptide"
KPLSCVVFI

SEQ ID NO: 32986 - protein, 10 aa, Artificial Sequence
  source: /note="Description of Artificial Sequence: Synthetic peptide"
NQNKPLSCVV

SEQ ID NO: 32987 - protein, 10 aa, Artificial Sequence
  source: /note="Description of Artificial Sequence: Synthetic peptide"
PLSCVVFINK

SEQ ID NO: 32988 - protein, 10 aa, Artificial Sequence
  source: /note="Description of Artificial Sequence: Synthetic peptide"
LSCVVFINKK

SEQ ID NO: 32989 - protein, 10 aa, Artificial Sequence
  source: /note="Description of Artificial Sequence: Synthetic peptide"
QNKPLSCVVF

SEQ ID NO: 32990 - protein, 10 aa, Artificial Sequence
  source: /note="Description of Artificial Sequence: Synthetic peptide"
KSSTLTGHQI

SEQ ID NO: 32991 - protein, 9 aa, Artificial Sequence
  source: /note="Description of Artificial Sequence: Synthetic peptide"
QLSTPKLLV

SEQ ID NO: 32992 - protein, 9 aa, Artificial Sequence
  source: /note="Description of Artificial Sequence: Synthetic peptide"
GQLSTPKLL

SEQ ID NO: 32993 - protein, 10 aa, Artificial Sequence
  source: /note="Description of Artificial Sequence: Synthetic peptide"
CWGQLSTPKL

SEQ ID NO: 32994 - protein, 10 aa, Artificial Sequence
  source: /note="Description of Artificial Sequence: Synthetic peptide"
GQLSTPKLLV

SEQ ID NO: 32995 - protein, 9 aa, Artificial Sequence
  source: /note="Description of Artificial Sequence: Synthetic peptide"
SAKYIQIHG

SEQ ID NO: 32996 - protein, 9 aa, Artificial Sequence
  source: /note="Description of Artificial Sequence: Synthetic peptide"
RSAKYIQIH

SEQ ID NO: 32997 - protein, 9 aa, Artificial Sequence
  source: /note="Description of Artificial Sequence: Synthetic peptide"
FRSAKYIQI

SEQ ID NO: 32998 - protein, 9 aa, Artificial Sequence
  source: /note="Description of Artificial Sequence: Synthetic peptide"
IQIHGRTHT

SEQ ID NO: 32999 - protein, 10 aa, Artificial Sequence
  source: /note="Description of Artificial Sequence: Synthetic peptide"
AFRSAKYIQI

SEQ ID NO: 33000 - protein, 10 aa, Artificial Sequence
  source: /note="Description of Artificial Sequence: Synthetic peptide"
SAKYIQIHGR

SEQ ID NO: 33001 - protein, 10 aa, Artificial Sequence
  source: /note="Description of Artificial Sequence: Synthetic peptide"
IQIHGRTHTG

SEQ ID NO: 33002 - protein, 9 aa, Artificial Sequence
  source: /note="Description of Artificial Sequence: Synthetic peptide"
RIHTGEKHY

SEQ ID NO: 33003 - protein, 10 aa, Artificial Sequence
  source: /note="Description of Artificial Sequence: Synthetic peptide"
RIHTGEKHYK

SEQ ID NO: 33004 - protein, 10 aa, Artificial Sequence
  source: /note="Description of Artificial Sequence: Synthetic peptide"
KRIHTGEKHY

SEQ ID NO: 33005 - protein, 9 aa, Artificial Sequence
  source: /note="Description of Artificial Sequence: Synthetic peptide"
MTFEDVAGE

SEQ ID NO: 33006 - protein, 10 aa, Artificial Sequence
  source: /note="Description of Artificial Sequence: Synthetic peptide"
MTFEDVAGEF

SEQ ID NO: 33007 - protein, 10 aa, Artificial Sequence
  source: /note="Description of Artificial Sequence: Synthetic peptide"
VAGEFSQWEW

SEQ ID NO: 33008 - protein, 9 aa, Artificial Sequence
  source: /note="Description of Artificial Sequence: Synthetic peptide"
YFKCKECGK

SEQ ID NO: 33009 - protein, 9 aa, Artificial Sequence
  source: /note="Description of Artificial Sequence: Synthetic peptide"
QRIHTGEKY

SEQ ID NO: 33010 - protein, 9 aa, Artificial Sequence
  source: /note="Description of Artificial Sequence: Synthetic peptide"
RIHTGEKYF

SEQ ID NO: 33011 - protein, 10 aa, Artificial Sequence
  source: /note="Description of Artificial Sequence: Synthetic peptide"
RIHTGEKYFK

SEQ ID NO: 33012 - protein, 10 aa, Artificial Sequence
  source: /note="Description of Artificial Sequence: Synthetic peptide"
HTGEKYFKCK

SEQ ID NO: 33013 - protein, 10 aa, Artificial Sequence
  source: /note="Description of Artificial Sequence: Synthetic peptide"
KYFKCKECGK

SEQ ID NO: 33014 - protein, 10 aa, Artificial Sequence
  source: /note="Description of Artificial Sequence: Synthetic peptide"
HQRIHTGEKY

SEQ ID NO: 33015 - protein, 10 aa, Artificial Sequence
  source: /note="Description of Artificial Sequence: Synthetic peptide"
QRIHTGEKYF

SEQ ID NO: 33016 - protein, 9 aa, Artificial Sequence
  source: /note="Description of Artificial Sequence: Synthetic peptide"
ICNQCCAKY

SEQ ID NO: 33017 - protein, 9 aa, Artificial Sequence
  source: /note="Description of Artificial Sequence: Synthetic peptide"
GEYICNQCC

SEQ ID NO: 33018 - protein, 10 aa, Artificial Sequence
  source: /note="Description of Artificial Sequence: Synthetic peptide"
YICNQCCAKY

SEQ ID NO: 33019 - protein, 10 aa, Artificial Sequence
  source: /note="Description of Artificial Sequence: Synthetic peptide"
CAKYTSLDSF

SEQ ID NO: 33020 - protein, 10 aa, Artificial Sequence
  source: /note="Description of Artificial Sequence: Synthetic peptide"
NQCCAKYTSL

SEQ ID NO: 33021 - protein, 10 aa, Artificial Sequence
  source: /note="Description of Artificial Sequence: Synthetic peptide"
GEYICNQCCA

SEQ ID NO: 33022 - protein, 10 aa, Artificial Sequence
  source: /note="Description of Artificial Sequence: Synthetic peptide"
LQKHIAECHH

SEQ ID NO: 33023 - protein, 9 aa, Artificial Sequence
  source: /note="Description of Artificial Sequence: Synthetic peptide"
KVFQSSSKL

SEQ ID NO: 33024 - protein, 9 aa, Artificial Sequence
  source: /note="Description of Artificial Sequence: Synthetic peptide"
FQSSSKLAQ

SEQ ID NO: 33025 - protein, 10 aa, Artificial Sequence
  source: /note="Description of Artificial Sequence: Synthetic peptide"
KVFQSSSKLA

SEQ ID NO: 33026 - protein, 10 aa, Artificial Sequence
  source: /note="Description of Artificial Sequence: Synthetic peptide"
FQSSSKLAQH

SEQ ID NO: 33027 - protein, 10 aa, Artificial Sequence
  source: /note="Description of Artificial Sequence: Synthetic peptide"
HECDKVFQSS

SEQ ID NO: 33028 - protein, 10 aa, Artificial Sequence
  source: /note="Description of Artificial Sequence: Synthetic peptide"
RKIHTGEKPH

SEQ ID NO: 33029 - protein, 9 aa, Artificial Sequence
  source: /note="Description of Artificial Sequence: Synthetic peptide"
EEDWLHVGL

SEQ ID NO: 33030 - protein, 10 aa, Artificial Sequence
  source: /note="Description of Artificial Sequence: Synthetic peptide"
DWLHVGLDER

SEQ ID NO: 33031 - protein, 10 aa, Artificial Sequence
  source: /note="Description of Artificial Sequence: Synthetic peptide"
GEEDWLHVGL

SEQ ID NO: 33032 - protein, 9 aa, Artificial Sequence
  source: /note="Description of Artificial Sequence: Synthetic peptide"
RTHKLGNLC

SEQ ID NO: 33033 - protein, 10 aa, Artificial Sequence
  source: /note="Description of Artificial Sequence: Synthetic peptide"
RTHKLGNLCK

SEQ ID NO: 33034 - protein, 10 aa, Artificial Sequence
  source: /note="Description of Artificial Sequence: Synthetic peptide"
NLCKGRGRVR

SEQ ID NO: 33035 - protein, 9 aa, Artificial Sequence
  source: /note="Description of Artificial Sequence: Synthetic peptide"
KTFSHSTAL

SEQ ID NO: 33036 - protein, 9 aa, Artificial Sequence
  source: /note="Description of Artificial Sequence: Synthetic peptide"
THKEYVKTF

SEQ ID NO: 33037 - protein, 9 aa, Artificial Sequence
  source: /note="Description of Artificial Sequence: Synthetic peptide"
KEYVKTFSH

SEQ ID NO: 33038 - protein, 9 aa, Artificial Sequence
  source: /note="Description of Artificial Sequence: Synthetic peptide"
VKTFSHSTA

SEQ ID NO: 33039 - protein, 10 aa, Artificial Sequence
  source: /note="Description of Artificial Sequence: Synthetic peptide"
YVKTFSHSTA

SEQ ID NO: 33040 - protein, 10 aa, Artificial Sequence
  source: /note="Description of Artificial Sequence: Synthetic peptide"
KTFSHSTALF

SEQ ID NO: 33041 - protein, 10 aa, Artificial Sequence
  source: /note="Description of Artificial Sequence: Synthetic peptide"
YTHKEYVKTF

SEQ ID NO: 33042 - protein, 10 aa, Artificial Sequence
  source: /note="Description of Artificial Sequence: Synthetic peptide"
RPYTHKEYVK

SEQ ID NO: 33043 - protein, 10 aa, Artificial Sequence
  source: /note="Description of Artificial Sequence: Synthetic peptide"
VKTFSHSTAL

SEQ ID NO: 33044 - protein, 10 aa, Artificial Sequence
  source: /note="Description of Artificial Sequence: Synthetic peptide"
KEYVKTFSHS

SEQ ID NO: 33045 - protein, 9 aa, Artificial Sequence
  source: /note="Description of Artificial Sequence: Synthetic peptide"
AFFGPVYYV

SEQ ID NO: 33046 - protein, 9 aa, Artificial Sequence
  source: /note="Description of Artificial Sequence: Synthetic peptide"
VLKPFLFTV

SEQ ID NO: 33047 - protein, 9 aa, Artificial Sequence
  source: /note="Description of Artificial Sequence: Synthetic peptide"
KAFFGPVYY

SEQ ID NO: 33048 - protein, 9 aa, Artificial Sequence
  source: /note="Description of Artificial Sequence: Synthetic peptide"
CMKELTLER

SEQ ID NO: 33049 - protein, 9 aa, Artificial Sequence
  source: /note="Description of Artificial Sequence: Synthetic peptide"
FFGPVYYVC

SEQ ID NO: 33050 - protein, 9 aa, Artificial Sequence
  source: /note="Description of Artificial Sequence: Synthetic peptide"
VYYVCMKEL

SEQ ID NO: 33051 - protein, 9 aa, Artificial Sequence
  source: /note="Description of Artificial Sequence: Synthetic peptide"
SSVLKPFLF

SEQ ID NO: 33052 - protein, 9 aa, Artificial Sequence
  source: /note="Description of Artificial Sequence: Synthetic peptide"
CGKAFFGPV

SEQ ID NO: 33053 - protein, 9 aa, Artificial Sequence
  source: /note="Description of Artificial Sequence: Synthetic peptide"
GKAFFGPVY

SEQ ID NO: 33054 - protein, 9 aa, Artificial Sequence
  source: /note="Description of Artificial Sequence: Synthetic peptide"
FTVPIEDMR

SEQ ID NO: 33055 - protein, 9 aa, Artificial Sequence
  source: /note="Description of Artificial Sequence: Synthetic peptide"
KPFLFTVPI

SEQ ID NO: 33056 - protein, 9 aa, Artificial Sequence
  source: /note="Description of Artificial Sequence: Synthetic peptide"
NVSSVLKPF

SEQ ID NO: 33057 - protein, 10 aa, Artificial Sequence
  source: /note="Description of Artificial Sequence: Synthetic peptide"
KAFFGPVYYV

SEQ ID NO: 33058 - protein, 10 aa, Artificial Sequence
  source: /note="Description of Artificial Sequence: Synthetic peptide"
SVLKPFLFTV

SEQ ID NO: 33059 - protein, 10 aa, Artificial Sequence
  source: /note="Description of Artificial Sequence: Synthetic peptide"
FLFTVPIEDM

SEQ ID NO: 33060 - protein, 10 aa, Artificial Sequence
  source: /note="Description of Artificial Sequence: Synthetic peptide"
FFGPVYYVCM

SEQ ID NO: 33061 - protein, 10 aa, Artificial Sequence
  source: /note="Description of Artificial Sequence: Synthetic peptide"
YYVCMKELTL

SEQ ID NO: 33062 - protein, 10 aa, Artificial Sequence
  source: /note="Description of Artificial Sequence: Synthetic peptide"
VSSVLKPFLF

SEQ ID NO: 33063 - protein, 10 aa, Artificial Sequence
  source: /note="Description of Artificial Sequence: Synthetic peptide"
CGKAFFGPVY

SEQ ID NO: 33064 - protein, 10 aa, Artificial Sequence
  source: /note="Description of Artificial Sequence: Synthetic peptide"
GKAFFGPVYY

SEQ ID NO: 33065 - protein, 10 aa, Artificial Sequence
  source: /note="Description of Artificial Sequence: Synthetic peptide"
NVSSVLKPFL

SEQ ID NO: 33066 - protein, 10 aa, Artificial Sequence
  source: /note="Description of Artificial Sequence: Synthetic peptide"
MNVSSVLKPF

SEQ ID NO: 33067 - protein, 10 aa, Artificial Sequence
  source: /note="Description of Artificial Sequence: Synthetic peptide"
KELTLERNRM

SEQ ID NO: 33068 - protein, 10 aa, Artificial Sequence
  source: /note="Description of Artificial Sequence: Synthetic peptide"
LKPFLFTVPI

SEQ ID NO: 33069 - protein, 9 aa, Artificial Sequence
  source: /note="Description of Artificial Sequence: Synthetic peptide"
PSQNNLYRY

SEQ ID NO: 33070 - protein, 9 aa, Artificial Sequence
  source: /note="Description of Artificial Sequence: Synthetic peptide"
LLGPSQNNL

SEQ ID NO: 33071 - protein, 9 aa, Artificial Sequence
  source: /note="Description of Artificial Sequence: Synthetic peptide"
SQNNLYRYV

SEQ ID NO: 33072 - protein, 9 aa, Artificial Sequence
  source: /note="Description of Artificial Sequence: Synthetic peptide"
LGPSQNNLY

SEQ ID NO: 33073 - protein, 9 aa, Artificial Sequence
  source: /note="Description of Artificial Sequence: Synthetic peptide"
QNNLYRYVM

SEQ ID NO: 33074 - protein, 10 aa, Artificial Sequence
  source: /note="Description of Artificial Sequence: Synthetic peptide"
ALLGPSQNNL

SEQ ID NO: 33075 - protein, 10 aa, Artificial Sequence
  source: /note="Description of Artificial Sequence: Synthetic peptide"
LLGPSQNNLY

SEQ ID NO: 33076 - protein, 10 aa, Artificial Sequence
  source: /note="Description of Artificial Sequence: Synthetic peptide"
SQNNLYRYVM

SEQ ID NO: 33077 - protein, 10 aa, Artificial Sequence
  source: /note="Description of Artificial Sequence: Synthetic peptide"
GPSQNNLYRY

SEQ ID NO: 33078 - protein, 9 aa, Artificial Sequence
  source: /note="Description of Artificial Sequence: Synthetic peptide"
FLLHQIIHK

SEQ ID NO: 33079 - protein, 9 aa, Artificial Sequence
  source: /note="Description of Artificial Sequence: Synthetic peptide"
SYFLLHQII

SEQ ID NO: 33080 - protein, 9 aa, Artificial Sequence
  source: /note="Description of Artificial Sequence: Synthetic peptide"
HQIIHKGGK

SEQ ID NO: 33081 - protein, 9 aa, Artificial Sequence
  source: /note="Description of Artificial Sequence: Synthetic peptide"
IIHKGGKPY

SEQ ID NO: 33082 - protein, 9 aa, Artificial Sequence
  source: /note="Description of Artificial Sequence: Synthetic peptide"
ASYFLLHQI

SEQ ID NO: 33083 - protein, 10 aa, Artificial Sequence
  source: /note="Description of Artificial Sequence: Synthetic peptide"
QIIHKGGKPY

SEQ ID NO: 33084 - protein, 10 aa, Artificial Sequence
  source: /note="Description of Artificial Sequence: Synthetic peptide"
TASYFLLHQI

SEQ ID NO: 33085 - protein, 10 aa, Artificial Sequence
  source: /note="Description of Artificial Sequence: Synthetic peptide"
ASYFLLHQII

SEQ ID NO: 33086 - protein, 10 aa, Artificial Sequence
  source: /note="Description of Artificial Sequence: Synthetic peptide"
CHRRCHTSEK

SEQ ID NO: 33087 - protein, 9 aa, Artificial Sequence
  source: /note="Description of Artificial Sequence: Synthetic peptide"
SFLAQHQII

SEQ ID NO: 33088 - protein, 9 aa, Artificial Sequence
  source: /note="Description of Artificial Sequence: Synthetic peptide"
GSFLAQHQI

SEQ ID NO: 33089 - protein, 9 aa, Artificial Sequence
  source: /note="Description of Artificial Sequence: Synthetic peptide"
FLAQHQIIH

SEQ ID NO: 33090 - protein, 10 aa, Artificial Sequence
  source: /note="Description of Artificial Sequence: Synthetic peptide"
FLAQHQIIHT

SEQ ID NO: 33091 - protein, 10 aa, Artificial Sequence
  source: /note="Description of Artificial Sequence: Synthetic peptide"
GSFLAQHQII

SEQ ID NO: 33092 - protein, 9 aa, Artificial Sequence
  source: /note="Description of Artificial Sequence: Synthetic peptide"
HQKTHTGDK

SEQ ID NO: 33093 - protein, 9 aa, Artificial Sequence
  source: /note="Description of Artificial Sequence: Synthetic peptide"
KTHTGDKSY

SEQ ID NO: 33094 - protein, 10 aa, Artificial Sequence
  source: /note="Description of Artificial Sequence: Synthetic peptide"
KTHTGDKSYI

SEQ ID NO: 33095 - protein, 10 aa, Artificial Sequence
  source: /note="Description of Artificial Sequence: Synthetic peptide"
QKTHTGDKSY

SEQ ID NO: 33096 - protein, 9 aa, Artificial Sequence
  source: /note="Description of Artificial Sequence: Synthetic peptide"
VCAKCGKAF

SEQ ID NO: 33097 - protein, 10 aa, Artificial Sequence
  source: /note="Description of Artificial Sequence: Synthetic peptide"
KPYVCAKCGK

SEQ ID NO: 33098 - protein, 10 aa, Artificial Sequence
  source: /note="Description of Artificial Sequence: Synthetic peptide"
YVCAKCGKAF

SEQ ID NO: 33099 - protein, 10 aa, Artificial Sequence
  source: /note="Description of Artificial Sequence: Synthetic peptide"
GEKPYVCAKC

SEQ ID NO: 33100 - protein, 9 aa, Artificial Sequence
  source: /note="Description of Artificial Sequence: Synthetic peptide"
LLTKAVHLA

SEQ ID NO: 33101 - protein, 9 aa, Artificial Sequence
  source: /note="Description of Artificial Sequence: Synthetic peptide"
NLLTKAVHL

SEQ ID NO: 33102 - protein, 9 aa, Artificial Sequence
  source: /note="Description of Artificial Sequence: Synthetic peptide"
TKAVHLANL

SEQ ID NO: 33103 - protein, 10 aa, Artificial Sequence
  source: /note="Description of Artificial Sequence: Synthetic peptide"
NLLTKAVHLA

SEQ ID NO: 33104 - protein, 10 aa, Artificial Sequence
  source: /note="Description of Artificial Sequence: Synthetic peptide"
TLAPANLLTK

SEQ ID NO: 33105 - protein, 10 aa, Artificial Sequence
  source: /note="Description of Artificial Sequence: Synthetic peptide"
LTKAVHLANL

SEQ ID NO: 33106 - protein, 10 aa, Artificial Sequence
  source: /note="Description of Artificial Sequence: Synthetic peptide"
APANLLTKAV

SEQ ID NO: 33107 - protein, 10 aa, Artificial Sequence
  source: /note="Description of Artificial Sequence: Synthetic peptide"
SSKGSPQMPK

SEQ ID NO: 33108 - protein, 10 aa, Artificial Sequence
  source: /note="Description of Artificial Sequence: Synthetic peptide"
QMPKSPKSPR

SEQ ID NO: 33109 - protein, 10 aa, Artificial Sequence
  source: /note="Description of Artificial Sequence: Synthetic peptide"
KESSKGSPQM

SEQ ID NO: 33110 - protein, 9 aa, Artificial Sequence
  source: /note="Description of Artificial Sequence: Synthetic peptide"
HLVPHQIIH

SEQ ID NO: 33111 - protein, 10 aa, Artificial Sequence
  source: /note="Description of Artificial Sequence: Synthetic peptide"
IIHTGEKPLK

SEQ ID NO: 33112 - protein, 10 aa, Artificial Sequence
  source: /note="Description of Artificial Sequence: Synthetic peptide"
SSHLVPHQII

SEQ ID NO: 33113 - protein, 10 aa, Artificial Sequence
  source: /note="Description of Artificial Sequence: Synthetic peptide"
AEAAAAPERG

SEQ ID NO: 33114 - protein, 9 aa, Artificial Sequence
  source: /note="Description of Artificial Sequence: Synthetic peptide"
QIVLLRISK

SEQ ID NO: 33115 - protein, 9 aa, Artificial Sequence
  source: /note="Description of Artificial Sequence: Synthetic peptide"
KNRGGPMGK

SEQ ID NO: 33116 - protein, 9 aa, Artificial Sequence
  source: /note="Description of Artificial Sequence: Synthetic peptide"
LLRISKPAL

SEQ ID NO: 33117 - protein, 9 aa, Artificial Sequence
  source: /note="Description of Artificial Sequence: Synthetic peptide"
KPALPPPTK

SEQ ID NO: 33118 - protein, 9 aa, Artificial Sequence
  source: /note="Description of Artificial Sequence: Synthetic peptide"
GPMGKGGGA

SEQ ID NO: 33119 - protein, 9 aa, Artificial Sequence
  source: /note="Description of Artificial Sequence: Synthetic peptide"
PPTKGKTSL

SEQ ID NO: 33120 - protein, 9 aa, Artificial Sequence
  source: /note="Description of Artificial Sequence: Synthetic peptide"
GKGGGAASM

SEQ ID NO: 33121 - protein, 9 aa, Artificial Sequence
  source: /note="Description of Artificial Sequence: Synthetic peptide"
TKGKTSLQW

SEQ ID NO: 33122 - protein, 9 aa, Artificial Sequence
  source: /note="Description of Artificial Sequence: Synthetic peptide"
GKTSLQWSW

SEQ ID NO: 33123 - protein, 9 aa, Artificial Sequence
  source: /note="Description of Artificial Sequence: Synthetic peptide"
DEGHPQIVL

SEQ ID NO: 33124 - protein, 9 aa, Artificial Sequence
  source: /note="Description of Artificial Sequence: Synthetic peptide"
MPADEGHPQ

SEQ ID NO: 33125 - protein, 9 aa, Artificial Sequence
  source: /note="Description of Artificial Sequence: Synthetic peptide"
HPQIVLLRI

SEQ ID NO: 33126 - protein, 10 aa, Artificial Sequence
  source: /note="Description of Artificial Sequence: Synthetic peptide"
VLLRISKPAL

SEQ ID NO: 33127 - protein, 10 aa, Artificial Sequence
  source: /note="Description of Artificial Sequence: Synthetic peptide"
ISKPALPPPT

SEQ ID NO: 33128 - protein, 10 aa, Artificial Sequence
  source: /note="Description of Artificial Sequence: Synthetic peptide"
EGHPQIVLLR

SEQ ID NO: 33129 - protein, 10 aa, Artificial Sequence
  source: /note="Description of Artificial Sequence: Synthetic peptide"
MPADEGHPQI

SEQ ID NO: 33130 - protein, 10 aa, Artificial Sequence
  source: /note="Description of Artificial Sequence: Synthetic peptide"
GPMGKGGGAA

SEQ ID NO: 33131 - protein, 10 aa, Artificial Sequence
  source: /note="Description of Artificial Sequence: Synthetic peptide"
MGKGGGAASM

SEQ ID NO: 33132 - protein, 10 aa, Artificial Sequence
  source: /note="Description of Artificial Sequence: Synthetic peptide"
LQNKNRGGPM

SEQ ID NO: 33133 - protein, 10 aa, Artificial Sequence
  source: /note="Description of Artificial Sequence: Synthetic peptide"
KGKTSLQWSW

SEQ ID NO: 33134 - protein, 10 aa, Artificial Sequence
  source: /note="Description of Artificial Sequence: Synthetic peptide"
DEGHPQIVLL

SEQ ID NO: 33135 - protein, 10 aa, Artificial Sequence
  source: /note="Description of Artificial Sequence: Synthetic peptide"
RKSTIETHKI

SEQ ID NO: 33136 - protein, 9 aa, Artificial Sequence
  source: /note="Description of Artificial Sequence: Synthetic peptide"
STCLHAHKK

SEQ ID NO: 33137 - protein, 10 aa, Artificial Sequence
  source: /note="Description of Artificial Sequence: Synthetic peptide"
SSTCLHAHKK

SEQ ID NO: 33138 - protein, 10 aa, Artificial Sequence
  source: /note="Description of Artificial Sequence: Synthetic peptide"
AHKKTHTGEK

SEQ ID NO: 33139 - protein, 10 aa, Artificial Sequence
  source: /note="Description of Artificial Sequence: Synthetic peptide"
CSSNLTTHKR

SEQ ID NO: 33140 - protein, 9 aa, Artificial Sequence
  source: /note="Description of Artificial Sequence: Synthetic peptide"
KFSHANAQK

SEQ ID NO: 33141 - protein, 9 aa, Artificial Sequence
  source: /note="Description of Artificial Sequence: Synthetic peptide"
HANAQKMKR

SEQ ID NO: 33142 - protein, 9 aa, Artificial Sequence
  source: /note="Description of Artificial Sequence: Synthetic peptide"
FSHANAQKM

SEQ ID NO: 33143 - protein, 10 aa, Artificial Sequence
  source: /note="Description of Artificial Sequence: Synthetic peptide"
WLPKFSHANA

SEQ ID NO: 33144 - protein, 10 aa, Artificial Sequence
  source: /note="Description of Artificial Sequence: Synthetic peptide"
FSHANAQKMK

SEQ ID NO: 33145 - protein, 10 aa, Artificial Sequence
  source: /note="Description of Artificial Sequence: Synthetic peptide"
KFSHANAQKM

SEQ ID NO: 33146 - protein, 9 aa, Artificial Sequence
  source: /note="Description of Artificial Sequence: Synthetic peptide"
RLNVLNWLA

SEQ ID NO: 33147 - protein, 9 aa, Artificial Sequence
  source: /note="Description of Artificial Sequence: Synthetic peptide"
WLANNMDDL

SEQ ID NO: 33148 - protein, 9 aa, Artificial Sequence
  source: /note="Description of Artificial Sequence: Synthetic peptide"
VLNWLANNM

SEQ ID NO: 33149 - protein, 9 aa, Artificial Sequence
  source: /note="Description of Artificial Sequence: Synthetic peptide"
KSRLNVLNW

SEQ ID NO: 33150 - protein, 9 aa, Artificial Sequence
  source: /note="Description of Artificial Sequence: Synthetic peptide"
SRLNVLNWL

SEQ ID NO: 33151 - protein, 10 aa, Artificial Sequence
  source: /note="Description of Artificial Sequence: Synthetic peptide"
WLANNMDDLK

SEQ ID NO: 33152 - protein, 10 aa, Artificial Sequence
  source: /note="Description of Artificial Sequence: Synthetic peptide"
KSRLNVLNWL

SEQ ID NO: 33153 - protein, 10 aa, Artificial Sequence
  source: /note="Description of Artificial Sequence: Synthetic peptide"
NVLNWLANNM

SEQ ID NO: 33154 - protein, 10 aa, Artificial Sequence
  source: /note="Description of Artificial Sequence: Synthetic peptide"
TKSRLNVLNW

SEQ ID NO: 33155 - protein, 9 aa, Artificial Sequence
  source: /note="Description of Artificial Sequence: Synthetic peptide"
SLEKVCPHI

SEQ ID NO: 33156 - protein, 9 aa, Artificial Sequence
  source: /note="Description of Artificial Sequence: Synthetic peptide"
LEKVCPHIA

SEQ ID NO: 33157 - protein, 9 aa, Artificial Sequence
  source: /note="Description of Artificial Sequence: Synthetic peptide"
SQLTEHKII

SEQ ID NO: 33158 - protein, 10 aa, Artificial Sequence
  source: /note="Description of Artificial Sequence: Synthetic peptide"
IIHTGKKPHV

SEQ ID NO: 33159 - protein, 10 aa, Artificial Sequence
  source: /note="Description of Artificial Sequence: Synthetic peptide"
KKSQLTEHKI

SEQ ID NO: 33160 - protein, 10 aa, Artificial Sequence
  source: /note="Description of Artificial Sequence: Synthetic peptide"
SQLTEHKIIH

SEQ ID NO: 33161 - protein, 9 aa, Artificial Sequence
  source: /note="Description of Artificial Sequence: Synthetic peptide"
IVHGYAENK

SEQ ID NO: 33162 - protein, 9 aa, Artificial Sequence
  source: /note="Description of Artificial Sequence: Synthetic peptide"
AENKFSCEI

SEQ ID NO: 33163 - protein, 10 aa, Artificial Sequence
  source: /note="Description of Artificial Sequence: Synthetic peptide"
KIVHGYAENK

SEQ ID NO: 33164 - protein, 10 aa, Artificial Sequence
  source: /note="Description of Artificial Sequence: Synthetic peptide"
IVHGYAENKF

SEQ ID NO: 33165 - protein, 10 aa, Artificial Sequence
  source: /note="Description of Artificial Sequence: Synthetic peptide"
AENKFSCEIC

SEQ ID NO: 33166 - protein, 9 aa, Artificial Sequence
  source: /note="Description of Artificial Sequence: Synthetic peptide"
SHLSVHQII

SEQ ID NO: 33167 - protein, 9 aa, Artificial Sequence
  source: /note="Description of Artificial Sequence: Synthetic peptide"
KSHLSVHQI

SEQ ID NO: 33168 - protein, 10 aa, Artificial Sequence
  source: /note="Description of Artificial Sequence: Synthetic peptide"
KSHLSVHQII

SEQ ID NO: 33169 - protein, 10 aa, Artificial Sequence
  source: /note="Description of Artificial Sequence: Synthetic peptide"
GKSHLSVHQI

SEQ ID NO: 33170 - protein, 9 aa, Artificial Sequence
  source: /note="Description of Artificial Sequence: Synthetic peptide"
KLTKHKIIY

SEQ ID NO: 33171 - protein, 9 aa, Artificial Sequence
  source: /note="Description of Artificial Sequence: Synthetic peptide"
IIYTCEKLY

SEQ ID NO: 33172 - protein, 9 aa, Artificial Sequence
  source: /note="Description of Artificial Sequence: Synthetic peptide"
SSKLTKHKI

SEQ ID NO: 33173 - protein, 10 aa, Artificial Sequence
  source: /note="Description of Artificial Sequence: Synthetic peptide"
IIYTCEKLYK

SEQ ID NO: 33174 - protein, 10 aa, Artificial Sequence
  source: /note="Description of Artificial Sequence: Synthetic peptide"
SSKLTKHKII

SEQ ID NO: 33175 - protein, 10 aa, Artificial Sequence
  source: /note="Description of Artificial Sequence: Synthetic peptide"
KHKIIYTCEK

SEQ ID NO: 33176 - protein, 10 aa, Artificial Sequence
  source: /note="Description of Artificial Sequence: Synthetic peptide"
KIIYTCEKLY

SEQ ID NO: 33177 - protein, 10 aa, Artificial Sequence
  source: /note="Description of Artificial Sequence: Synthetic peptide"
SKLTKHKIIY

SEQ ID NO: 33178 - protein, 10 aa, Artificial Sequence
  source: /note="Description of Artificial Sequence: Synthetic peptide"
HKIIYTCEKL

SEQ ID NO: 33179 - protein, 9 aa, Artificial Sequence
  source: /note="Description of Artificial Sequence: Synthetic peptide"
HEMVEEPTV

SEQ ID NO: 33180 - protein, 9 aa, Artificial Sequence
  source: /note="Description of Artificial Sequence: Synthetic peptide"
EPTVICSHF

SEQ ID NO: 33181 - protein, 10 aa, Artificial Sequence
  source: /note="Description of Artificial Sequence: Synthetic peptide"
HEMVEEPTVI

SEQ ID NO: 33182 - protein, 10 aa, Artificial Sequence
  source: /note="Description of Artificial Sequence: Synthetic peptide"
EEPTVICSHF

SEQ ID NO: 33183 - protein, 9 aa, Artificial Sequence
  source: /note="Description of Artificial Sequence: Synthetic peptide"
SSLVEHQII

SEQ ID NO: 33184 - protein, 9 aa, Artificial Sequence
  source: /note="Description of Artificial Sequence: Synthetic peptide"
VEHQIIHTG

SEQ ID NO: 33185 - protein, 10 aa, Artificial Sequence
  source: /note="Description of Artificial Sequence: Synthetic peptide"
SLVEHQIIHT

SEQ ID NO: 33186 - protein, 9 aa, Artificial Sequence
  source: /note="Description of Artificial Sequence: Synthetic peptide"
HTKDQQHNK

SEQ ID NO: 33187 - protein, 9 aa, Artificial Sequence
  source: /note="Description of Artificial Sequence: Synthetic peptide"
CNKNLTHTK

SEQ ID NO: 33188 - protein, 9 aa, Artificial Sequence
  source: /note="Description of Artificial Sequence: Synthetic peptide"
FNWSSHLTR

SEQ ID NO: 33189 - protein, 10 aa, Artificial Sequence
  source: /note="Description of Artificial Sequence: Synthetic peptide"
WSSHLTRHKK

SEQ ID NO: 33190 - protein, 10 aa, Artificial Sequence
  source: /note="Description of Artificial Sequence: Synthetic peptide"
AFNWSSHLTR

SEQ ID NO: 33191 - protein, 10 aa, Artificial Sequence
  source: /note="Description of Artificial Sequence: Synthetic peptide"
FNWSSHLTRH

SEQ ID NO: 33192 - protein, 9 aa, Artificial Sequence
  source: /note="Description of Artificial Sequence: Synthetic peptide"
LLPQRVSVC

SEQ ID NO: 33193 - protein, 10 aa, Artificial Sequence
  source: /note="Description of Artificial Sequence: Synthetic peptide"
CKCPSCPLLF

SEQ ID NO: 33194 - protein, 9 aa, Artificial Sequence
  source: /note="Description of Artificial Sequence: Synthetic peptide"
LLDLAQINL

SEQ ID NO: 33195 - protein, 9 aa, Artificial Sequence
  source: /note="Description of Artificial Sequence: Synthetic peptide"
DLAQINLYR

SEQ ID NO: 33196 - protein, 9 aa, Artificial Sequence
  source: /note="Description of Artificial Sequence: Synthetic peptide"
LDLAQINLY

SEQ ID NO: 33197 - protein, 9 aa, Artificial Sequence
  source: /note="Description of Artificial Sequence: Synthetic peptide"
AQINLYRDV

SEQ ID NO: 33198 - protein, 9 aa, Artificial Sequence
  source: /note="Description of Artificial Sequence: Synthetic peptide"
QINLYRDVM

SEQ ID NO: 33199 - protein, 9 aa, Artificial Sequence
  source: /note="Description of Artificial Sequence: Synthetic peptide"
WALLDLAQI

SEQ ID NO: 33200 - protein, 10 aa, Artificial Sequence
  source: /note="Description of Artificial Sequence: Synthetic peptide"
LLDLAQINLY

SEQ ID NO: 33201 - protein, 10 aa, Artificial Sequence
  source: /note="Description of Artificial Sequence: Synthetic peptide"
ALLDLAQINL

SEQ ID NO: 33202 - protein, 10 aa, Artificial Sequence
  source: /note="Description of Artificial Sequence: Synthetic peptide"
AQINLYRDVM

SEQ ID NO: 33203 - protein, 9 aa, Artificial Sequence
  source: /note="Description of Artificial Sequence: Synthetic peptide"
SSSLIHHQI

SEQ ID NO: 33204 - protein, 9 aa, Artificial Sequence
  source: /note="Description of Artificial Sequence: Synthetic peptide"
SSLIHHQII

SEQ ID NO: 33205 - protein, 10 aa, Artificial Sequence
  source: /note="Description of Artificial Sequence: Synthetic peptide"
SLIHHQIIHT

SEQ ID NO: 33206 - protein, 10 aa, Artificial Sequence
  source: /note="Description of Artificial Sequence: Synthetic peptide"
QSSSLIHHQI

SEQ ID NO: 33207 - protein, 9 aa, Artificial Sequence
  source: /note="Description of Artificial Sequence: Synthetic peptide"
SLRKHEIIH

SEQ ID NO: 33208 - protein, 10 aa, Artificial Sequence
  source: /note="Description of Artificial Sequence: Synthetic peptide"
RSSSLRKHEI

SEQ ID NO: 33209 - protein, 10 aa, Artificial Sequence
  source: /note="Description of Artificial Sequence: Synthetic peptide"
EIIHTGERPY

SEQ ID NO: 33210 - protein, 9 aa, Artificial Sequence
  source: /note="Description of Artificial Sequence: Synthetic peptide"
KAFRCASNL

SEQ ID NO: 33211 - protein, 9 aa, Artificial Sequence
  source: /note="Description of Artificial Sequence: Synthetic peptide"
FRCASNLQM

SEQ ID NO: 33212 - protein, 10 aa, Artificial Sequence
  source: /note="Description of Artificial Sequence: Synthetic peptide"
CASNLQMHER

SEQ ID NO: 33213 - protein, 10 aa, Artificial Sequence
  source: /note="Description of Artificial Sequence: Synthetic peptide"
AFRCASNLQM

SEQ ID NO: 33214 - protein, 10 aa, Artificial Sequence
  source: /note="Description of Artificial Sequence: Synthetic peptide"
GKAFRCASNL

SEQ ID NO: 33215 - protein, 9 aa, Artificial Sequence
  source: /note="Description of Artificial Sequence: Synthetic peptide"
ASHLQMHER

SEQ ID NO: 33216 - protein, 9 aa, Artificial Sequence
  source: /note="Description of Artificial Sequence: Synthetic peptide"
AFRSASHLQ

SEQ ID NO: 33217 - protein, 9 aa, Artificial Sequence
  source: /note="Description of Artificial Sequence: Synthetic peptide"
RSASHLQMH

SEQ ID NO: 33218 - protein, 9 aa, Artificial Sequence
  source: /note="Description of Artificial Sequence: Synthetic peptide"
FRSASHLQM

SEQ ID NO: 33219 - protein, 10 aa, Artificial Sequence
  source: /note="Description of Artificial Sequence: Synthetic peptide"
SASHLQMHER

SEQ ID NO: 33220 - protein, 10 aa, Artificial Sequence
  source: /note="Description of Artificial Sequence: Synthetic peptide"
AFRSASHLQM

SEQ ID NO: 33221 - protein, 9 aa, Artificial Sequence
  source: /note="Description of Artificial Sequence: Synthetic peptide"
ASNLRMHER

SEQ ID NO: 33222 - protein, 9 aa, Artificial Sequence
  source: /note="Description of Artificial Sequence: Synthetic peptide"
AFRSASNLR

SEQ ID NO: 33223 - protein, 9 aa, Artificial Sequence
  source: /note="Description of Artificial Sequence: Synthetic peptide"
FRSASNLRM

SEQ ID NO: 33224 - protein, 10 aa, Artificial Sequence
  source: /note="Description of Artificial Sequence: Synthetic peptide"
KAFRSASNLR

SEQ ID NO: 33225 - protein, 10 aa, Artificial Sequence
  source: /note="Description of Artificial Sequence: Synthetic peptide"
SASNLRMHER

SEQ ID NO: 33226 - protein, 10 aa, Artificial Sequence
  source: /note="Description of Artificial Sequence: Synthetic peptide"
AFRSASNLRM

SEQ ID NO: 33227 - protein, 9 aa, Artificial Sequence
  source: /note="Description of Artificial Sequence: Synthetic peptide"
AFSLSSNLR

SEQ ID NO: 33228 - protein, 10 aa, Artificial Sequence
  source: /note="Description of Artificial Sequence: Synthetic peptide"
KAFSLSSNLR

SEQ ID NO: 33229 - protein, 9 aa, Artificial Sequence
  source: /note="Description of Artificial Sequence: Synthetic peptide"
QQKNQSQQK

SEQ ID NO: 33230 - protein, 10 aa, Artificial Sequence
  source: /note="Description of Artificial Sequence: Synthetic peptide"
KNQSQQKNAK

SEQ ID NO: 33231 - protein, 9 aa, Artificial Sequence
  source: /note="Description of Artificial Sequence: Synthetic peptide"
RMHEIIHTG

SEQ ID NO: 33232 - protein, 9 aa, Artificial Sequence
  source: /note="Description of Artificial Sequence: Synthetic peptide"
SFRMHEIIH

SEQ ID NO: 33233 - protein, 9 aa, Artificial Sequence
  source: /note="Description of Artificial Sequence: Synthetic peptide"
SSFRMHEII

SEQ ID NO: 33234 - protein, 10 aa, Artificial Sequence
  source: /note="Description of Artificial Sequence: Synthetic peptide"
SFRMHEIIHT

SEQ ID NO: 33235 - protein, 10 aa, Artificial Sequence
  source: /note="Description of Artificial Sequence: Synthetic peptide"
CSSSFRMHEI

SEQ ID NO: 33236 - protein, 10 aa, Artificial Sequence
  source: /note="Description of Artificial Sequence: Synthetic peptide"
SSFRMHEIIH

SEQ ID NO: 33237 - protein, 9 aa, Artificial Sequence
  source: /note="Description of Artificial Sequence: Synthetic peptide"
YLCGECGKA

SEQ ID NO: 33238 - protein, 9 aa, Artificial Sequence
  source: /note="Description of Artificial Sequence: Synthetic peptide"
LCGECGKAF

SEQ ID NO: 33239 - protein, 10 aa, Artificial Sequence
  source: /note="Description of Artificial Sequence: Synthetic peptide"
YLCGECGKAF

SEQ ID NO: 33240 - protein, 10 aa, Artificial Sequence
  source: /note="Description of Artificial Sequence: Synthetic peptide"
GEKPYLCGEC

SEQ ID NO: 33241 - protein, 9 aa, Artificial Sequence
  source: /note="Description of Artificial Sequence: Synthetic peptide"
RQQNELKNI

SEQ ID NO: 33242 - protein, 9 aa, Artificial Sequence
  source: /note="Description of Artificial Sequence: Synthetic peptide"
LTKHKRILT

SEQ ID NO: 33243 - protein, 9 aa, Artificial Sequence
  source: /note="Description of Artificial Sequence: Synthetic peptide"
SLTKHKRIL

SEQ ID NO: 33244 - protein, 10 aa, Artificial Sequence
  source: /note="Description of Artificial Sequence: Synthetic peptide"
KHKRILTGEK

SEQ ID NO: 33245 - protein, 10 aa, Artificial Sequence
  source: /note="Description of Artificial Sequence: Synthetic peptide"
YECIECEKTF

SEQ ID NO: 33246 - protein, 9 aa, Artificial Sequence
  source: /note="Description of Artificial Sequence: Synthetic peptide"
RSNECRKTF

SEQ ID NO: 33247 - protein, 10 aa, Artificial Sequence
  source: /note="Description of Artificial Sequence: Synthetic peptide"
KPFRSNECRK

SEQ ID NO: 33248 - protein, 10 aa, Artificial Sequence
  source: /note="Description of Artificial Sequence: Synthetic peptide"
RSNECRKTFS

SEQ ID NO: 33249 - protein, 10 aa, Artificial Sequence
  source: /note="Description of Artificial Sequence: Synthetic peptide"
FRSNECRKTF

SEQ ID NO: 33250 - protein, 10 aa, Artificial Sequence
  source: /note="Description of Artificial Sequence: Synthetic peptide"
KPYACNCCEK

SEQ ID NO: 33251 - protein, 10 aa, Artificial Sequence
  source: /note="Description of Artificial Sequence: Synthetic peptide"
YACNCCEKLF

SEQ ID NO: 33252 - protein, 9 aa, Artificial Sequence
  source: /note="Description of Artificial Sequence: Synthetic peptide"
RVFPHQVGL

SEQ ID NO: 33253 - protein, 9 aa, Artificial Sequence
  source: /note="Description of Artificial Sequence: Synthetic peptide"
GLPHSWLPL

SEQ ID NO: 33254 - protein, 9 aa, Artificial Sequence
  source: /note="Description of Artificial Sequence: Synthetic peptide"
RLTFPSTRV

SEQ ID NO: 33255 - protein, 9 aa, Artificial Sequence
  source: /note="Description of Artificial Sequence: Synthetic peptide"
SVANGLCLR

SEQ ID NO: 33256 - protein, 9 aa, Artificial Sequence
  source: /note="Description of Artificial Sequence: Synthetic peptide"
SAFCICSSR

SEQ ID NO: 33257 - protein, 9 aa, Artificial Sequence
  source: /note="Description of Artificial Sequence: Synthetic peptide"
HSWLPLESR

SEQ ID NO: 33258 - protein, 9 aa, Artificial Sequence
  source: /note="Description of Artificial Sequence: Synthetic peptide"
SWLPLESRL

SEQ ID NO: 33259 - protein, 9 aa, Artificial Sequence
  source: /note="Description of Artificial Sequence: Synthetic peptide"
GSRPRCPAC

SEQ ID NO: 33260 - protein, 9 aa, Artificial Sequence
  source: /note="Description of Artificial Sequence: Synthetic peptide"
SGRRSSAFC

SEQ ID NO: 33261 - protein, 9 aa, Artificial Sequence
  source: /note="Description of Artificial Sequence: Synthetic peptide"
GARQRRGAR

SEQ ID NO: 33262 - protein, 9 aa, Artificial Sequence
  source: /note="Description of Artificial Sequence: Synthetic peptide"
AFCICSSRR

SEQ ID NO: 33263 - protein, 9 aa, Artificial Sequence
  source: /note="Description of Artificial Sequence: Synthetic peptide"
QTQGARQRR

SEQ ID NO: 33264 - protein, 9 aa, Artificial Sequence
  source: /note="Description of Artificial Sequence: Synthetic peptide"
FTQPHCQGR

SEQ ID NO: 33265 - protein, 9 aa, Artificial Sequence
  source: /note="Description of Artificial Sequence: Synthetic peptide"
RPRCPACSG

SEQ ID NO: 33266 - protein, 9 aa, Artificial Sequence
  source: /note="Description of Artificial Sequence: Synthetic peptide"
QPHCQGRVF

SEQ ID NO: 33267 - protein, 9 aa, Artificial Sequence
  source: /note="Description of Artificial Sequence: Synthetic peptide"
FPHQVGLPH

SEQ ID NO: 33268 - protein, 9 aa, Artificial Sequence
  source: /note="Description of Artificial Sequence: Synthetic peptide"
LPLESRLTF

SEQ ID NO: 33269 - protein, 9 aa, Artificial Sequence
  source: /note="Description of Artificial Sequence: Synthetic peptide"
CSGRRSSAF

SEQ ID NO: 33270 - protein, 9 aa, Artificial Sequence
  source: /note="Description of Artificial Sequence: Synthetic peptide"
KSVANGLCL

SEQ ID NO: 33271 - protein, 9 aa, Artificial Sequence
  source: /note="Description of Artificial Sequence: Synthetic peptide"
LRLEASAQL

SEQ ID NO: 33272 - protein, 9 aa, Artificial Sequence
  source: /note="Description of Artificial Sequence: Synthetic peptide"
HQGKPGAAS

SEQ ID NO: 33273 - protein, 9 aa, Artificial Sequence
  source: /note="Description of Artificial Sequence: Synthetic peptide"
RRGARDTGF

SEQ ID NO: 33274 - protein, 9 aa, Artificial Sequence
  source: /note="Description of Artificial Sequence: Synthetic peptide"
HQVGLPHSW

SEQ ID NO: 33275 - protein, 9 aa, Artificial Sequence
  source: /note="Description of Artificial Sequence: Synthetic peptide"
TEASPPQGI

SEQ ID NO: 33276 - protein, 9 aa, Artificial Sequence
  source: /note="Description of Artificial Sequence: Synthetic peptide"
LESRLTFPS

SEQ ID NO: 33277 - protein, 10 aa, Artificial Sequence
  source: /note="Description of Artificial Sequence: Synthetic peptide"
SVANGLCLRL

SEQ ID NO: 33278 - protein, 10 aa, Artificial Sequence
  source: /note="Description of Artificial Sequence: Synthetic peptide"
GLCLRLEASA

SEQ ID NO: 33279 - protein, 10 aa, Artificial Sequence
  source: /note="Description of Artificial Sequence: Synthetic peptide"
CLRLEASAQL

SEQ ID NO: 33280 - protein, 10 aa, Artificial Sequence
  source: /note="Description of Artificial Sequence: Synthetic peptide"
FTQPHCQGRV

SEQ ID NO: 33281 - protein, 10 aa, Artificial Sequence
  source: /note="Description of Artificial Sequence: Synthetic peptide"
KSVANGLCLR

SEQ ID NO: 33282 - protein, 10 aa, Artificial Sequence
  source: /note="Description of Artificial Sequence: Synthetic peptide"
SSAFCICSSR

SEQ ID NO: 33283 - protein, 10 aa, Artificial Sequence
  source: /note="Description of Artificial Sequence: Synthetic peptide"
SAFCICSSRR

SEQ ID NO: 33284 - protein, 10 aa, Artificial Sequence
  source: /note="Description of Artificial Sequence: Synthetic peptide"
WLPLESRLTF

SEQ ID NO: 33285 - protein, 10 aa, Artificial Sequence
  source: /note="Description of Artificial Sequence: Synthetic peptide"
SSGSRPRCPA

SEQ ID NO: 33286 - protein, 10 aa, Artificial Sequence
  source: /note="Description of Artificial Sequence: Synthetic peptide"
GSRPRCPACS

SEQ ID NO: 33287 - protein, 10 aa, Artificial Sequence
  source: /note="Description of Artificial Sequence: Synthetic peptide"
RPRCPACSGR

SEQ ID NO: 33288 - protein, 10 aa, Artificial Sequence
  source: /note="Description of Artificial Sequence: Synthetic peptide"
SGRRSSAFCI

SEQ ID NO: 33289 - protein, 10 aa, Artificial Sequence
  source: /note="Description of Artificial Sequence: Synthetic peptide"
SSRRAQTQGA

SEQ ID NO: 33290 - protein, 10 aa, Artificial Sequence
  source: /note="Description of Artificial Sequence: Synthetic peptide"
RAQTQGARQR

SEQ ID NO: 33291 - protein, 10 aa, Artificial Sequence
  source: /note="Description of Artificial Sequence: Synthetic peptide"
RVFPHQVGLP

SEQ ID NO: 33292 - protein, 10 aa, Artificial Sequence
  source: /note="Description of Artificial Sequence: Synthetic peptide"
EASAQLCQGR

SEQ ID NO: 33293 - protein, 10 aa, Artificial Sequence
  source: /note="Description of Artificial Sequence: Synthetic peptide"
TLQEPSSGSR

SEQ ID NO: 33294 - protein, 10 aa, Artificial Sequence
  source: /note="Description of Artificial Sequence: Synthetic peptide"
ESRLTFPSTR

SEQ ID NO: 33295 - protein, 10 aa, Artificial Sequence
  source: /note="Description of Artificial Sequence: Synthetic peptide"
EASPPQGITL

SEQ ID NO: 33296 - protein, 10 aa, Artificial Sequence
  source: /note="Description of Artificial Sequence: Synthetic peptide"
SKSVANGLCL

SEQ ID NO: 33297 - protein, 10 aa, Artificial Sequence
  source: /note="Description of Artificial Sequence: Synthetic peptide"
HQGKPGAASP

SEQ ID NO: 33298 - protein, 10 aa, Artificial Sequence
  source: /note="Description of Artificial Sequence: Synthetic peptide"
ACSGRRSSAF

SEQ ID NO: 33299 - protein, 10 aa, Artificial Sequence
  source: /note="Description of Artificial Sequence: Synthetic peptide"
RQRRGARDTG

SEQ ID NO: 33300 - protein, 10 aa, Artificial Sequence
  source: /note="Description of Artificial Sequence: Synthetic peptide"
QRRGARDTGF

SEQ ID NO: 33301 - protein, 10 aa, Artificial Sequence
  source: /note="Description of Artificial Sequence: Synthetic peptide"
TQPHCQGRVF

SEQ ID NO: 33302 - protein, 10 aa, Artificial Sequence
  source: /note="Description of Artificial Sequence: Synthetic peptide"
GRVFPHQVGL

SEQ ID NO: 33303 - protein, 10 aa, Artificial Sequence
  source: /note="Description of Artificial Sequence: Synthetic peptide"
HQVGLPHSWL

SEQ ID NO: 33304 - protein, 10 aa, Artificial Sequence
  source: /note="Description of Artificial Sequence: Synthetic peptide"
VGLPHSWLPL

SEQ ID NO: 33305 - protein, 10 aa, Artificial Sequence
  source: /note="Description of Artificial Sequence: Synthetic peptide"
HSWLPLESRL

SEQ ID NO: 33306 - protein, 10 aa, Artificial Sequence
  source: /note="Description of Artificial Sequence: Synthetic peptide"
LESRLTFPST

SEQ ID NO: 33307 - protein, 9 aa, Artificial Sequence
  source: /note="Description of Artificial Sequence: Synthetic peptide"
KVFNLKRYV

SEQ ID NO: 33308 - protein, 9 aa, Artificial Sequence
  source: /note="Description of Artificial Sequence: Synthetic peptide"
FNLKRYVAR

SEQ ID NO: 33309 - protein, 9 aa, Artificial Sequence
  source: /note="Description of Artificial Sequence: Synthetic peptide"
GKVFNLKRY

SEQ ID NO: 33310 - protein, 10 aa, Artificial Sequence
  source: /note="Description of Artificial Sequence: Synthetic peptide"
KVFNLKRYVA

SEQ ID NO: 33311 - protein, 10 aa, Artificial Sequence
  source: /note="Description of Artificial Sequence: Synthetic peptide"
CGKVFNLKRY

SEQ ID NO: 33312 - protein, 10 aa, Artificial Sequence
  source: /note="Description of Artificial Sequence: Synthetic peptide"
DICGKVFNLK

SEQ ID NO: 33313 - protein, 10 aa, Artificial Sequence
  source: /note="Description of Artificial Sequence: Synthetic peptide"
VFNLKRYVAR

SEQ ID NO: 33314 - protein, 10 aa, Artificial Sequence
  source: /note="Description of Artificial Sequence: Synthetic peptide"
NLKRYVARHR

SEQ ID NO: 33315 - protein, 9 aa, Artificial Sequence
  source: /note="Description of Artificial Sequence: Synthetic peptide"
FITHQQIHL

SEQ ID NO: 33316 - protein, 9 aa, Artificial Sequence
  source: /note="Description of Artificial Sequence: Synthetic peptide"
QIHLGDRPY

SEQ ID NO: 33317 - protein, 9 aa, Artificial Sequence
  source: /note="Description of Artificial Sequence: Synthetic peptide"
SHFITHQQI

SEQ ID NO: 33318 - protein, 10 aa, Artificial Sequence
  source: /note="Description of Artificial Sequence: Synthetic peptide"
SSHFITHQQI

SEQ ID NO: 33319 - protein, 10 aa, Artificial Sequence
  source: /note="Description of Artificial Sequence: Synthetic peptide"
QQIHLGDRPY

SEQ ID NO: 33320 - protein, 10 aa, Artificial Sequence
  source: /note="Description of Artificial Sequence: Synthetic peptide"
QIHLGDRPYR

SEQ ID NO: 33321 - protein, 10 aa, Artificial Sequence
  source: /note="Description of Artificial Sequence: Synthetic peptide"
SHFITHQQIH

SEQ ID NO: 33322 - protein, 9 aa, Artificial Sequence
  source: /note="Description of Artificial Sequence: Synthetic peptide"
HSQIHTGDK

SEQ ID NO: 33323 - protein, 9 aa, Artificial Sequence
  source: /note="Description of Artificial Sequence: Synthetic peptide"
QIHTGDKPF

SEQ ID NO: 33324 - protein, 9 aa, Artificial Sequence
  source: /note="Description of Artificial Sequence: Synthetic peptide"
CQLIEHSQI

SEQ ID NO: 33325 - protein, 9 aa, Artificial Sequence
  source: /note="Description of Artificial Sequence: Synthetic peptide"
QLIEHSQIH

SEQ ID NO: 33326 - protein, 10 aa, Artificial Sequence
  source: /note="Description of Artificial Sequence: Synthetic peptide"
QLIEHSQIHT

SEQ ID NO: 33327 - protein, 10 aa, Artificial Sequence
  source: /note="Description of Artificial Sequence: Synthetic peptide"
SQIHTGDKPF

SEQ ID NO: 33328 - protein, 10 aa, Artificial Sequence
  source: /note="Description of Artificial Sequence: Synthetic peptide"
CQLIEHSQIH

SEQ ID NO: 33329 - protein, 9 aa, Artificial Sequence
  source: /note="Description of Artificial Sequence: Synthetic peptide"
NECWKSFSH

SEQ ID NO: 33330 - protein, 9 aa, Artificial Sequence
  source: /note="Description of Artificial Sequence: Synthetic peptide"
KPFECNECW

SEQ ID NO: 33331 - protein, 10 aa, Artificial Sequence
  source: /note="Description of Artificial Sequence: Synthetic peptide"
CWKSFSHMSG

SEQ ID NO: 33332 - protein, 10 aa, Artificial Sequence
  source: /note="Description of Artificial Sequence: Synthetic peptide"
FECNECWKSF

SEQ ID NO: 33333 - protein, 10 aa, Artificial Sequence
  source: /note="Description of Artificial Sequence: Synthetic peptide"
NECWKSFSHM

SEQ ID NO: 33334 - protein, 10 aa, Artificial Sequence
  source: /note="Description of Artificial Sequence: Synthetic peptide"
WKSFSHMSGL

SEQ ID NO: 33335 - protein, 9 aa, Artificial Sequence
  source: /note="Description of Artificial Sequence: Synthetic peptide"
SAFQGLSLM

SEQ ID NO: 33336 - protein, 9 aa, Artificial Sequence
  source: /note="Description of Artificial Sequence: Synthetic peptide"
KCDIAGSAF

SEQ ID NO: 33337 - protein, 9 aa, Artificial Sequence
  source: /note="Description of Artificial Sequence: Synthetic peptide"
IAGSAFQGL

SEQ ID NO: 33338 - protein, 9 aa, Artificial Sequence
  source: /note="Description of Artificial Sequence: Synthetic peptide"
GSAFQGLSL

SEQ ID NO: 33339 - protein, 9 aa, Artificial Sequence
  source: /note="Description of Artificial Sequence: Synthetic peptide"
FQGLSLMAP

SEQ ID NO: 33340 - protein, 10 aa, Artificial Sequence
  source: /note="Description of Artificial Sequence: Synthetic peptide"
DIAGSAFQGL

SEQ ID NO: 33341 - protein, 10 aa, Artificial Sequence
  source: /note="Description of Artificial Sequence: Synthetic peptide"
CKCDIAGSAF

SEQ ID NO: 33342 - protein, 10 aa, Artificial Sequence
  source: /note="Description of Artificial Sequence: Synthetic peptide"
AGSAFQGLSL

SEQ ID NO: 33343 - protein, 10 aa, Artificial Sequence
  source: /note="Description of Artificial Sequence: Synthetic peptide"
GSAFQGLSLM

SEQ ID NO: 33344 - protein, 10 aa, Artificial Sequence
  source: /note="Description of Artificial Sequence: Synthetic peptide"
SAFQGLSLMA

SEQ ID NO: 33345 - protein, 10 aa, Artificial Sequence
  source: /note="Description of Artificial Sequence: Synthetic peptide"
FQGLSLMAPH

SEQ ID NO: 33346 - protein, 9 aa, Artificial Sequence
  source: /note="Description of Artificial Sequence: Synthetic peptide"
KGKSYNFNT

SEQ ID NO: 33347 - protein, 9 aa, Artificial Sequence
  source: /note="Description of Artificial Sequence: Synthetic peptide"
KSYNFNTFG

SEQ ID NO: 33348 - protein, 9 aa, Artificial Sequence
  source: /note="Description of Artificial Sequence: Synthetic peptide"
GKSYNFNTF

SEQ ID NO: 33349 - protein, 9 aa, Artificial Sequence
  source: /note="Description of Artificial Sequence: Synthetic peptide"
FNTFGENKY

SEQ ID NO: 33350 - protein, 10 aa, Artificial Sequence
  source: /note="Description of Artificial Sequence: Synthetic peptide"
NTFGENKYDK

SEQ ID NO: 33351 - protein, 10 aa, Artificial Sequence
  source: /note="Description of Artificial Sequence: Synthetic peptide"
KGKSYNFNTF

SEQ ID NO: 33352 - protein, 9 aa, Artificial Sequence
  source: /note="Description of Artificial Sequence: Synthetic peptide"
KQFGKTFSY

SEQ ID NO: 33353 - protein, 9 aa, Artificial Sequence
  source: /note="Description of Artificial Sequence: Synthetic peptide"
RNTRKQFGK

SEQ ID NO: 33354 - protein, 9 aa, Artificial Sequence
  source: /note="Description of Artificial Sequence: Synthetic peptide"
TRKQFGKTF

SEQ ID NO: 33355 - protein, 10 aa, Artificial Sequence
  source: /note="Description of Artificial Sequence: Synthetic peptide"
KRNTRKQFGK

SEQ ID NO: 33356 - protein, 10 aa, Artificial Sequence
  source: /note="Description of Artificial Sequence: Synthetic peptide"
RKQFGKTFSY

SEQ ID NO: 33357 - protein, 10 aa, Artificial Sequence
  source: /note="Description of Artificial Sequence: Synthetic peptide"
KQFGKTFSYC

SEQ ID NO: 33358 - protein, 10 aa, Artificial Sequence
  source: /note="Description of Artificial Sequence: Synthetic peptide"
GKTFSYCHSF

SEQ ID NO: 33359 - protein, 9 aa, Artificial Sequence
  source: /note="Description of Artificial Sequence: Synthetic peptide"
KQFWKAFSY

SEQ ID NO: 33360 - protein, 9 aa, Artificial Sequence
  source: /note="Description of Artificial Sequence: Synthetic peptide"
KAFSYCHSF

SEQ ID NO: 33361 - protein, 9 aa, Artificial Sequence
  source: /note="Description of Artificial Sequence: Synthetic peptide"
NTRKQFWKA

SEQ ID NO: 33362 - protein, 9 aa, Artificial Sequence
  source: /note="Description of Artificial Sequence: Synthetic peptide"
TRKQFWKAF

SEQ ID NO: 33363 - protein, 10 aa, Artificial Sequence
  source: /note="Description of Artificial Sequence: Synthetic peptide"
KAFSYCHSFQ

SEQ ID NO: 33364 - protein, 10 aa, Artificial Sequence
  source: /note="Description of Artificial Sequence: Synthetic peptide"
RKQFWKAFSY

SEQ ID NO: 33365 - protein, 10 aa, Artificial Sequence
  source: /note="Description of Artificial Sequence: Synthetic peptide"
NTRKQFWKAF

SEQ ID NO: 33366 - protein, 10 aa, Artificial Sequence
  source: /note="Description of Artificial Sequence: Synthetic peptide"
WKAFSYCHSF

SEQ ID NO: 33367 - protein, 10 aa, Artificial Sequence
  source: /note="Description of Artificial Sequence: Synthetic peptide"
KQFWKAFSYC

SEQ ID NO: 33368 - protein, 9 aa, Artificial Sequence
  source: /note="Description of Artificial Sequence: Synthetic peptide"
KPYKCKRGK

SEQ ID NO: 33369 - protein, 9 aa, Artificial Sequence
  source: /note="Description of Artificial Sequence: Synthetic peptide"
KCKRGKAFI

SEQ ID NO: 33370 - protein, 9 aa, Artificial Sequence
  source: /note="Description of Artificial Sequence: Synthetic peptide"
RGKAFIDFY

SEQ ID NO: 33371 - protein, 9 aa, Artificial Sequence
  source: /note="Description of Artificial Sequence: Synthetic peptide"
YKCKRGKAF

SEQ ID NO: 33372 - protein, 9 aa, Artificial Sequence
  source: /note="Description of Artificial Sequence: Synthetic peptide"
KRGKAFIDF

SEQ ID NO: 33373 - protein, 10 aa, Artificial Sequence
  source: /note="Description of Artificial Sequence: Synthetic peptide"
RGKAFIDFYS

SEQ ID NO: 33374 - protein, 10 aa, Artificial Sequence
  source: /note="Description of Artificial Sequence: Synthetic peptide"
KRGKAFIDFY

SEQ ID NO: 33375 - protein, 10 aa, Artificial Sequence
  source: /note="Description of Artificial Sequence: Synthetic peptide"
KPYKCKRGKA

SEQ ID NO: 33376 - protein, 10 aa, Artificial Sequence
  source: /note="Description of Artificial Sequence: Synthetic peptide"
CKRGKAFIDF

SEQ ID NO: 33377 - protein, 9 aa, Artificial Sequence
  source: /note="Description of Artificial Sequence: Synthetic peptide"
KLIPCSSHL

SEQ ID NO: 33378 - protein, 9 aa, Artificial Sequence
  source: /note="Description of Artificial Sequence: Synthetic peptide"
IPCSSHLEF

SEQ ID NO: 33379 - protein, 9 aa, Artificial Sequence
  source: /note="Description of Artificial Sequence: Synthetic peptide"
HKLIPCSSH

SEQ ID NO: 33380 - protein, 10 aa, Artificial Sequence
  source: /note="Description of Artificial Sequence: Synthetic peptide"
LIPCSSHLEF

SEQ ID NO: 33381 - protein, 10 aa, Artificial Sequence
  source: /note="Description of Artificial Sequence: Synthetic peptide"
HKLIPCSSHL

SEQ ID NO: 33382 - protein, 9 aa, Artificial Sequence
  source: /note="Description of Artificial Sequence: Synthetic peptide"
HQRVHTEKR

SEQ ID NO: 33383 - protein, 9 aa, Artificial Sequence
  source: /note="Description of Artificial Sequence: Synthetic peptide"
RVHTEKRPY

SEQ ID NO: 33384 - protein, 10 aa, Artificial Sequence
  source: /note="Description of Artificial Sequence: Synthetic peptide"
RVHTEKRPYE

SEQ ID NO: 33385 - protein, 10 aa, Artificial Sequence
  source: /note="Description of Artificial Sequence: Synthetic peptide"
QRVHTEKRPY

SEQ ID NO: 33386 - protein, 9 aa, Artificial Sequence
  source: /note="Description of Artificial Sequence: Synthetic peptide"
RVHTGKRHY

SEQ ID NO: 33387 - protein, 10 aa, Artificial Sequence
  source: /note="Description of Artificial Sequence: Synthetic peptide"
RVHTGKRHYE

SEQ ID NO: 33388 - protein, 10 aa, Artificial Sequence
  source: /note="Description of Artificial Sequence: Synthetic peptide"
HQRVHTGKRH

SEQ ID NO: 33389 - protein, 10 aa, Artificial Sequence
  source: /note="Description of Artificial Sequence: Synthetic peptide"
QRVHTGKRHY

SEQ ID NO: 33390 - protein, 9 aa, Artificial Sequence
  source: /note="Description of Artificial Sequence: Synthetic peptide"
RVHTGKRPH

SEQ ID NO: 33391 - protein, 10 aa, Artificial Sequence
  source: /note="Description of Artificial Sequence: Synthetic peptide"
RVHTGKRPHE

SEQ ID NO: 33392 - protein, 10 aa, Artificial Sequence
  source: /note="Description of Artificial Sequence: Synthetic peptide"
WLTCLLRHEI

SEQ ID NO: 33393 - protein, 9 aa, Artificial Sequence
  source: /note="Description of Artificial Sequence: Synthetic peptide"
ALHTQPCAA

SEQ ID NO: 33394 - protein, 9 aa, Artificial Sequence
  source: /note="Description of Artificial Sequence: Synthetic peptide"
HGASRGPPA

SEQ ID NO: 33395 - protein, 9 aa, Artificial Sequence
  source: /note="Description of Artificial Sequence: Synthetic peptide"
ASRGPPAPR

SEQ ID NO: 33396 - protein, 9 aa, Artificial Sequence
  source: /note="Description of Artificial Sequence: Synthetic peptide"
RALHTQPCA

SEQ ID NO: 33397 - protein, 9 aa, Artificial Sequence
  source: /note="Description of Artificial Sequence: Synthetic peptide"
DGQPRWGQR

SEQ ID NO: 33398 - protein, 9 aa, Artificial Sequence
  source: /note="Description of Artificial Sequence: Synthetic peptide"
QPRWGQRAL

SEQ ID NO: 33399 - protein, 10 aa, Artificial Sequence
  source: /note="Description of Artificial Sequence: Synthetic peptide"
ALHTQPCAAA

SEQ ID NO: 33400 - protein, 10 aa, Artificial Sequence
  source: /note="Description of Artificial Sequence: Synthetic peptide"
RALHTQPCAA

SEQ ID NO: 33401 - protein, 10 aa, Artificial Sequence
  source: /note="Description of Artificial Sequence: Synthetic peptide"
VPEGPAHPTV

SEQ ID NO: 33402 - protein, 10 aa, Artificial Sequence
  source: /note="Description of Artificial Sequence: Synthetic peptide"
GQPRWGQRAL

SEQ ID NO: 33403 - protein, 10 aa, Artificial Sequence
  source: /note="Description of Artificial Sequence: Synthetic peptide"
GQRALHTQPC

SEQ ID NO: 33404 - protein, 10 aa, Artificial Sequence
  source: /note="Description of Artificial Sequence: Synthetic peptide"
RPASDGQPRW

SEQ ID NO: 33405 - protein, 9 aa, Artificial Sequence
  source: /note="Description of Artificial Sequence: Synthetic peptide"
RLKMFSKEK

SEQ ID NO: 33406 - protein, 9 aa, Artificial Sequence
  source: /note="Description of Artificial Sequence: Synthetic peptide"
MFSKEKWQV

SEQ ID NO: 33407 - protein, 9 aa, Artificial Sequence
  source: /note="Description of Artificial Sequence: Synthetic peptide"
QRRLKMFSK

SEQ ID NO: 33408 - protein, 9 aa, Artificial Sequence
  source: /note="Description of Artificial Sequence: Synthetic peptide"
FSKEKWQVY

SEQ ID NO: 33409 - protein, 9 aa, Artificial Sequence
  source: /note="Description of Artificial Sequence: Synthetic peptide"
LKMFSKEKW

SEQ ID NO: 33410 - protein, 10 aa, Artificial Sequence
  source: /note="Description of Artificial Sequence: Synthetic peptide"
KMFSKEKWQV

SEQ ID NO: 33411 - protein, 10 aa, Artificial Sequence
  source: /note="Description of Artificial Sequence: Synthetic peptide"
GQRRLKMFSK

SEQ ID NO: 33412 - protein, 10 aa, Artificial Sequence
  source: /note="Description of Artificial Sequence: Synthetic peptide"
RRLKMFSKEK

SEQ ID NO: 33413 - protein, 10 aa, Artificial Sequence
  source: /note="Description of Artificial Sequence: Synthetic peptide"
MFSKEKWQVY

SEQ ID NO: 33414 - protein, 10 aa, Artificial Sequence
  source: /note="Description of Artificial Sequence: Synthetic peptide"
RLKMFSKEKW

SEQ ID NO: 33415 - protein, 9 aa, Artificial Sequence
  source: /note="Description of Artificial Sequence: Synthetic peptide"
RLPQADTPL

SEQ ID NO: 33416 - protein, 9 aa, Artificial Sequence
  source: /note="Description of Artificial Sequence: Synthetic peptide"
PQADTPLPL

SEQ ID NO: 33417 - protein, 10 aa, Artificial Sequence
  source: /note="Description of Artificial Sequence: Synthetic peptide"
LPQADTPLPL

SEQ ID NO: 33418 - protein, 10 aa, Artificial Sequence
  source: /note="Description of Artificial Sequence: Synthetic peptide"
LRLPQADTPL

SEQ ID NO: 33419 - protein, 9 aa, Artificial Sequence
  source: /note="Description of Artificial Sequence: Synthetic peptide"
REMDKQTVK

SEQ ID NO: 33420 - protein, 10 aa, Artificial Sequence
  source: /note="Description of Artificial Sequence: Synthetic peptide"
QTVKDISPSA

SEQ ID NO: 33421 - protein, 9 aa, Artificial Sequence
  source: /note="Description of Artificial Sequence: Synthetic peptide"
YSGNLSNHK

SEQ ID NO: 33422 - protein, 10 aa, Artificial Sequence
  source: /note="Description of Artificial Sequence: Synthetic peptide"
FNYSGNLSNH

SEQ ID NO: 33423 - protein, 9 aa, Artificial Sequence
  source: /note="Description of Artificial Sequence: Synthetic peptide"
RIHTGQQPY

SEQ ID NO: 33424 - protein, 9 aa, Artificial Sequence
  source: /note="Description of Artificial Sequence: Synthetic peptide"
GQQPYKCNV

SEQ ID NO: 33425 - protein, 10 aa, Artificial Sequence
  source: /note="Description of Artificial Sequence: Synthetic peptide"
RIHTGQQPYK

SEQ ID NO: 33426 - protein, 10 aa, Artificial Sequence
  source: /note="Description of Artificial Sequence: Synthetic peptide"
LRIHTGQQPY

SEQ ID NO: 33427 - protein, 10 aa, Artificial Sequence
  source: /note="Description of Artificial Sequence: Synthetic peptide"
KIIHTGEKPF

SEQ ID NO: 33428 - protein, 9 aa, Artificial Sequence
  source: /note="Description of Artificial Sequence: Synthetic peptide"
KLVYHQINH

SEQ ID NO: 33429 - protein, 9 aa, Artificial Sequence
  source: /note="Description of Artificial Sequence: Synthetic peptide"
HQINHTGEK

SEQ ID NO: 33430 - protein, 9 aa, Artificial Sequence
  source: /note="Description of Artificial Sequence: Synthetic peptide"
RSKLVYHQI

SEQ ID NO: 33431 - protein, 9 aa, Artificial Sequence
  source: /note="Description of Artificial Sequence: Synthetic peptide"
INHTGEKPY

SEQ ID NO: 33432 - protein, 10 aa, Artificial Sequence
  source: /note="Description of Artificial Sequence: Synthetic peptide"
KLVYHQINHT

SEQ ID NO: 33433 - protein, 10 aa, Artificial Sequence
  source: /note="Description of Artificial Sequence: Synthetic peptide"
RSKLVYHQIN

SEQ ID NO: 33434 - protein, 10 aa, Artificial Sequence
  source: /note="Description of Artificial Sequence: Synthetic peptide"
INHTGEKPYK

SEQ ID NO: 33435 - protein, 10 aa, Artificial Sequence
  source: /note="Description of Artificial Sequence: Synthetic peptide"
QINHTGEKPY

SEQ ID NO: 33436 - protein, 9 aa, Artificial Sequence
  source: /note="Description of Artificial Sequence: Synthetic peptide"
TTTLARHRI

SEQ ID NO: 33437 - protein, 9 aa, Artificial Sequence
  source: /note="Description of Artificial Sequence: Synthetic peptide"
FSQISSLVY

SEQ ID NO: 33438 - protein, 9 aa, Artificial Sequence
  source: /note="Description of Artificial Sequence: Synthetic peptide"
KTFSQISSL

SEQ ID NO: 33439 - protein, 9 aa, Artificial Sequence
  source: /note="Description of Artificial Sequence: Synthetic peptide"
QISSLVYHR

SEQ ID NO: 33440 - protein, 9 aa, Artificial Sequence
  source: /note="Description of Artificial Sequence: Synthetic peptide"
ISSLVYHRR

SEQ ID NO: 33441 - protein, 9 aa, Artificial Sequence
  source: /note="Description of Artificial Sequence: Synthetic peptide"
TFSQISSLV

SEQ ID NO: 33442 - protein, 9 aa, Artificial Sequence
  source: /note="Description of Artificial Sequence: Synthetic peptide"
SQISSLVYH

SEQ ID NO: 33443 - protein, 10 aa, Artificial Sequence
  source: /note="Description of Artificial Sequence: Synthetic peptide"
KTFSQISSLV

SEQ ID NO: 33444 - protein, 10 aa, Artificial Sequence
  source: /note="Description of Artificial Sequence: Synthetic peptide"
SQISSLVYHR

SEQ ID NO: 33445 - protein, 10 aa, Artificial Sequence
  source: /note="Description of Artificial Sequence: Synthetic peptide"
QISSLVYHRR

SEQ ID NO: 33446 - protein, 10 aa, Artificial Sequence
  source: /note="Description of Artificial Sequence: Synthetic peptide"
TFSQISSLVY

SEQ ID NO: 33447 - protein, 10 aa, Artificial Sequence
  source: /note="Description of Artificial Sequence: Synthetic peptide"
GKTFSQISSL

SEQ ID NO: 33448 - protein, 9 aa, Artificial Sequence
  source: /note="Description of Artificial Sequence: Synthetic peptide"
KTFHHNSVL

SEQ ID NO: 33449 - protein, 9 aa, Artificial Sequence
  source: /note="Description of Artificial Sequence: Synthetic peptide"
GKTFHHNSV

SEQ ID NO: 33450 - protein, 9 aa, Artificial Sequence
  source: /note="Description of Artificial Sequence: Synthetic peptide"
FHHNSVLVI

SEQ ID NO: 33451 - protein, 10 aa, Artificial Sequence
  source: /note="Description of Artificial Sequence: Synthetic peptide"
KTFHHNSVLV

SEQ ID NO: 33452 - protein, 10 aa, Artificial Sequence
  source: /note="Description of Artificial Sequence: Synthetic peptide"
TFHHNSVLVI

SEQ ID NO: 33453 - protein, 10 aa, Artificial Sequence
  source: /note="Description of Artificial Sequence: Synthetic peptide"
CGKTFHHNSV

SEQ ID NO: 33454 - protein, 10 aa, Artificial Sequence
  source: /note="Description of Artificial Sequence: Synthetic peptide"
HHNSVLVIHK

SEQ ID NO: 33455 - protein, 10 aa, Artificial Sequence
  source: /note="Description of Artificial Sequence: Synthetic peptide"
GKTFHHNSVL

SEQ ID NO: 33456 - protein, 10 aa, Artificial Sequence
  source: /note="Description of Artificial Sequence: Synthetic peptide"
FHHNSVLVIH

SEQ ID NO: 33457 - protein, 9 aa, Artificial Sequence
  source: /note="Description of Artificial Sequence: Synthetic peptide"
HHRMHTGER

SEQ ID NO: 33458 - protein, 10 aa, Artificial Sequence
  source: /note="Description of Artificial Sequence: Synthetic peptide"
HRMHTGERPY

SEQ ID NO: 33459 - protein, 9 aa, Artificial Sequence
  source: /note="Description of Artificial Sequence: Synthetic peptide"
EEADVTVGA

SEQ ID NO: 33460 - protein, 10 aa, Artificial Sequence
  source: /note="Description of Artificial Sequence: Synthetic peptide"
EEADVTVGAT

SEQ ID NO: 33461 - protein, 10 aa, Artificial Sequence
  source: /note="Description of Artificial Sequence: Synthetic peptide"
TEEADVTVGA

SEQ ID NO: 33462 - protein, 9 aa, Artificial Sequence
  source: /note="Description of Artificial Sequence: Synthetic peptide"
IVKCLQLKY

SEQ ID NO: 33463 - protein, 9 aa, Artificial Sequence
  source: /note="Description of Artificial Sequence: Synthetic peptide"
CLQLKYAIY

SEQ ID NO: 33464 - protein, 9 aa, Artificial Sequence
  source: /note="Description of Artificial Sequence: Synthetic peptide"
EEIVKCLQL

SEQ ID NO: 33465 - protein, 10 aa, Artificial Sequence
  source: /note="Description of Artificial Sequence: Synthetic peptide"
CLQLKYAIYA

SEQ ID NO: 33466 - protein, 10 aa, Artificial Sequence
  source: /note="Description of Artificial Sequence: Synthetic peptide"
IVKCLQLKYA

SEQ ID NO: 33467 - protein, 10 aa, Artificial Sequence
  source: /note="Description of Artificial Sequence: Synthetic peptide"
KCLQLKYAIY

SEQ ID NO: 33468 - protein, 10 aa, Artificial Sequence
  source: /note="Description of Artificial Sequence: Synthetic peptide"
VEEIVKCLQL

SEQ ID NO: 33469 - protein, 9 aa, Artificial Sequence
  source: /note="Description of Artificial Sequence: Synthetic peptide"
WSWGDPGTF

SEQ ID NO: 33470 - protein, 9 aa, Artificial Sequence
  source: /note="Description of Artificial Sequence: Synthetic peptide"
LASPQPGPW

SEQ ID NO: 33471 - protein, 9 aa, Artificial Sequence
  source: /note="Description of Artificial Sequence: Synthetic peptide"
SPQPGPWSW

SEQ ID NO: 33472 - protein, 9 aa, Artificial Sequence
  source: /note="Description of Artificial Sequence: Synthetic peptide"
GELASPQPG

SEQ ID NO: 33473 - protein, 9 aa, Artificial Sequence
  source: /note="Description of Artificial Sequence: Synthetic peptide"
KNYSKLVAA

SEQ ID NO: 33474 - protein, 9 aa, Artificial Sequence
  source: /note="Description of Artificial Sequence: Synthetic peptide"
LILEEFKNY

SEQ ID NO: 33475 - protein, 9 aa, Artificial Sequence
  source: /note="Description of Artificial Sequence: Synthetic peptide"
FKNYSKLVA

SEQ ID NO: 33476 - protein, 9 aa, Artificial Sequence
  source: /note="Description of Artificial Sequence: Synthetic peptide"
EEFKNYSKL

SEQ ID NO: 33477 - protein, 10 aa, Artificial Sequence
  source: /note="Description of Artificial Sequence: Synthetic peptide"
ILEEFKNYSK

SEQ ID NO: 33478 - protein, 10 aa, Artificial Sequence
  source: /note="Description of Artificial Sequence: Synthetic peptide"
YSKLVAAAEK

SEQ ID NO: 33479 - protein, 10 aa, Artificial Sequence
  source: /note="Description of Artificial Sequence: Synthetic peptide"
KNYSKLVAAA

SEQ ID NO: 33480 - protein, 10 aa, Artificial Sequence
  source: /note="Description of Artificial Sequence: Synthetic peptide"
KLILEEFKNY

SEQ ID NO: 33481 - protein, 10 aa, Artificial Sequence
  source: /note="Description of Artificial Sequence: Synthetic peptide"
FKNYSKLVAA

SEQ ID NO: 33482 - protein, 10 aa, Artificial Sequence
  source: /note="Description of Artificial Sequence: Synthetic peptide"
LEEFKNYSKL

SEQ ID NO: 33483 - protein, 10 aa, Artificial Sequence
  source: /note="Description of Artificial Sequence: Synthetic peptide"
EEFKNYSKLV

SEQ ID NO: 33484 - protein, 9 aa, Artificial Sequence
  source: /note="Description of Artificial Sequence: Synthetic peptide"
GSTCITNTK

SEQ ID NO: 33485 - protein, 9 aa, Artificial Sequence
  source: /note="Description of Artificial Sequence: Synthetic peptide"
TKGWVGHPL

SEQ ID NO: 33486 - protein, 10 aa, Artificial Sequence
  source: /note="Description of Artificial Sequence: Synthetic peptide"
KGSTCITNTK

SEQ ID NO: 33487 - protein, 10 aa, Artificial Sequence
  source: /note="Description of Artificial Sequence: Synthetic peptide"
NTKGWVGHPL

SEQ ID NO: 33488 - protein, 9 aa, Artificial Sequence
  source: /note="Description of Artificial Sequence: Synthetic peptide"
RTQKKSYPI

SEQ ID NO: 33489 - protein, 9 aa, Artificial Sequence
  source: /note="Description of Artificial Sequence: Synthetic peptide"
TQKKSYPIK

SEQ ID NO: 33490 - protein, 9 aa, Artificial Sequence
  source: /note="Description of Artificial Sequence: Synthetic peptide"
MFRTQKKSY

SEQ ID NO: 33491 - protein, 10 aa, Artificial Sequence
  source: /note="Description of Artificial Sequence: Synthetic peptide"
RTQKKSYPIK

SEQ ID NO: 33492 - protein, 10 aa, Artificial Sequence
  source: /note="Description of Artificial Sequence: Synthetic peptide"
EMFRTQKKSY

SEQ ID NO: 33493 - protein, 10 aa, Artificial Sequence
  source: /note="Description of Artificial Sequence: Synthetic peptide"
FRTQKKSYPI

SEQ ID NO: 33494 - protein, 9 aa, Artificial Sequence
  source: /note="Description of Artificial Sequence: Synthetic peptide"
GPHQDWAAA

SEQ ID NO: 33495 - protein, 10 aa, Artificial Sequence
  source: /note="Description of Artificial Sequence: Synthetic peptide"
WAAASGTTPG

SEQ ID NO: 33496 - protein, 9 aa, Artificial Sequence
  source: /note="Description of Artificial Sequence: Synthetic peptide"
MAASQSTRV

SEQ ID NO: 33497 - protein, 9 aa, Artificial Sequence
  source: /note="Description of Artificial Sequence: Synthetic peptide"
ASQSTRVTR

SEQ ID NO: 33498 - protein, 10 aa, Artificial Sequence
  source: /note="Description of Artificial Sequence: Synthetic peptide"
SQSTRVTRST

SEQ ID NO: 33499 - protein, 9 aa, Artificial Sequence
  source: /note="Description of Artificial Sequence: Synthetic peptide"
KQACRCLIL

SEQ ID NO: 33500 - protein, 10 aa, Artificial Sequence
  source: /note="Description of Artificial Sequence: Synthetic peptide"
GTKQACRCLI

SEQ ID NO: 33501 - protein, 10 aa, Artificial Sequence
  source: /note="Description of Artificial Sequence: Synthetic peptide"
DFQGTKQACR

SEQ ID NO: 33502 - protein, 10 aa, Artificial Sequence
  source: /note="Description of Artificial Sequence: Synthetic peptide"
TKQACRCLIL

SEQ ID NO: 33503 - protein, 9 aa, Artificial Sequence
  source: /note="Description of Artificial Sequence: Synthetic peptide"
VTAASTSYY

SEQ ID NO: 33504 - protein, 10 aa, Artificial Sequence
  source: /note="Description of Artificial Sequence: Synthetic peptide"
KLVVVGADGV

SEQ ID NO: 33505 - protein, 10 aa, Artificial Sequence
  source: /note="Description of Artificial Sequence: Synthetic peptide"
KLVVVGAVGV

SEQ ID NO: 33506 - protein, 9 aa, Artificial Sequence
  source: /note="Description of Artificial Sequence: Synthetic peptide"
VVGAVGVGK

SEQ ID NO: 33507 - protein, 10 aa, Artificial Sequence
  source: /note="Description of Artificial Sequence: Synthetic peptide"
KLVVVGACGV

SEQ ID NO: 33508 - protein, 9 aa, Artificial Sequence
  source: /note="Description of Artificial Sequence: Synthetic peptide"
VVGACGVGK

SEQ ID NO: 33509 - protein, 10 aa, Artificial Sequence
  source: /note="Description of Artificial Sequence: Synthetic peptide"
VVVGAVGVGK

SEQ ID NO: 33510 - protein, 10 aa, Artificial Sequence
  source: /note="Description of Artificial Sequence: Synthetic peptide"
GMNWRPILTI

SEQ ID NO: 33511 - protein, 10 aa, Artificial Sequence
  source: /note="Description of Artificial Sequence: Synthetic peptide"
AISTRDPLSK

SEQ ID NO: 33512 - protein, 9 aa, Artificial Sequence
  source: /note="Description of Artificial Sequence: Synthetic peptide"
KLSDSRTAL

SEQ ID NO: 33513 - protein, 9 aa, Artificial Sequence
  source: /note="Description of Artificial Sequence: Synthetic peptide"
KIMFATLQR

SEQ ID NO: 33514 - protein, 9 aa, Artificial Sequence
  source: /note="Description of Artificial Sequence: Synthetic peptide"
VVGADGVGK

SEQ ID NO: 33515 - protein, 10 aa, Artificial Sequence
  source: /note="Description of Artificial Sequence: Synthetic peptide"
ILDTAGREEY

SEQ ID NO: 33516 - protein, 10 aa, Artificial Sequence
  source: /note="Description of Artificial Sequence: Synthetic peptide"
ILDTAGKEEY

SEQ ID NO: 33517 - protein, 9 aa, Artificial Sequence
  source: /note="Description of Artificial Sequence: Synthetic peptide"
MLTGPPARV

SEQ ID NO: 33518 - protein, 9 aa, Artificial Sequence
  source: /note="Description of Artificial Sequence: Synthetic peptide"
AAAAVIPTV

SEQ ID NO: 33519 - protein, 10 aa, Artificial Sequence
  source: /note="Description of Artificial Sequence: Synthetic peptide"
AAAAAVIPTV

SEQ ID NO: 33520 - protein, 9 aa, Artificial Sequence
  source: /note="Description of Artificial Sequence: Synthetic peptide"
YMFLKAESK

SEQ ID NO: 33521 - protein, 10 aa, Artificial Sequence
  source: /note="Description of Artificial Sequence: Synthetic peptide"
SMLTGPPARV

SEQ ID NO: 33522 - protein, 10 aa, Artificial Sequence
  source: /note="Description of Artificial Sequence: Synthetic peptide"
YMFLKAESKI

SEQ ID NO: 33523 - protein, 10 aa, Artificial Sequence
  source: /note="Description of Artificial Sequence: Synthetic peptide"
TLQRSSLWCL

SEQ ID NO: 33524 - protein, 9 aa, Artificial Sequence
  source: /note="Description of Artificial Sequence: Synthetic peptide"
LVSEMKMFV

SEQ ID NO: 33525 - protein, 9 aa, Artificial Sequence
  source: /note="Description of Artificial Sequence: Synthetic peptide"
FMKQMNDAR

SEQ ID NO: 33526 - protein, 10 aa, Artificial Sequence
  source: /note="Description of Artificial Sequence: Synthetic peptide"
LLDILDTAGL

SEQ ID NO: 33527 - protein, 9 aa, Artificial Sequence
  source: /note="Description of Artificial Sequence: Synthetic peptide"
FATLQRSSL

SEQ ID NO: 33528 - protein, 10 aa, Artificial Sequence
  source: /note="Description of Artificial Sequence: Synthetic peptide"
HLVSEMKMFV

SEQ ID NO: 33529 - protein, 10 aa, Artificial Sequence
  source: /note="Description of Artificial Sequence: Synthetic peptide"
ALSASNSCFI

SEQ ID NO: 33530 - protein, 10 aa, Artificial Sequence
  source: /note="Description of Artificial Sequence: Synthetic peptide"
FQNGKMALSA

SEQ ID NO: 33531 - protein, 9 aa, Artificial Sequence
  source: /note="Description of Artificial Sequence: Synthetic peptide"
AVTAASTSY

SEQ ID NO: 33532 - protein, 9 aa, Artificial Sequence
  source: /note="Description of Artificial Sequence: Synthetic peptide"
VVGARGVGK

SEQ ID NO: 33533 - protein, 10 aa, Artificial Sequence
  source: /note="Description of Artificial Sequence: Synthetic peptide"
SEITKQEKDF

SEQ ID NO: 33534 - protein, 9 aa, Artificial Sequence
  source: /note="Description of Artificial Sequence: Synthetic peptide"
LLTSNSCFI

SEQ ID NO: 33535 - protein, 10 aa, Artificial Sequence
  source: /note="Description of Artificial Sequence: Synthetic peptide"
ALLTSNSCFI

SEQ ID NO: 33536 - protein, 10 aa, Artificial Sequence
  source: /note="Description of Artificial Sequence: Synthetic peptide"
RTALKSGYGK

SEQ ID NO: 33537 - protein, 9 aa, Artificial Sequence
  source: /note="Description of Artificial Sequence: Synthetic peptide"
FQNGKMPLL

SEQ ID NO: 33538 - protein, 9 aa, Artificial Sequence
  source: /note="Description of Artificial Sequence: Synthetic peptide"
FMKQMNDAL

SEQ ID NO: 33539 - protein, 10 aa, Artificial Sequence
  source: /note="Description of Artificial Sequence: Synthetic peptide"
ILDTAGLEEY

SEQ ID NO: 33540 - protein, 9 aa, Artificial Sequence
  source: /note="Description of Artificial Sequence: Synthetic peptide"
ITLKSGYGK

SEQ ID NO: 33541 - protein, 9 aa, Artificial Sequence
  source: /note="Description of Artificial Sequence: Synthetic peptide"
VSAPKPLSK

SEQ ID NO: 33542 - protein, 9 aa, Artificial Sequence
  source: /note="Description of Artificial Sequence: Synthetic peptide"
FLKAESKIM

SEQ ID NO: 33543 - protein, 10 aa, Artificial Sequence
  source: /note="Description of Artificial Sequence: Synthetic peptide"
FQNGKMPLLA

SEQ ID NO: 33544 - protein, 10 aa, Artificial Sequence
  source: /note="Description of Artificial Sequence: Synthetic peptide"
YFMKQMNDAR

SEQ ID NO: 33545 - protein, 9 aa, Artificial Sequence
  source: /note="Description of Artificial Sequence: Synthetic peptide"
AIQPVLWTT

SEQ ID NO: 33546 - protein, 10 aa, Artificial Sequence
  source: /note="Description of Artificial Sequence: Synthetic peptide"
AVTAASTSYY

SEQ ID NO: 33547 - protein, 10 aa, Artificial Sequence
  source: /note="Description of Artificial Sequence: Synthetic peptide"
KLSDSRTALK

SEQ ID NO: 33548 - protein, 9 aa, Artificial Sequence
  source: /note="Description of Artificial Sequence: Synthetic peptide"
KLSDSRITL

SEQ ID NO: 33549 - protein, 10 aa, Artificial Sequence
  source: /note="Description of Artificial Sequence: Synthetic peptide"
GVSAPKPLSK

SEQ ID NO: 33550 - protein, 10 aa, Artificial Sequence
  source: /note="Description of Artificial Sequence: Synthetic peptide"
VVVPCEPPEV

SEQ ID NO: 33551 - protein, 10 aa, Artificial Sequence
  source: /note="Description of Artificial Sequence: Synthetic peptide"
SSCMGGMNWR

SEQ ID NO: 33552 - protein, 10 aa, Artificial Sequence
  source: /note="Description of Artificial Sequence: Synthetic peptide"
GARGVGKSAL

SEQ ID NO: 33553 - protein, 9 aa, Artificial Sequence
  source: /note="Description of Artificial Sequence: Synthetic peptide"
TTNAFSGEY

SEQ ID NO: 33554 - protein, 9 aa, Artificial Sequence
  source: /note="Description of Artificial Sequence: Synthetic peptide"
GPPARVPAV

SEQ ID NO: 33555 - protein, 9 aa, Artificial Sequence
  source: /note="Description of Artificial Sequence: Synthetic peptide"
KPKRDGYMF

SEQ ID NO: 33556 - protein, 10 aa, Artificial Sequence
  source: /note="Description of Artificial Sequence: Synthetic peptide"
KPKRDGYMFL

SEQ ID NO: 33557 - protein, 10 aa, Artificial Sequence
  source: /note="Description of Artificial Sequence: Synthetic peptide"
KLVVVGAAGV

SEQ ID NO: 33558 - protein, 9 aa, Artificial Sequence
  source: /note="Description of Artificial Sequence: Synthetic peptide"
FVQGKDWGL

SEQ ID NO: 33559 - protein, 10 aa, Artificial Sequence
  source: /note="Description of Artificial Sequence: Synthetic peptide"
CSMLTGPPAR

SEQ ID NO: 33560 - protein, 10 aa, Artificial Sequence
  source: /note="Description of Artificial Sequence: Synthetic peptide"
SIRQAGGISK

SEQ ID NO: 33561 - protein, 9 aa, Artificial Sequence
  source: /note="Description of Artificial Sequence: Synthetic peptide"
EIAEVLFHI

SEQ ID NO: 33562 - protein, 9 aa, Artificial Sequence
  source: /note="Description of Artificial Sequence: Synthetic peptide"
ALQPLQPHA

SEQ ID NO: 33563 - protein, 10 aa, Artificial Sequence
  source: /note="Description of Artificial Sequence: Synthetic peptide"
SAWDLEIAEV

SEQ ID NO: 33564 - protein, 9 aa, Artificial Sequence
  source: /note="Description of Artificial Sequence: Synthetic peptide"
LLASNSCFV

SEQ ID NO: 33565 - protein, 9 aa, Artificial Sequence
  source: /note="Description of Artificial Sequence: Synthetic peptide"
KMLTQTDSA

SEQ ID NO: 33566 - protein, 9 aa, Artificial Sequence
  source: /note="Description of Artificial Sequence: Synthetic peptide"
LLLLLLLLV

SEQ ID NO: 33567 - protein, 10 aa, Artificial Sequence
  source: /note="Description of Artificial Sequence: Synthetic peptide"
SSCMGGMNQR

SEQ ID NO: 33568 - protein, 10 aa, Artificial Sequence
  source: /note="Description of Artificial Sequence: Synthetic peptide"
VVVGACGVGK

SEQ ID NO: 33569 - protein, 9 aa, Artificial Sequence
  source: /note="Description of Artificial Sequence: Synthetic peptide"
KILCATYVK

SEQ ID NO: 33570 - protein, 10 aa, Artificial Sequence
  source: /note="Description of Artificial Sequence: Synthetic peptide"
KLSDSRITLK

SEQ ID NO: 33571 - protein, 10 aa, Artificial Sequence
  source: /note="Description of Artificial Sequence: Synthetic peptide"
RITLKSGYGK

SEQ ID NO: 33572 - protein, 10 aa, Artificial Sequence
  source: /note="Description of Artificial Sequence: Synthetic peptide"
AVPFDLHFCR

SEQ ID NO: 33573 - protein, 9 aa, Artificial Sequence
  source: /note="Description of Artificial Sequence: Synthetic peptide"
ISTRDPLSK

SEQ ID NO: 33574 - protein, 9 aa, Artificial Sequence
  source: /note="Description of Artificial Sequence: Synthetic peptide"
SSCMGSMNR

SEQ ID NO: 33575 - protein, 10 aa, Artificial Sequence
  source: /note="Description of Artificial Sequence: Synthetic peptide"
AESKIMFATL

SEQ ID NO: 33576 - protein, 10 aa, Artificial Sequence
  source: /note="Description of Artificial Sequence: Synthetic peptide"
WLHKRGKYIK

SEQ ID NO: 33577 - protein, 9 aa, Artificial Sequence
  source: /note="Description of Artificial Sequence: Synthetic peptide"
ILCATYVKV

SEQ ID NO: 33578 - protein, 10 aa, Artificial Sequence
  source: /note="Description of Artificial Sequence: Synthetic peptide"
ALLASNSCFV

SEQ ID NO: 33579 - protein, 9 aa, Artificial Sequence
  source: /note="Description of Artificial Sequence: Synthetic peptide"
SASNSCFIR

SEQ ID NO: 33580 - protein, 10 aa, Artificial Sequence
  source: /note="Description of Artificial Sequence: Synthetic peptide"
KILCATYVKV

SEQ ID NO: 33581 - protein, 9 aa, Artificial Sequence
  source: /note="Description of Artificial Sequence: Synthetic peptide"
ETFHLVSEM

SEQ ID NO: 33582 - protein, 9 aa, Artificial Sequence
  source: /note="Description of Artificial Sequence: Synthetic peptide"
KVNIRDIDK

SEQ ID NO: 33583 - protein, 9 aa, Artificial Sequence
  source: /note="Description of Artificial Sequence: Synthetic peptide"
VVGAAGVGK

SEQ ID NO: 33584 - protein, 9 aa, Artificial Sequence
  source: /note="Description of Artificial Sequence: Synthetic peptide"
TLWHLQKEV

SEQ ID NO: 33585 - protein, 9 aa, Artificial Sequence
  source: /note="Description of Artificial Sequence: Synthetic peptide"
ESKIMFATL

SEQ ID NO: 33586 - protein, 10 aa, Artificial Sequence
  source: /note="Description of Artificial Sequence: Synthetic peptide"
KPTRAATVSV

SEQ ID NO: 33587 - protein, 9 aa, Artificial Sequence
  source: /note="Description of Artificial Sequence: Synthetic peptide"
ATAPSLSGK

SEQ ID NO: 33588 - protein, 10 aa, Artificial Sequence
  source: /note="Description of Artificial Sequence: Synthetic peptide"
HLQKEVALSV

SEQ ID NO: 33589 - protein, 9 aa, Artificial Sequence
  source: /note="Description of Artificial Sequence: Synthetic peptide"
ALHGGWTTK

SEQ ID NO: 33590 - protein, 10 aa, Artificial Sequence
  source: /note="Description of Artificial Sequence: Synthetic peptide"
RLRGGMQIFV

SEQ ID NO: 33591 - protein, 9 aa, Artificial Sequence
  source: /note="Description of Artificial Sequence: Synthetic peptide"
KMRRPVCYK

SEQ ID NO: 33592 - protein, 9 aa, Artificial Sequence
  source: /note="Description of Artificial Sequence: Synthetic peptide"
TTIHYNYMY

SEQ ID NO: 33593 - protein, 9 aa, Artificial Sequence
  source: /note="Description of Artificial Sequence: Synthetic peptide"
APKPLSKLL

SEQ ID NO: 33594 - protein, 9 aa, Artificial Sequence
  source: /note="Description of Artificial Sequence: Synthetic peptide"
LTSNSCFIR

SEQ ID NO: 33595 - protein, 9 aa, Artificial Sequence
  source: /note="Description of Artificial Sequence: Synthetic peptide"
TQLARFFPI

SEQ ID NO: 33596 - protein, 10 aa, Artificial Sequence
  source: /note="Description of Artificial Sequence: Synthetic peptide"
ETFHLVSEMK

SEQ ID NO: 33597 - protein, 9 aa, Artificial Sequence
  source: /note="Description of Artificial Sequence: Synthetic peptide"
ARHGGWTTK

SEQ ID NO: 33598 - protein, 10 aa, Artificial Sequence
  source: /note="Description of Artificial Sequence: Synthetic peptide"
ARHGGWTTKM

SEQ ID NO: 33599 - protein, 10 aa, Artificial Sequence
  source: /note="Description of Artificial Sequence: Synthetic peptide"
QPVLWTTPPL

SEQ ID NO: 33600 - protein, 10 aa, Artificial Sequence
  source: /note="Description of Artificial Sequence: Synthetic peptide"
MPLLASNSCF

SEQ ID NO: 33601 - protein, 9 aa, Artificial Sequence
  source: /note="Description of Artificial Sequence: Synthetic peptide"
ISKAKLRSM

SEQ ID NO: 33602 - protein, 9 aa, Artificial Sequence
  source: /note="Description of Artificial Sequence: Synthetic peptide"
VVGAGRVGK

SEQ ID NO: 33603 - protein, 9 aa, Artificial Sequence
  source: /note="Description of Artificial Sequence: Synthetic peptide"
RLLTWHAAM

SEQ ID NO: 33604 - protein, 9 aa, Artificial Sequence
  source: /note="Description of Artificial Sequence: Synthetic peptide"
LVVVGADGV

SEQ ID NO: 33605 - protein, 10 aa, Artificial Sequence
  source: /note="Description of Artificial Sequence: Synthetic peptide"
KLVVVGASGV

SEQ ID NO: 33606 - protein, 9 aa, Artificial Sequence
  source: /note="Description of Artificial Sequence: Synthetic peptide"
RVRVMAIYK

SEQ ID NO: 33607 - protein, 9 aa, Artificial Sequence
  source: /note="Description of Artificial Sequence: Synthetic peptide"
IEREGPEYW

SEQ ID NO: 33608 - protein, 9 aa, Artificial Sequence
  source: /note="Description of Artificial Sequence: Synthetic peptide"
LQRSSLWCL

SEQ ID NO: 33609 - protein, 10 aa, Artificial Sequence
  source: /note="Description of Artificial Sequence: Synthetic peptide"
ALQEKQSQEL

SEQ ID NO: 33610 - protein, 10 aa, Artificial Sequence
  source: /note="Description of Artificial Sequence: Synthetic peptide"
KLSGWGNVSK

SEQ ID NO: 33611 - protein, 10 aa, Artificial Sequence
  source: /note="Description of Artificial Sequence: Synthetic peptide"
LSASNSCFIR

SEQ ID NO: 33612 - protein, 9 aa, Artificial Sequence
  source: /note="Description of Artificial Sequence: Synthetic peptide"
WLHKRGKYI

SEQ ID NO: 33613 - protein, 9 aa, Artificial Sequence
  source: /note="Description of Artificial Sequence: Synthetic peptide"
KLGQIIMKK

SEQ ID NO: 33614 - protein, 9 aa, Artificial Sequence
  source: /note="Description of Artificial Sequence: Synthetic peptide"
FSGEYIPTV

SEQ ID NO: 33615 - protein, 9 aa, Artificial Sequence
  source: /note="Description of Artificial Sequence: Synthetic peptide"
IMKPKRDGY

SEQ ID NO: 33616 - protein, 10 aa, Artificial Sequence
  source: /note="Description of Artificial Sequence: Synthetic peptide"
EEEIATGQAF

SEQ ID NO: 33617 - protein, 10 aa, Artificial Sequence
  source: /note="Description of Artificial Sequence: Synthetic peptide"
TVHCMHLHEK

SEQ ID NO: 33618 - protein, 9 aa, Artificial Sequence
  source: /note="Description of Artificial Sequence: Synthetic peptide"
LTFFLLLLV

SEQ ID NO: 33619 - protein, 9 aa, Artificial Sequence
  source: /note="Description of Artificial Sequence: Synthetic peptide"
RVLAMAIYK

SEQ ID NO: 33620 - protein, 9 aa, Artificial Sequence
  source: /note="Description of Artificial Sequence: Synthetic peptide"
LVVVGAVGV

SEQ ID NO: 33621 - protein, 10 aa, Artificial Sequence
  source: /note="Description of Artificial Sequence: Synthetic peptide"
HMSSLSHISA

SEQ ID NO: 33622 - protein, 9 aa, Artificial Sequence
  source: /note="Description of Artificial Sequence: Synthetic peptide"
YLDSGIHFG

SEQ ID NO: 33623 - protein, 10 aa, Artificial Sequence
  source: /note="Description of Artificial Sequence: Synthetic peptide"
YLDSGIHFGA

SEQ ID NO: 33624 - protein, 10 aa, Artificial Sequence
  source: /note="Description of Artificial Sequence: Synthetic peptide"
YLDSGIHCGA

SEQ ID NO: 33625 - protein, 9 aa, Artificial Sequence
  source: /note="Description of Artificial Sequence: Synthetic peptide"
GLVDEQQEV

SEQ ID NO: 33626 - protein, 10 aa, Artificial Sequence
  source: /note="Description of Artificial Sequence: Synthetic peptide"
VVVGARGVGK

SEQ ID NO: 33627 - protein, 9 aa, Artificial Sequence
  source: /note="Description of Artificial Sequence: Synthetic peptide"
KITDFGRAK

SEQ ID NO: 33628 - protein, 9 aa, Artificial Sequence
  source: /note="Description of Artificial Sequence: Synthetic peptide"
NLLGRNSFK

SEQ ID NO: 33629 - protein, 9 aa, Artificial Sequence
  source: /note="Description of Artificial Sequence: Synthetic peptide"
FLLLLVVFL

SEQ ID NO: 33630 - protein, 9 aa, Artificial Sequence
  source: /note="Description of Artificial Sequence: Synthetic peptide"
LLVVFLLEA

SEQ ID NO: 33631 - protein, 9 aa, Artificial Sequence
  source: /note="Description of Artificial Sequence: Synthetic peptide"
LLLLVVFLL

SEQ ID NO: 33632 - protein, 10 aa, Artificial Sequence
  source: /note="Description of Artificial Sequence: Synthetic peptide"
FLLLLVVFLL

SEQ ID NO: 33633 - protein, 10 aa, Artificial Sequence
  source: /note="Description of Artificial Sequence: Synthetic peptide"
LLLVVFLLEA

SEQ ID NO: 33634 - protein, 10 aa, Artificial Sequence
  source: /note="Description of Artificial Sequence: Synthetic peptide"
LLTFFLLLLV

SEQ ID NO: 33635 - protein, 10 aa, Artificial Sequence
  source: /note="Description of Artificial Sequence: Synthetic peptide"
LEIAEVLFHI

SEQ ID NO: 33636 - protein, 9 aa, Artificial Sequence
  source: /note="Description of Artificial Sequence: Synthetic peptide"
TALKSGYGK

SEQ ID NO: 33637 - protein, 9 aa, Artificial Sequence
  source: /note="Description of Artificial Sequence: Synthetic peptide"
ATAAAVTAA

SEQ ID NO: 33638 - protein, 9 aa, Artificial Sequence
  source: /note="Description of Artificial Sequence: Synthetic peptide"
VVGASGVGK

SEQ ID NO: 33639 - protein, 9 aa, Artificial Sequence
  source: /note="Description of Artificial Sequence: Synthetic peptide"
STLHLVLRR

SEQ ID NO: 33640 - protein, 9 aa, Artificial Sequence
  source: /note="Description of Artificial Sequence: Synthetic peptide"
ATYVKVNIR

SEQ ID NO: 33641 - protein, 9 aa, Artificial Sequence
  source: /note="Description of Artificial Sequence: Synthetic peptide"
RMVRGTQVY

SEQ ID NO: 33642 - protein, 9 aa, Artificial Sequence
  source: /note="Description of Artificial Sequence: Synthetic peptide"
AESKIMFAT

SEQ ID NO: 33643 - protein, 9 aa, Artificial Sequence
  source: /note="Description of Artificial Sequence: Synthetic peptide"
ALSASNSCF

SEQ ID NO: 33644 - protein, 9 aa, Artificial Sequence
  source: /note="Description of Artificial Sequence: Synthetic peptide"
LLGRNSFKV

SEQ ID NO: 33645 - protein, 10 aa, Artificial Sequence
  source: /note="Description of Artificial Sequence: Synthetic peptide"
NLLGRNSFKV

SEQ ID NO: 33646 - protein, 9 aa, Artificial Sequence
  source: /note="Description of Artificial Sequence: Synthetic peptide"
TLKSGYGKY

SEQ ID NO: 33647 - protein, 10 aa, Artificial Sequence
  source: /note="Description of Artificial Sequence: Synthetic peptide"
QLDEQTGEFL

SEQ ID NO: 33648 - protein, 9 aa, Artificial Sequence
  source: /note="Description of Artificial Sequence: Synthetic peptide"
ALNNMFCQL

SEQ ID NO: 33649 - protein, 9 aa, Artificial Sequence
  source: /note="Description of Artificial Sequence: Synthetic peptide"
NSSYIVGFY

SEQ ID NO: 33650 - protein, 9 aa, Artificial Sequence
  source: /note="Description of Artificial Sequence: Synthetic peptide"
ATFSPSFPL

SEQ ID NO: 33651 - protein, 9 aa, Artificial Sequence
  source: /note="Description of Artificial Sequence: Synthetic peptide"
QEVRTISAL

SEQ ID NO: 33652 - protein, 9 aa, Artificial Sequence
  source: /note="Description of Artificial Sequence: Synthetic peptide"
FSHSSTLAK

SEQ ID NO: 33653 - protein, 9 aa, Artificial Sequence
  source: /note="Description of Artificial Sequence: Synthetic peptide"
APSAATTTA

SEQ ID NO: 33654 - protein, 10 aa, Artificial Sequence
  source: /note="Description of Artificial Sequence: Synthetic peptide"
APSAATTTAV

SEQ ID NO: 33655 - protein, 10 aa, Artificial Sequence
  source: /note="Description of Artificial Sequence: Synthetic peptide"
YTTNAFSGEY

SEQ ID NO: 33656 - protein, 9 aa, Artificial Sequence
  source: /note="Description of Artificial Sequence: Synthetic peptide"
LTWHAAMLK

SEQ ID NO: 33657 - protein, 9 aa, Artificial Sequence
  source: /note="Description of Artificial Sequence: Synthetic peptide"
SSFMGGMNR

SEQ ID NO: 33658 - protein, 9 aa, Artificial Sequence
  source: /note="Description of Artificial Sequence: Synthetic peptide"
LLLLPAPEL

SEQ ID NO: 33659 - protein, 10 aa, Artificial Sequence
  source: /note="Description of Artificial Sequence: Synthetic peptide"
LLLLLLLLPA

SEQ ID NO: 33660 - protein, 9 aa, Artificial Sequence
  source: /note="Description of Artificial Sequence: Synthetic peptide"
LLLLLLLPA

SEQ ID NO: 33661 - protein, 10 aa, Artificial Sequence
  source: /note="Description of Artificial Sequence: Synthetic peptide"
LLLLLPAPEL

SEQ ID NO: 33662 - protein, 9 aa, Artificial Sequence
  source: /note="Description of Artificial Sequence: Synthetic peptide"
AAAAAVAAL

SEQ ID NO: 33663 - protein, 9 aa, Artificial Sequence
  source: /note="Description of Artificial Sequence: Synthetic peptide"
SPSPSQNAT

SEQ ID NO: 33664 - protein, 10 aa, Artificial Sequence
  source: /note="Description of Artificial Sequence: Synthetic peptide"
SPSQNATQTT

SEQ ID NO: 33665 - protein, 9 aa, Artificial Sequence
  source: /note="Description of Artificial Sequence: Synthetic peptide"
HLVSEMKMF

SEQ ID NO: 33666 - protein, 9 aa, Artificial Sequence
  source: /note="Description of Artificial Sequence: Synthetic peptide"
NPIFRFSSL

SEQ ID NO: 33667 - protein, 9 aa, Artificial Sequence
  source: /note="Description of Artificial Sequence: Synthetic peptide"
NLFKRLMIV

SEQ ID NO: 33668 - protein, 9 aa, Artificial Sequence
  source: /note="Description of Artificial Sequence: Synthetic peptide"
ALLTSNSCF

SEQ ID NO: 33669 - protein, 9 aa, Artificial Sequence
  source: /note="Description of Artificial Sequence: Synthetic peptide"
LVLRRRGGM

SEQ ID NO: 33670 - protein, 9 aa, Artificial Sequence
  source: /note="Description of Artificial Sequence: Synthetic peptide"
RVRPMAIYK

SEQ ID NO: 33671 - protein, 9 aa, Artificial Sequence
  source: /note="Description of Artificial Sequence: Synthetic peptide"
IALNSGYGK

SEQ ID NO: 33672 - protein, 9 aa, Artificial Sequence
  source: /note="Description of Artificial Sequence: Synthetic peptide"
VPFDLHFCR

SEQ ID NO: 33673 - protein, 10 aa, Artificial Sequence
  source: /note="Description of Artificial Sequence: Synthetic peptide"
STLHLVLRRR

SEQ ID NO: 33674 - protein, 9 aa, Artificial Sequence
  source: /note="Description of Artificial Sequence: Synthetic peptide"
LLTWHAAML

SEQ ID NO: 33675 - protein, 9 aa, Artificial Sequence
  source: /note="Description of Artificial Sequence: Synthetic peptide"
ATLQRSSLW

SEQ ID NO: 33676 - protein, 10 aa, Artificial Sequence
  source: /note="Description of Artificial Sequence: Synthetic peptide"
VLHECNSSYI

SEQ ID NO: 33677 - protein, 10 aa, Artificial Sequence
  source: /note="Description of Artificial Sequence: Synthetic peptide"
RLLTWHAAML

SEQ ID NO: 33678 - protein, 10 aa, Artificial Sequence
  source: /note="Description of Artificial Sequence: Synthetic peptide"
RLPALRFIGL

SEQ ID NO: 33679 - protein, 9 aa, Artificial Sequence
  source: /note="Description of Artificial Sequence: Synthetic peptide"
LPLPNLRMV

SEQ ID NO: 33680 - protein, 9 aa, Artificial Sequence
  source: /note="Description of Artificial Sequence: Synthetic peptide"
LLSAANLVI

SEQ ID NO: 33681 - protein, 10 aa, Artificial Sequence
  source: /note="Description of Artificial Sequence: Synthetic peptide"
YLDFGIHSGA

SEQ ID NO: 33682 - protein, 9 aa, Artificial Sequence
  source: /note="Description of Artificial Sequence: Synthetic peptide"
YLDFGIHSG

SEQ ID NO: 33683 - protein, 9 aa, Artificial Sequence
  source: /note="Description of Artificial Sequence: Synthetic peptide"
GTGVMICAY

SEQ ID NO: 33684 - protein, 9 aa, Artificial Sequence
  source: /note="Description of Artificial Sequence: Synthetic peptide"
LPALRFIGL

SEQ ID NO: 33685 - protein, 9 aa, Artificial Sequence
  source: /note="Description of Artificial Sequence: Synthetic peptide"
MPALRRSAV

SEQ ID NO: 33686 - protein, 10 aa, Artificial Sequence
  source: /note="Description of Artificial Sequence: Synthetic peptide"
LPPTPPPLPV

SEQ ID NO: 33687 - protein, 10 aa, Artificial Sequence
  source: /note="Description of Artificial Sequence: Synthetic peptide"
SPLPPTPPPL

SEQ ID NO: 33688 - protein, 10 aa, Artificial Sequence
  source: /note="Description of Artificial Sequence: Synthetic peptide"
LLTWHAAMLK

SEQ ID NO: 33689 - protein, 9 aa, Artificial Sequence
  source: /note="Description of Artificial Sequence: Synthetic peptide"
RSSIMKPKR

SEQ ID NO: 33690 - protein, 9 aa, Artificial Sequence
  source: /note="Description of Artificial Sequence: Synthetic peptide"
FLLLTLPKV

SEQ ID NO: 33691 - protein, 9 aa, Artificial Sequence
  source: /note="Description of Artificial Sequence: Synthetic peptide"
RVRDMKCLM

SEQ ID NO: 33692 - protein, 10 aa, Artificial Sequence
  source: /note="Description of Artificial Sequence: Synthetic peptide"
ESGDYKATQK

SEQ ID NO: 33693 - protein, 10 aa, Artificial Sequence
  source: /note="Description of Artificial Sequence: Synthetic peptide"
GLNPLPDVQV

SEQ ID NO: 33694 - protein, 10 aa, Artificial Sequence
  source: /note="Description of Artificial Sequence: Synthetic peptide"
IPPTSRGSSL

SEQ ID NO: 33695 - protein, 9 aa, Artificial Sequence
  source: /note="Description of Artificial Sequence: Synthetic peptide"
PPTSRGSSL

SEQ ID NO: 33696 - protein, 10 aa, Artificial Sequence
  source: /note="Description of Artificial Sequence: Synthetic peptide"
YLNSGIHSGA

SEQ ID NO: 33697 - protein, 10 aa, Artificial Sequence
  source: /note="Description of Artificial Sequence: Synthetic peptide"
ALNSGYGKYL

SEQ ID NO: 33698 - protein, 10 aa, Artificial Sequence
  source: /note="Description of Artificial Sequence: Synthetic peptide"
KLCPQLAENK

SEQ ID NO: 33699 - protein, 9 aa, Artificial Sequence
  source: /note="Description of Artificial Sequence: Synthetic peptide"
VIVCSFAPI

SEQ ID NO: 33700 - protein, 9 aa, Artificial Sequence
  source: /note="Description of Artificial Sequence: Synthetic peptide"
KQMNDARHG

SEQ ID NO: 33701 - protein, 9 aa, Artificial Sequence
  source: /note="Description of Artificial Sequence: Synthetic peptide"
YLNSGIHSG

SEQ ID NO: 33702 - protein, 10 aa, Artificial Sequence
  source: /note="Description of Artificial Sequence: Synthetic peptide"
QEYQELFRHM

SEQ ID NO: 33703 - protein, 10 aa, Artificial Sequence
  source: /note="Description of Artificial Sequence: Synthetic peptide"
ILDVIVCSFA

SEQ ID NO: 33704 - protein, 10 aa, Artificial Sequence
  source: /note="Description of Artificial Sequence: Synthetic peptide"
RETFHLVSEM

SEQ ID NO: 33705 - protein, 10 aa, Artificial Sequence
  source: /note="Description of Artificial Sequence: Synthetic peptide"
RMVRRAAASK

SEQ ID NO: 33706 - protein, 10 aa, Artificial Sequence
  source: /note="Description of Artificial Sequence: Synthetic peptide"
AAAAAAVAAL

SEQ ID NO: 33707 - protein, 9 aa, Artificial Sequence
  source: /note="Description of Artificial Sequence: Synthetic peptide"
SARKSNFSL

SEQ ID NO: 33708 - protein, 10 aa, Artificial Sequence
  source: /note="Description of Artificial Sequence: Synthetic peptide"
RVAGRRALSR

SEQ ID NO: 33709 - protein, 10 aa, Artificial Sequence
  source: /note="Description of Artificial Sequence: Synthetic peptide"
TTPPLQHGHR

SEQ ID NO: 33710 - protein, 9 aa, Artificial Sequence
  source: /note="Description of Artificial Sequence: Synthetic peptide"
FHLVSEMKM

SEQ ID NO: 33711 - protein, 10 aa, Artificial Sequence
  source: /note="Description of Artificial Sequence: Synthetic peptide"
SIMMSWMPPL

SEQ ID NO: 33712 - protein, 9 aa, Artificial Sequence
  source: /note="Description of Artificial Sequence: Synthetic peptide"
KLEGLELEV

SEQ ID NO: 33713 - protein, 9 aa, Artificial Sequence
  source: /note="Description of Artificial Sequence: Synthetic peptide"
WTSSRSARK

SEQ ID NO: 33714 - protein, 9 aa, Artificial Sequence
  source: /note="Description of Artificial Sequence: Synthetic peptide"
GAAATAAAV

SEQ ID NO: 33715 - protein, 9 aa, Artificial Sequence
  source: /note="Description of Artificial Sequence: Synthetic peptide"
MPILTIITL

SEQ ID NO: 33716 - protein, 10 aa, Artificial Sequence
  source: /note="Description of Artificial Sequence: Synthetic peptide"
QLNHVDGSSK

SEQ ID NO: 33717 - protein, 9 aa, Artificial Sequence
  source: /note="Description of Artificial Sequence: Synthetic peptide"
EEDAEAWAM

SEQ ID NO: 33718 - protein, 9 aa, Artificial Sequence
  source: /note="Description of Artificial Sequence: Synthetic peptide"
HMHLIRHQK

SEQ ID NO: 33719 - protein, 9 aa, Artificial Sequence
  source: /note="Description of Artificial Sequence: Synthetic peptide"
LSDSRTALK

SEQ ID NO: 33720 - protein, 9 aa, Artificial Sequence
  source: /note="Description of Artificial Sequence: Synthetic peptide"
EETEAQHLY

SEQ ID NO: 33721 - protein, 9 aa, Artificial Sequence
  source: /note="Description of Artificial Sequence: Synthetic peptide"
SSLSHISAL

SEQ ID NO: 33722 - protein, 9 aa, Artificial Sequence
  source: /note="Description of Artificial Sequence: Synthetic peptide"
FGRAKLLGA

SEQ ID NO: 33723 - protein, 10 aa, Artificial Sequence
  source: /note="Description of Artificial Sequence: Synthetic peptide"
RMPILTIITL

SEQ ID NO: 33724 - protein, 10 aa, Artificial Sequence
  source: /note="Description of Artificial Sequence: Synthetic peptide"
TEAQHLYQSI

SEQ ID NO: 33725 - protein, 9 aa, Artificial Sequence
  source: /note="Description of Artificial Sequence: Synthetic peptide"
EVALSVLSK

SEQ ID NO: 33726 - protein, 9 aa, Artificial Sequence
  source: /note="Description of Artificial Sequence: Synthetic peptide"
MFLKAESKI

SEQ ID NO: 33727 - protein, 10 aa, Artificial Sequence
  source: /note="Description of Artificial Sequence: Synthetic peptide"
RIALNSGYGK

SEQ ID NO: 33728 - protein, 10 aa, Artificial Sequence
  source: /note="Description of Artificial Sequence: Synthetic peptide"
YLDSRIHSGA

SEQ ID NO: 33729 - protein, 9 aa, Artificial Sequence
  source: /note="Description of Artificial Sequence: Synthetic peptide"
LSASNSCFI

SEQ ID NO: 33730 - protein, 9 aa, Artificial Sequence
  source: /note="Description of Artificial Sequence: Synthetic peptide"
TPAPPPVPT

SEQ ID NO: 33731 - protein, 9 aa, Artificial Sequence
  source: /note="Description of Artificial Sequence: Synthetic peptide"
VPTCSPRTL

SEQ ID NO: 33732 - protein, 9 aa, Artificial Sequence
  source: /note="Description of Artificial Sequence: Synthetic peptide"
RPGLHRFVV

SEQ ID NO: 33733 - protein, 6 aa, Artificial Sequence
  source: /note="Description of Artificial Sequence: Synthetic 6xHis tag"
HHHHHH
